US012098361B2

(12) United States Patent
Hess et al.

(10) Patent No.: US 12,098,361 B2
(45) Date of Patent: Sep. 24, 2024

(54) ATTENUATED *HISTOMONAS MELEAGRIDIS* STRAIN AND VACCINE

(71) Applicant: VETERINÄRMEDIZINISCHE UNIVERSITÄT WIEN, Vienna (AT)

(72) Inventors: Michael Hess, Vienna (AT); Ivana Bilic, Vienna (AT); Nicola Palmieri, Vienna (AT)

(73) Assignee: VETERINÄRMEDIZINISCHE UNIVERSITÄT WIEN, Vienna (AT)

( * ) Notice: Subject to any disclaimer, the term of this patent is extended or adjusted under 35 U.S.C. 154(b) by 0 days.

(21) Appl. No.: 17/851,692

(22) Filed: Jun. 28, 2022

(65) Prior Publication Data

US 2023/0045943 A1 Feb. 16, 2023

(30) Foreign Application Priority Data

Jun. 29, 2021 (EP) .................................... 21182469

(51) Int. Cl.
*C12N 1/10* (2006.01)
*A61K 39/002* (2006.01)
*A61P 33/04* (2006.01)
*A61K 39/00* (2006.01)

(52) U.S. Cl.
CPC .............. *C12N 1/10* (2013.01); *A61K 39/002* (2013.01); *A61P 33/04* (2018.01); *A61K 2039/522* (2013.01)

(58) Field of Classification Search
None
See application file for complete search history.

(56) References Cited

FOREIGN PATENT DOCUMENTS

WO WO 2014/006018 A 1/2014

OTHER PUBLICATIONS

Hess, M., et al., "Cloned *Histomonas meleagridis* passaged in vitro resulted in reduced pathogenicity and is capable of protecting turkeys from histomonosis", Vaccine, (2008), pp. 4187-4193, vol. 26.

European Search Report dated Jan. 14, 2022 for European Application No. 21182469.3-1118.

*Primary Examiner* — Oluwatosin A Ogunbiyi

(74) *Attorney, Agent, or Firm* — Greer, Burns & Crain, Ltd

(57) ABSTRACT

A *Histomonas meleagridis* strain having at least one of the following attenuating features (a) an inactivation of a gene, wherein the gene has the sequence identified by SEQ ID NO: 1 or a sequence with at least 90% sequence identity thereto, (b) an inactivation of a gene, wherein the gene has the sequence identified by SEQ ID NO: 2 or a sequence with at least 90% sequence identity thereto, (c) a truncating mutation in the coding sequence of a gene, wherein the gene has the unmutated coding sequence identified by SEQ ID NO: 3 or an unmutated coding sequence with at least 95% sequence identity thereto, and (d) a truncating mutation in the coding sequence of a gene, wherein the gene has the unmutated coding sequence identified by SEQ ID NO: 4 or an unmutated coding sequence with at least 95% sequence identity thereto. An anti-histomonosis vaccine containing the strain.

19 Claims, 17 Drawing Sheets

Specification includes a Sequence Listing.

(a)

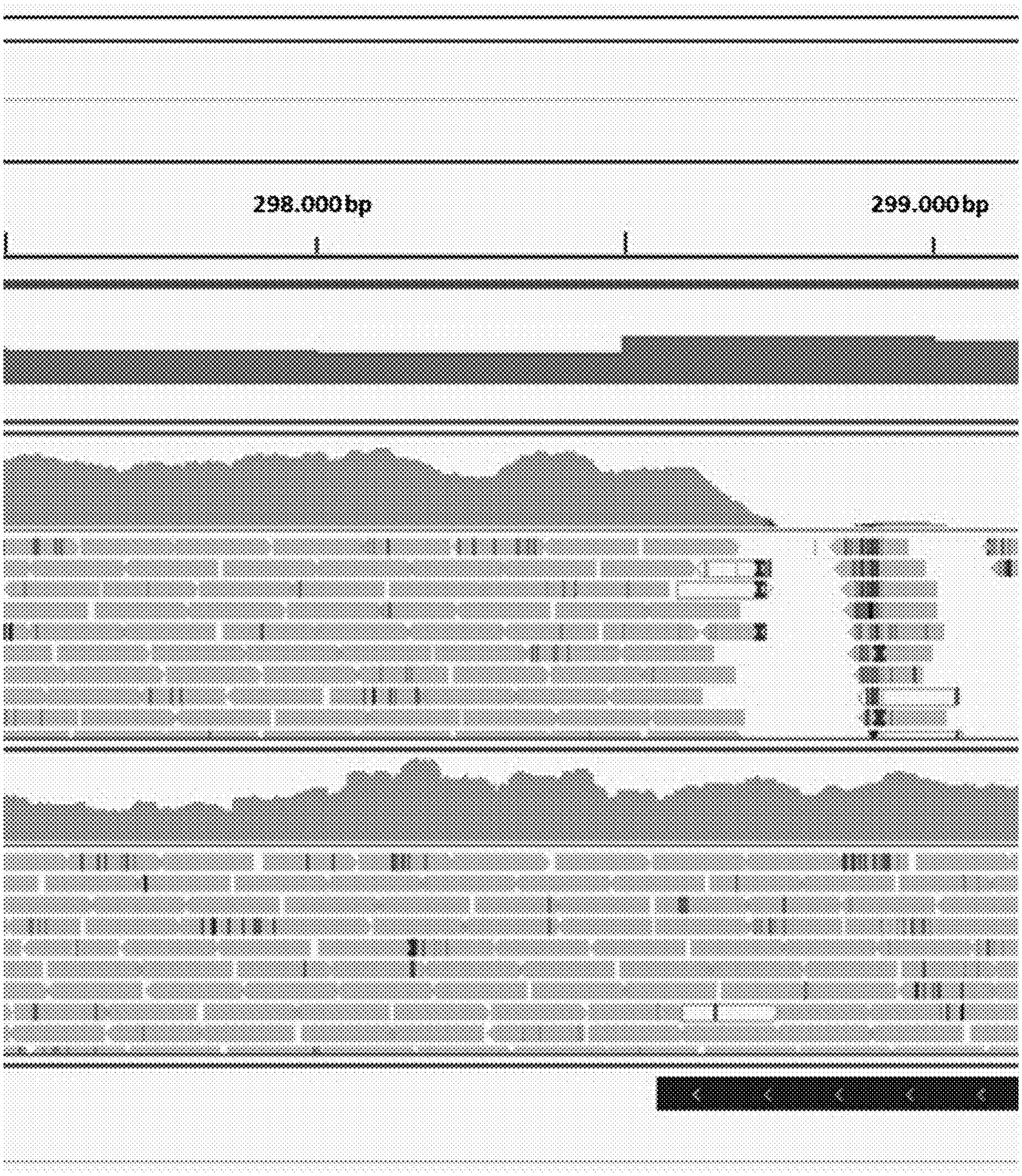
Fig. 2 (ctd)

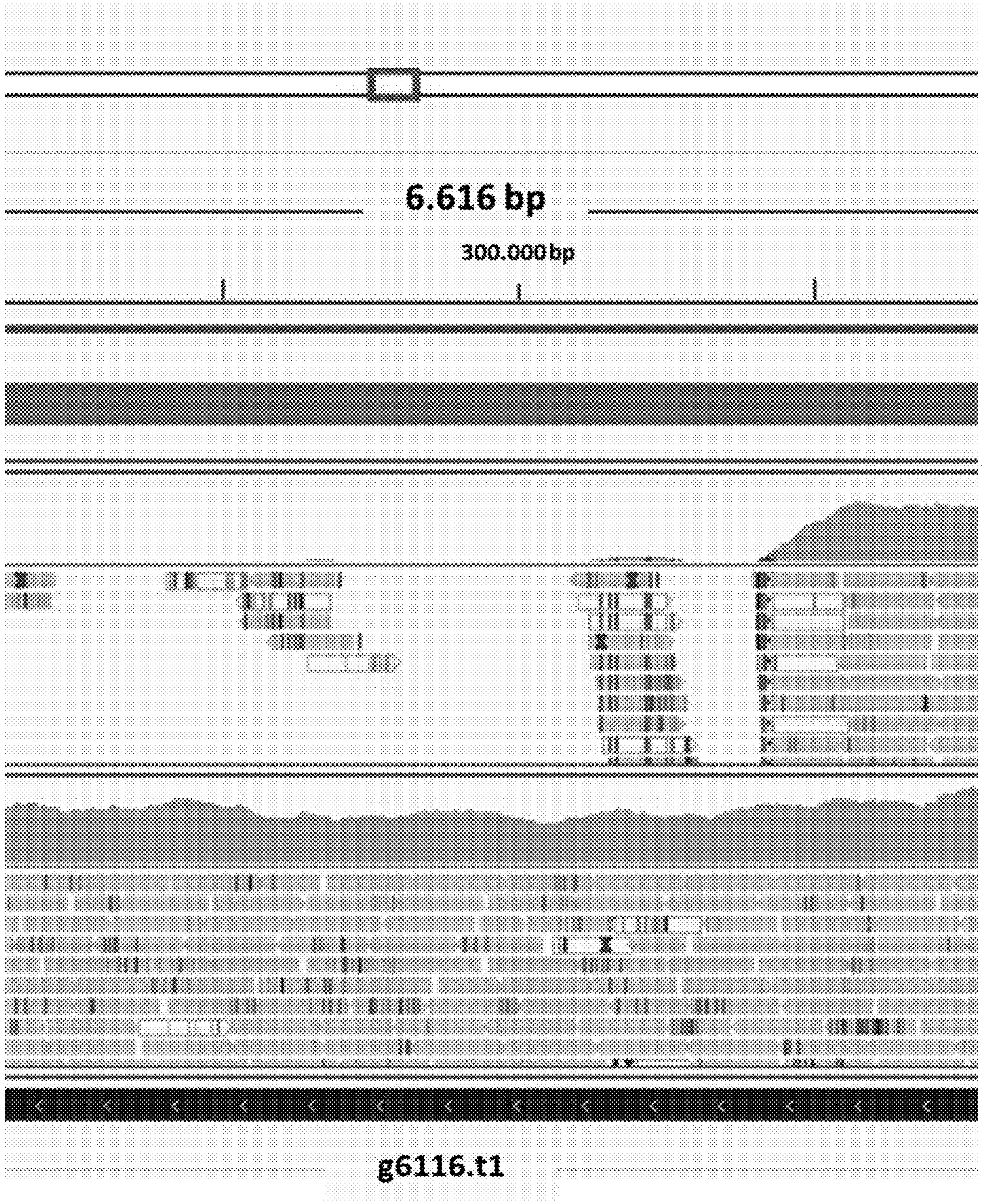
Fig. 2 (ctd)

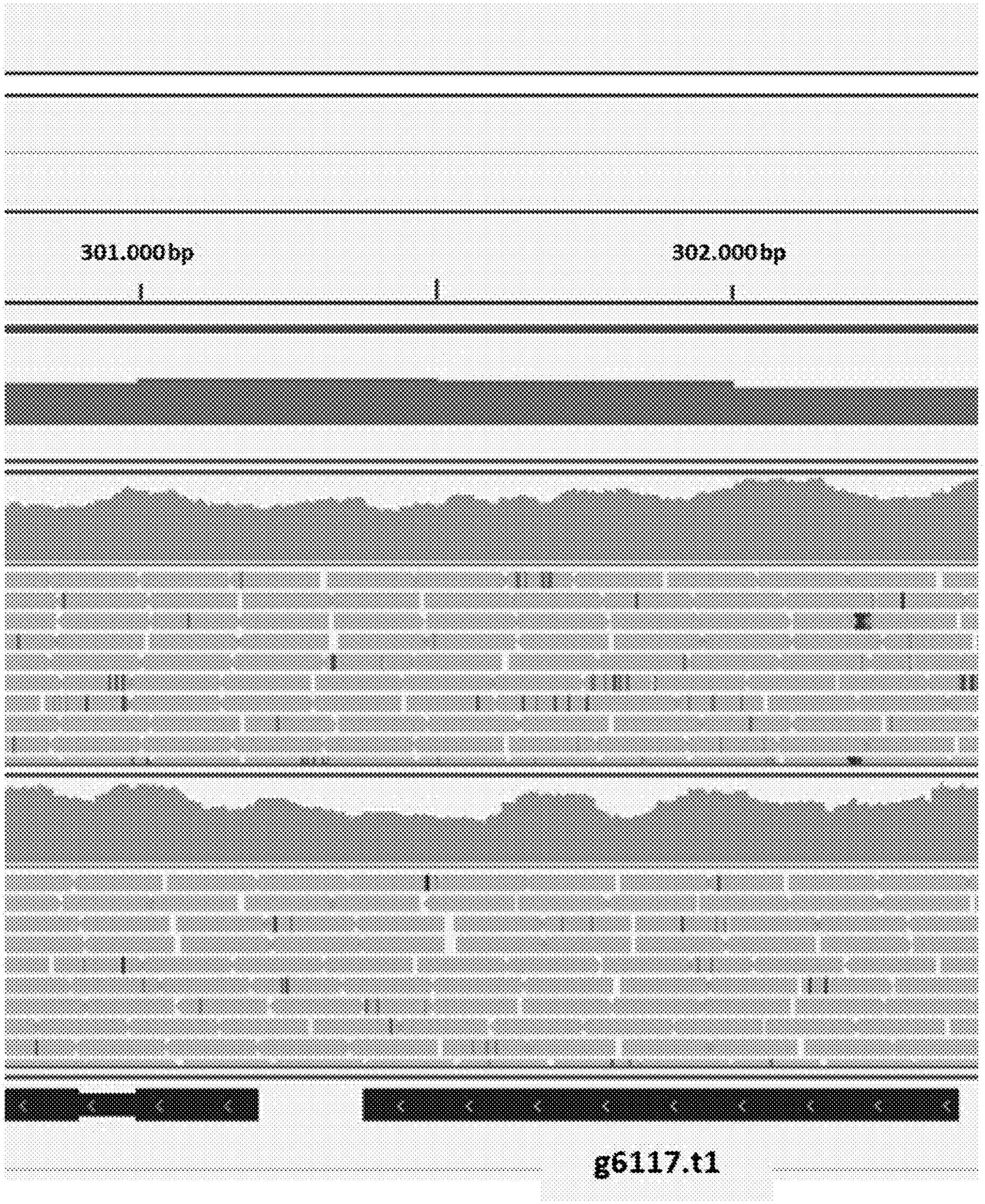
Fig. 2 (ctd)

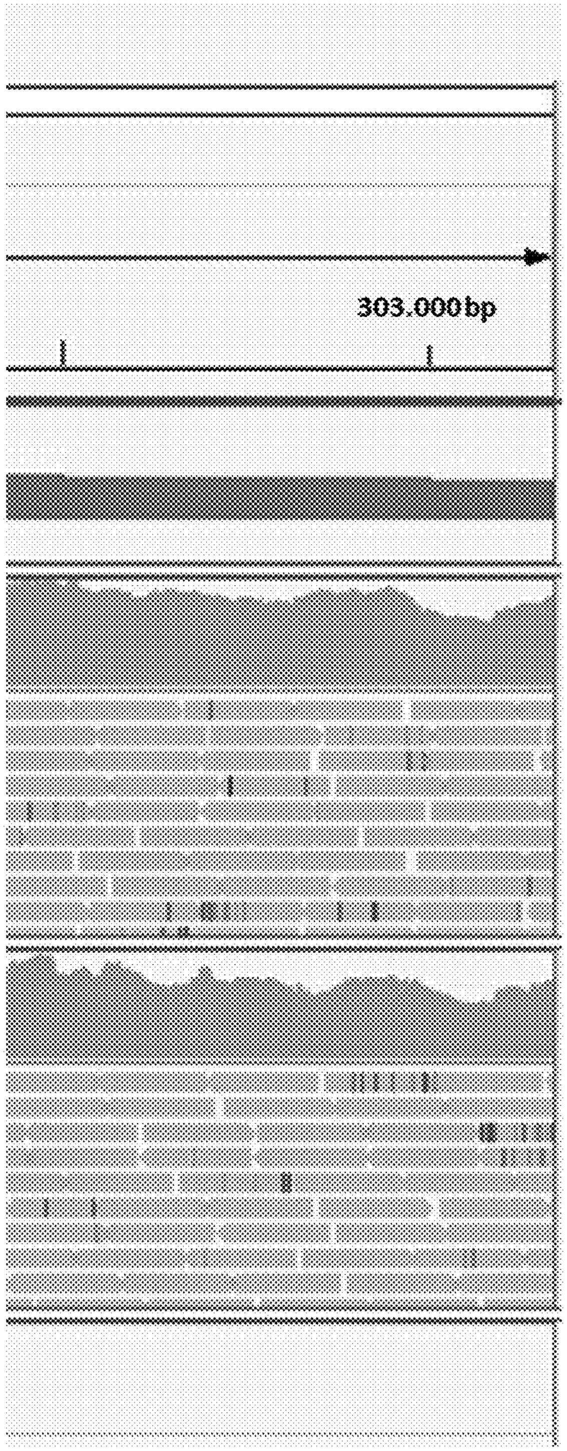
Fig. 2 (ctd)

(b)
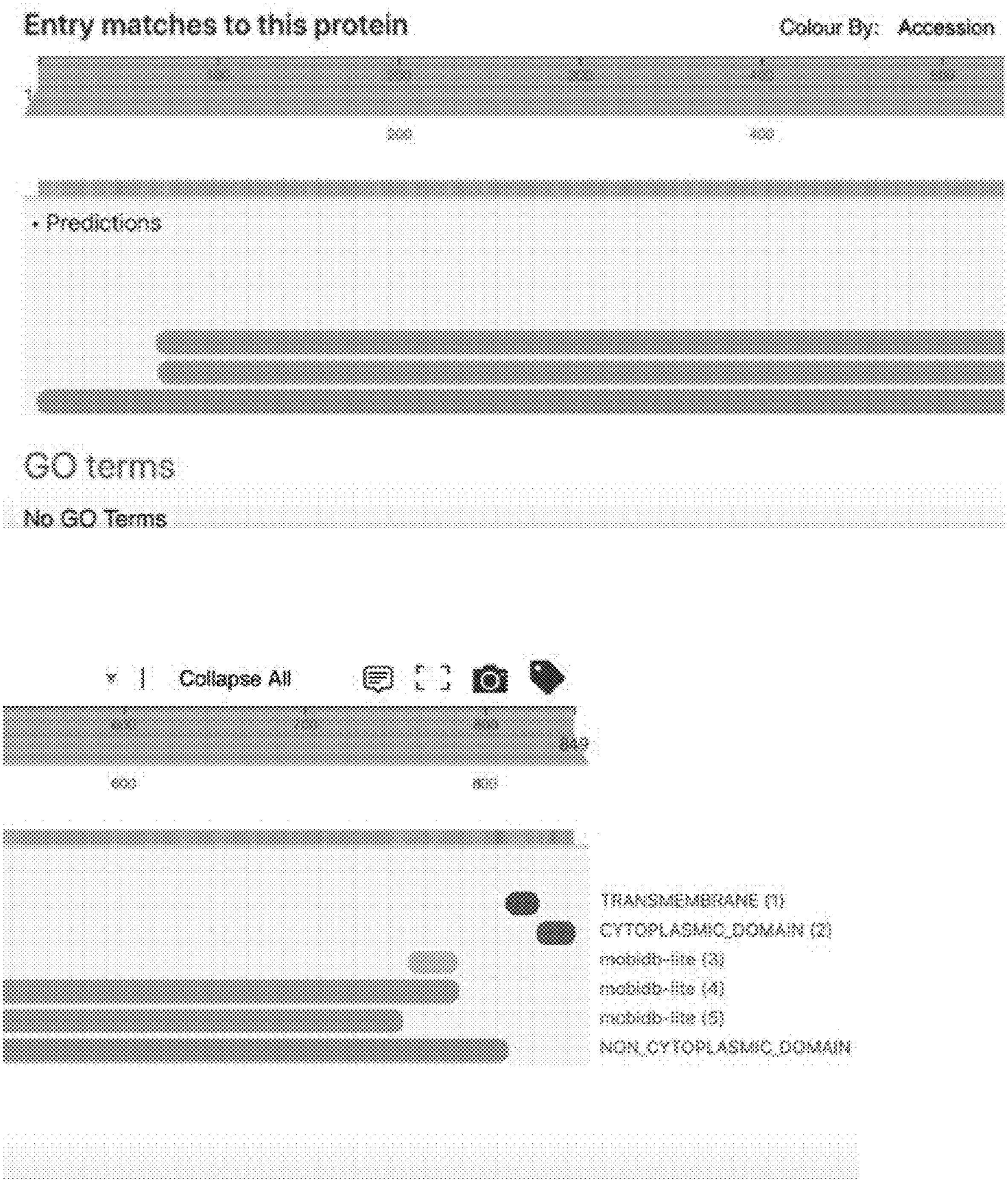
Fig. 2 (ctd)

(a)

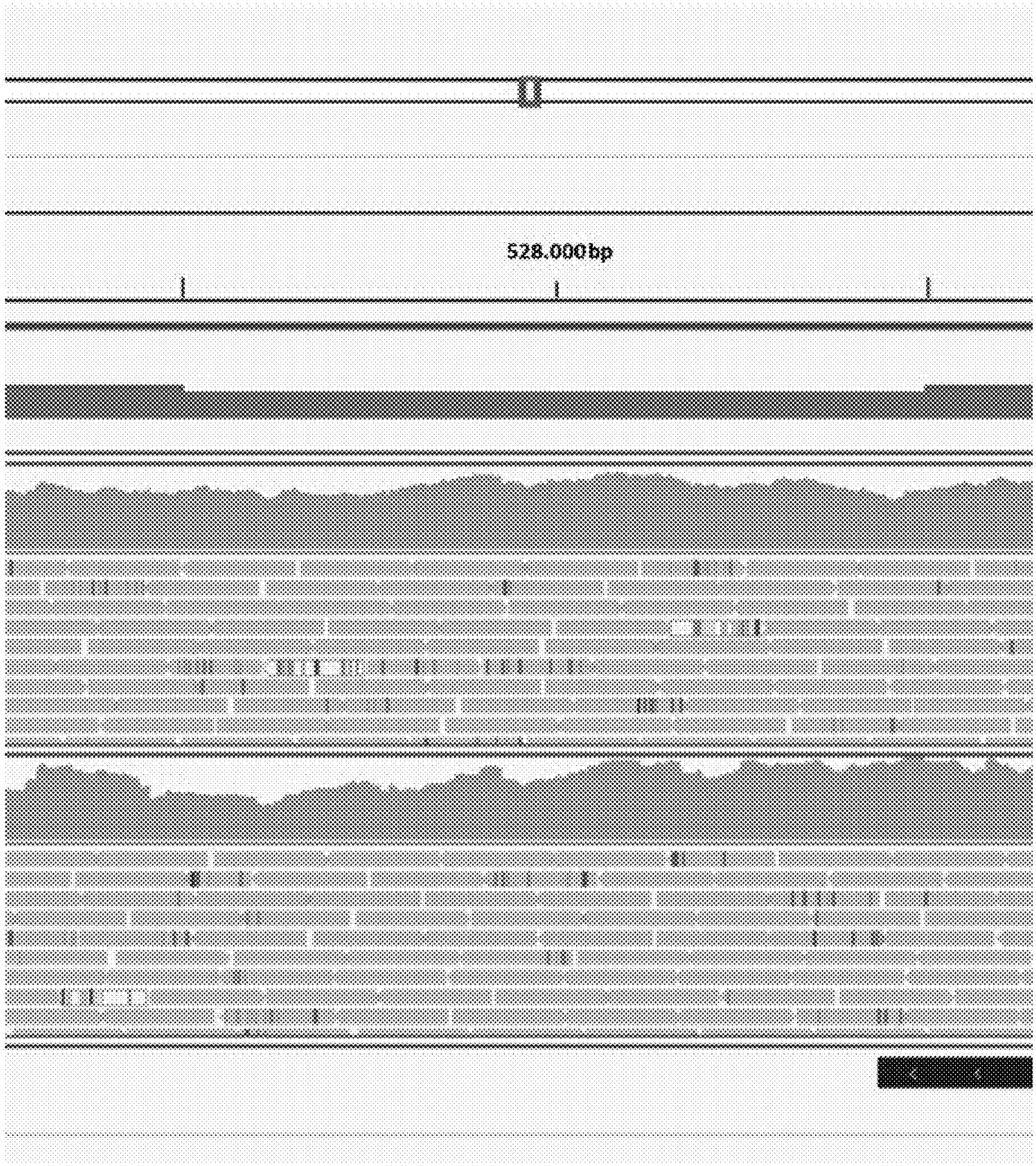
Fig. 3 (ctd)

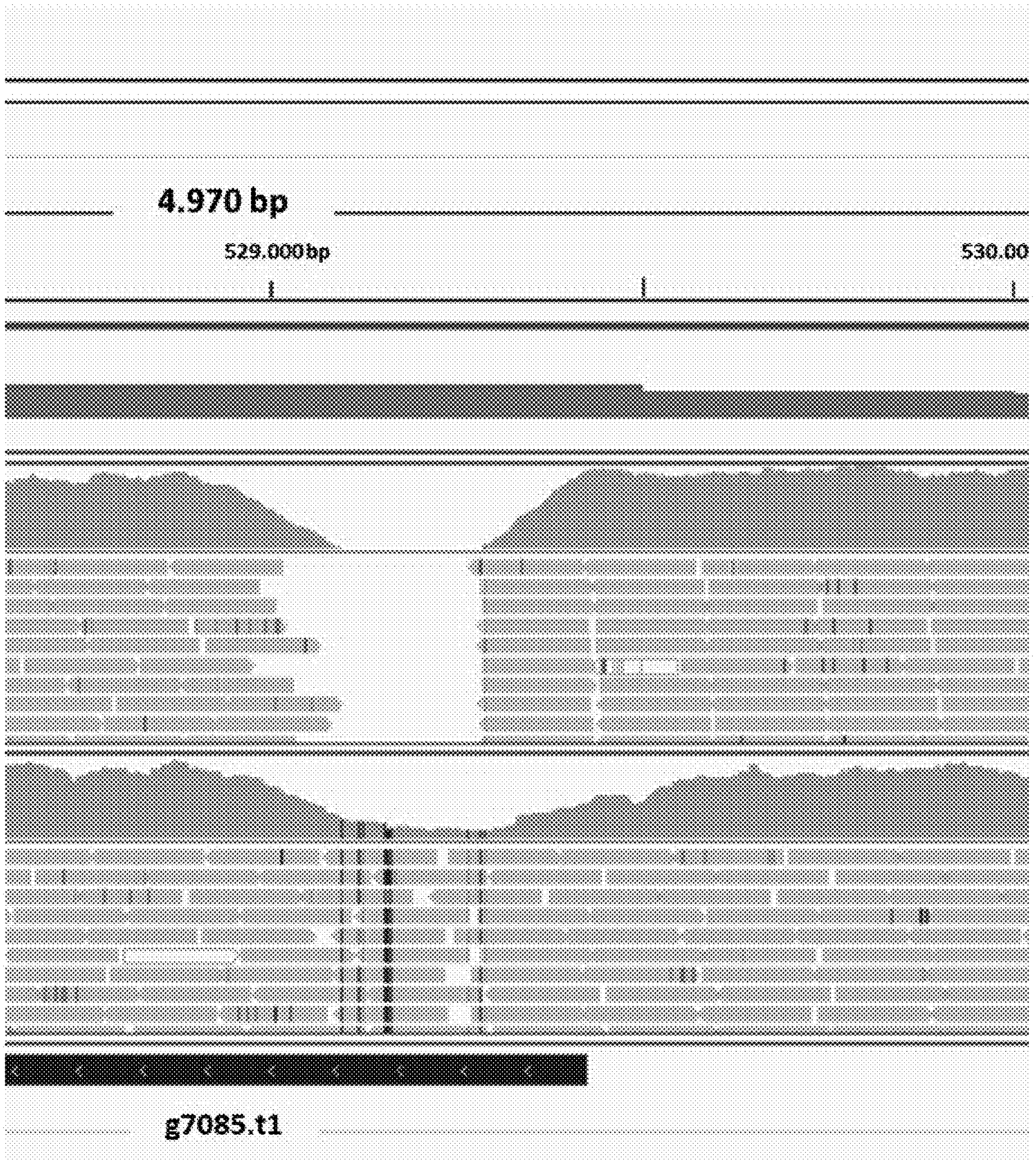
Fig. 3 (ctd)

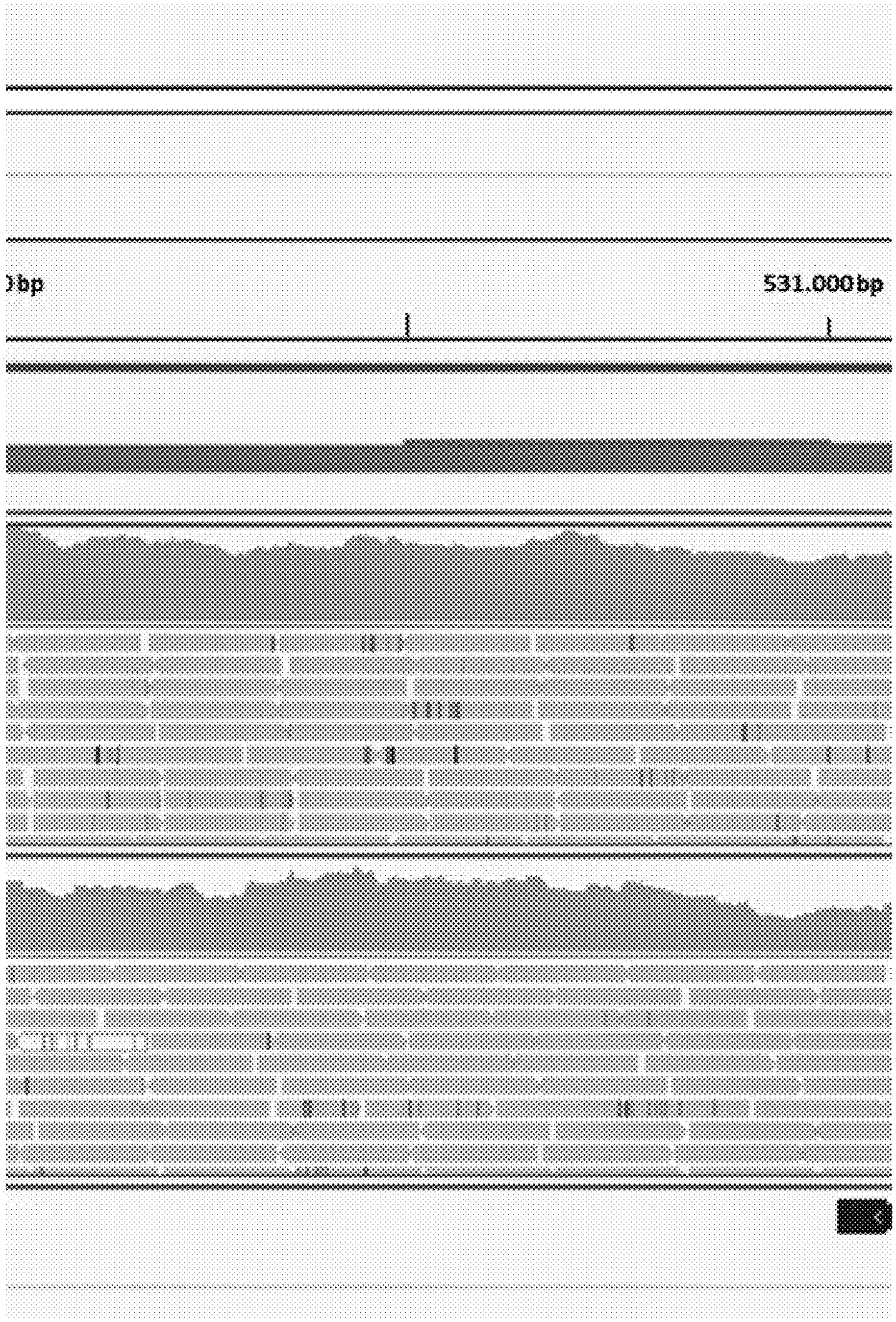
Fig. 3 (ctd)

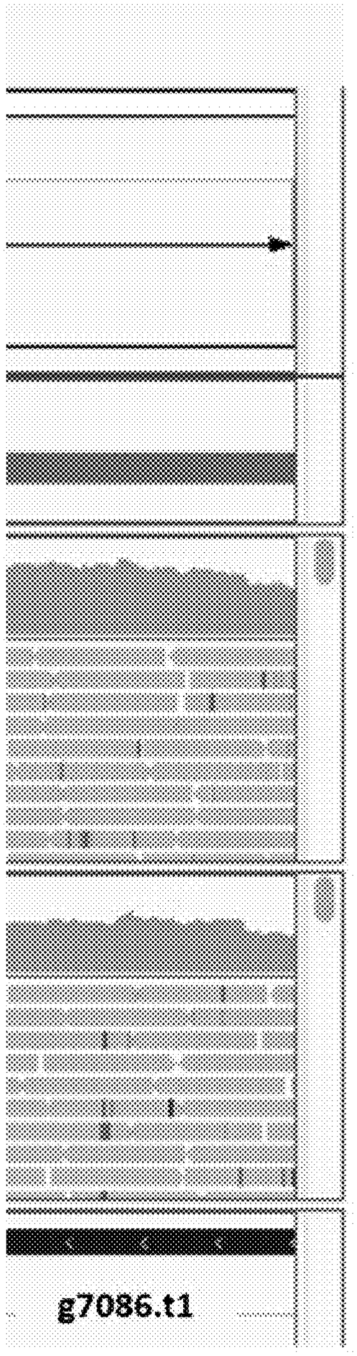
Fig. 3 (ctd)

(b)

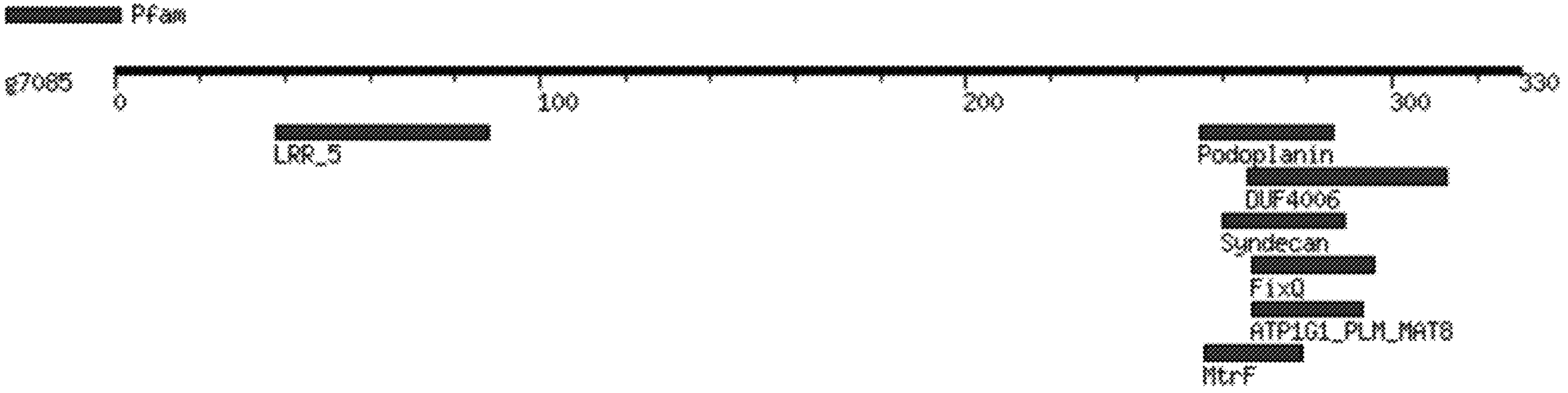

Pfam (7 motifs)

| Pfam | Position(Independent E-value) | | Description |
|---|---|---|---|
| LRR_5 | 38..88(6.1e-08) | Detail | PF13306, BspA type Leucine rich repeat region (6 copies) |
| Podoplanin | 255..286(0.0027) | Detail | PF05808, Podoplanin |
| DUF4006 | 266..313(0.065) | Detail | PF13179, Family of unknown function (DUF4006) |
| Syndecan | 260..289(0.18) | Detail | PF01034, Syndecan domain |
| FixQ | 267..296(0.28) | Detail | PF05545, Cbb3-type cytochrome oxidase component FixQ |
| ATP1G1_PLM_MAT8 | 267..293(0.54) | Detail | PF02038, ATP1G1/PLM/MAT8 family |
| MtrF | 256..279(0.77) | Detail | PF09472, Tetrahydromethanopterin S-methyltransferase, F subunit (MtrF) |

Fig. 3 (ctd)

(c)
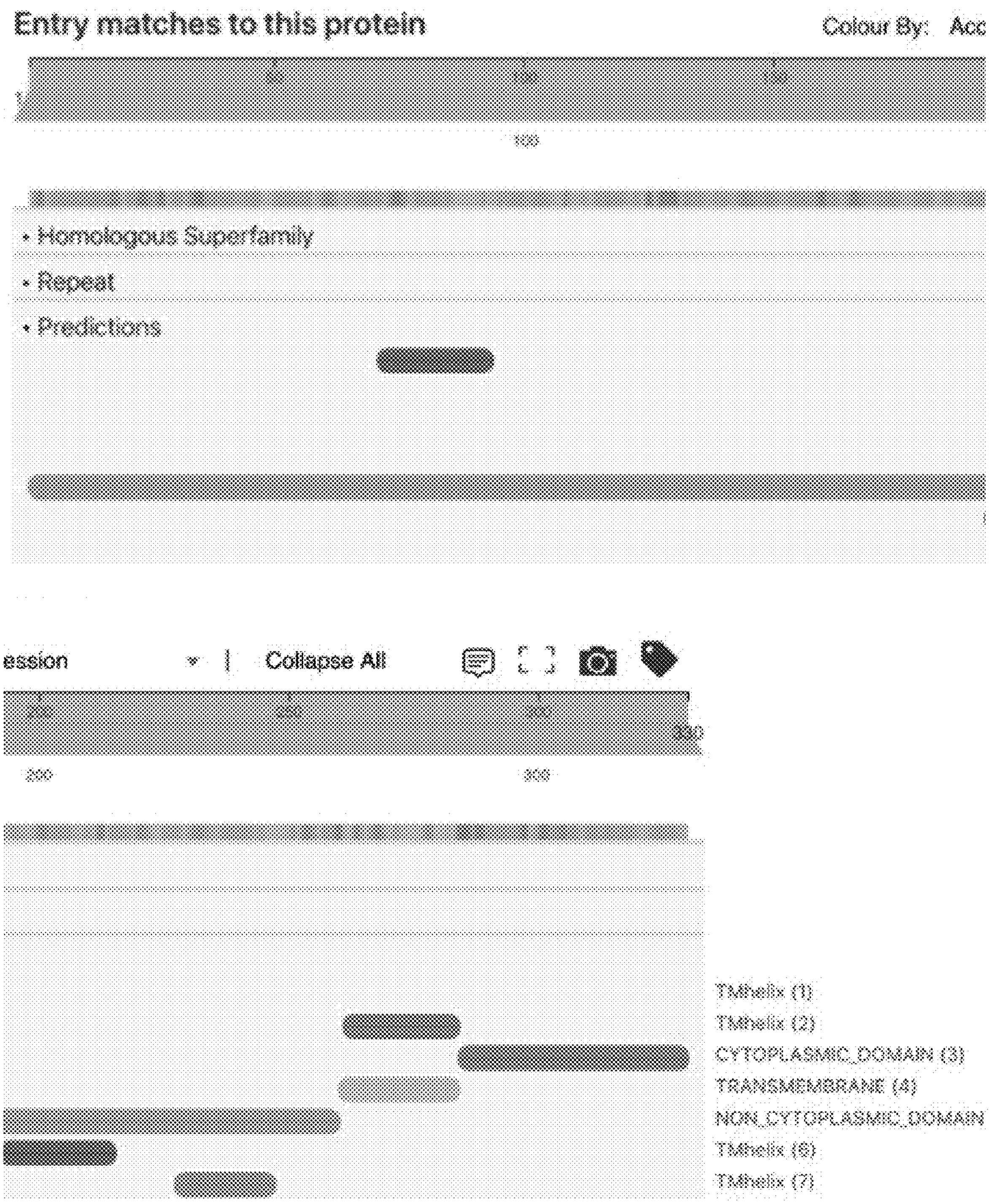
Fig. 3 (ctd)

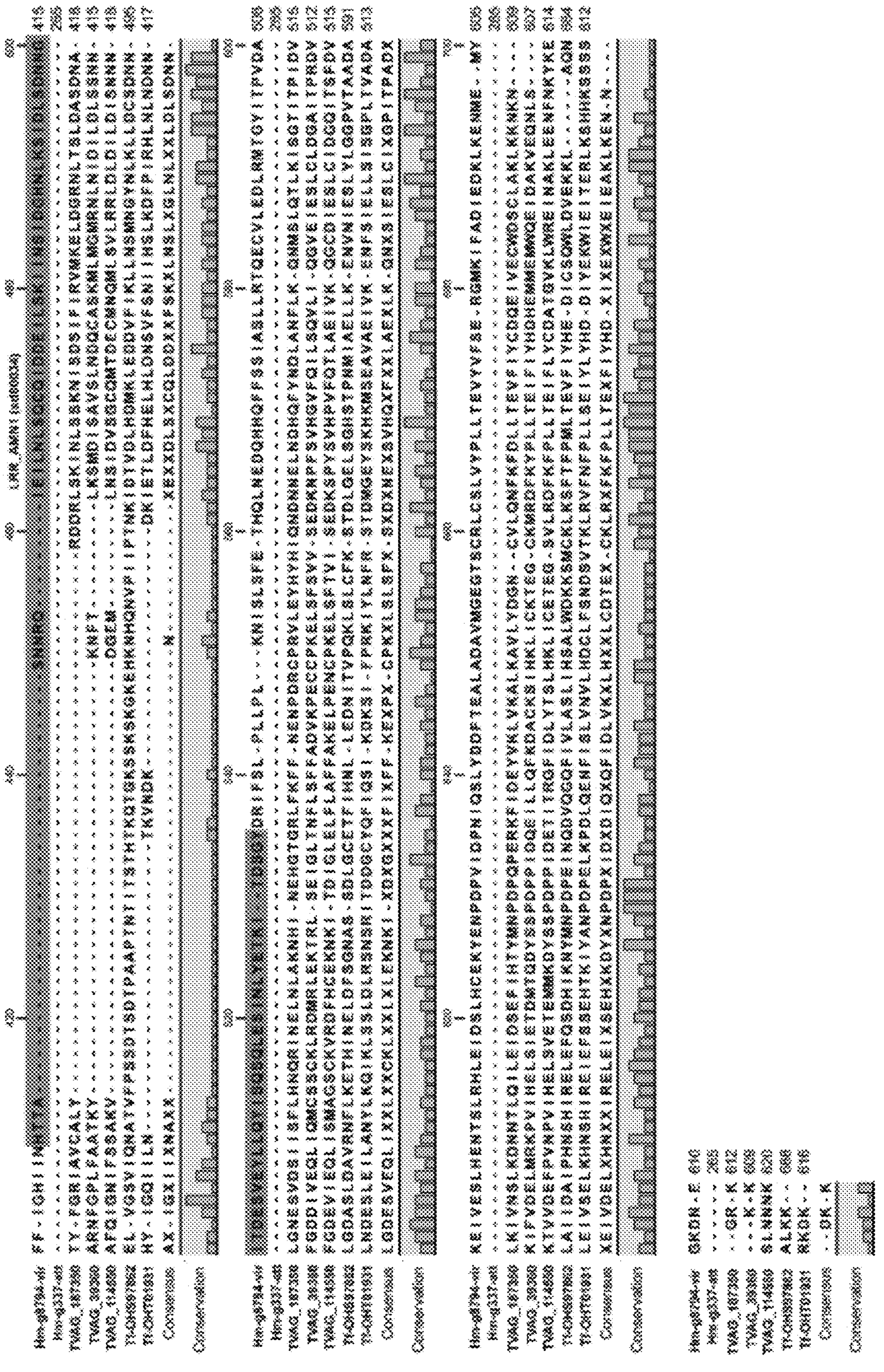
Fig. 4 (ctd)

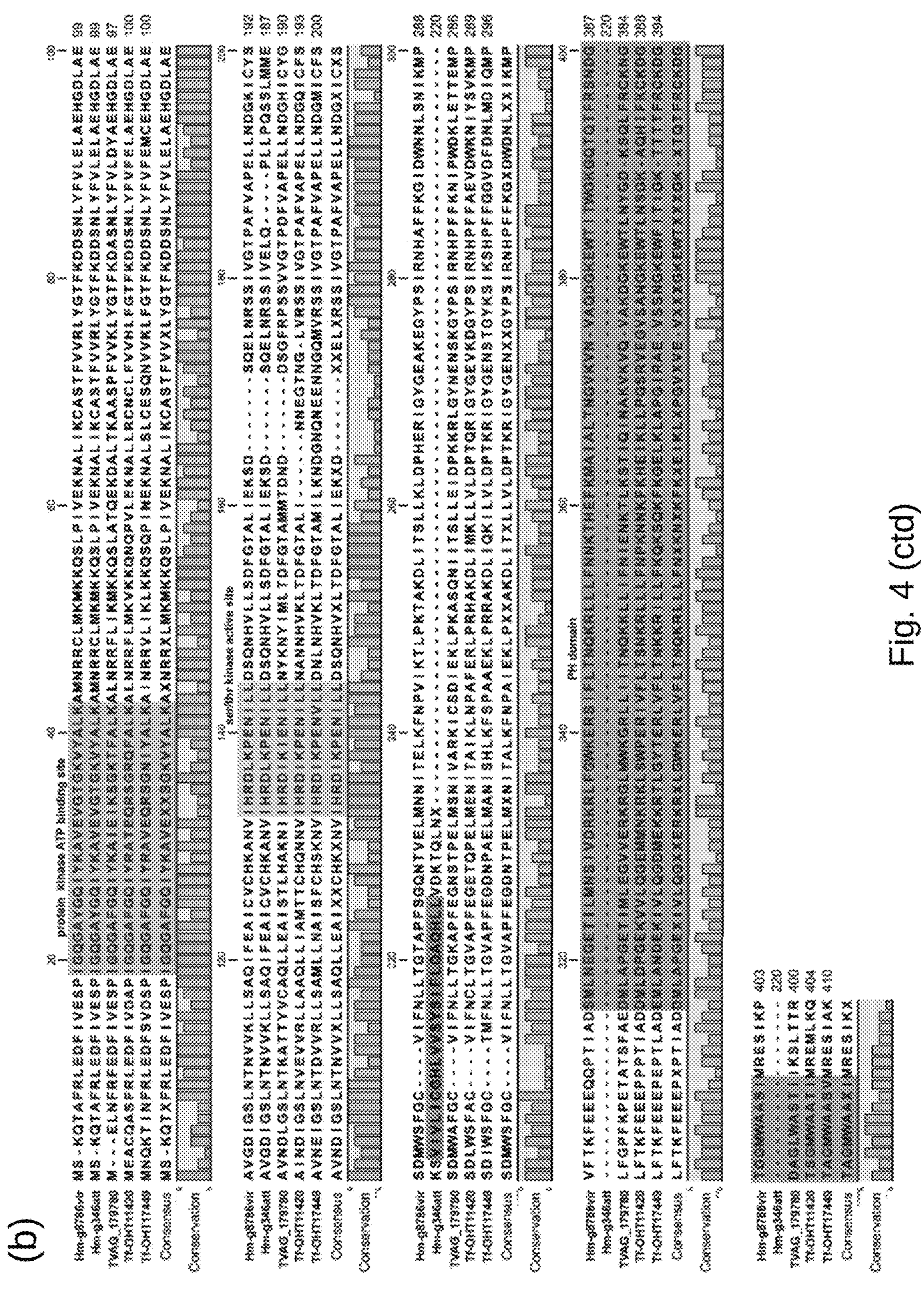
Fig. 4 (ctd)

ATTENUATED *HISTOMONAS MELEAGRIDIS* STRAIN AND VACCINE

CROSS-REFERENCE TO RELATED APPLICATIONS

This Application claims the benefit of foreign priority to EP Patent Application EP 21182469.3 filed Jun. 29, 2021, the entire disclosure of which is herein incorporated by reference.

Incorporation by Reference of the Sequence Listing

The content of the ASCII text file of the sequence listing named-1AR1888.TXT 1B78174, 4939226-4727000 bytes in size, created on Sep. 16, 2022, is incorporated herein by reference in its entirety.

BACKGROUND SECTION

The field of the invention relates to attenuated *Histomonas meleagridis* (*H. meleagridis*) strains and vaccines against histomonosis based thereon.

*H. meleagridis* is a flagellated extracellular poultry parasite of the order Tritrichomonadida. It causes histomonosis (also called histomoniasis, blackhead disease or infectious typhlohepatitis), an important disease of gallinaceous birds, especially in turkeys and chickens. The disease can be very devastating in turkeys, in which the parasite causes serious ceacal lesions and liver necrosis that can lead up to 100% mortality (McDougald, 2005). In chickens, histomonosis is typically less severe and the infection is generally confined to the caeca (Hess et al., 2015). Histomonosis and the parasite are known for more than 100 years, which in the second half of the 20th century led to the introduction of effective prophylactic and chemotherapeutic drugs with the almost disappearance of the disease (Liebhart et al., 2017). The situation drastically changed at the beginning of the present century, when these active compounds were banned as a result of amendments in drug legislation in the European Union and the USA and histomonosis reappeared with most severe consequences in turkeys (Clark & Kimminau, 2017). In addition, histomonosis became more prevalent in chickens aided by the tendency to increase free-range farming, enabling bird's easy access to the parasite.

In an attempt to prevent mortality, veterinarians can only rely on the implementation of proper flock management and the very early administration of the aminoglycoside antibiotic paramomycin, often without success. Accordingly, safe and effective vaccines against histomonosis are needed.

WO 2014/006018 A1 discloses a vaccine formulation consisting of a *Histomonas* component consisting of an attenuated culture of *H. meleagridis*, a bacterial component consisting of one or more single bacterial strains, and pharmaceutically acceptable non-biological formulation compounds.

Hess et al., 2008, discloses an attenuated culture of *H. meleagridis* which is used for the formulation of a live vaccine. EP 1 721 965 A1 also discloses such an attenuated culture.

However, producing an attenuated culture of *H. meleagridis*, especially when starting from a field isolate, is a time-consuming and laborious process when based on conventional methods such as prolonged passaging of the *H. meleagridis* cells in vitro without any guided selection for genomic traits. It is therefore an object of the present invention to provide improved methods of attenuating *H. meleagridis* as well as attenuated *H. meleagridis* strains and vaccines based thereon.

SUMMARY

The present invention provides an *H. meleagridis* strain having at least one attenuating feature selected from the group consisting of:

(a) an inactivation of a gene, wherein the gene has the sequence identified by SEQ ID NO: 1 or a sequence with at least 90%, preferably at least 93%, more preferably at least 95%, even more preferably at least 97.5%, yet even more preferably at least 98%, especially at least 99% sequence identity thereto (i.e. to the entire sequence identified by SEQ ID NO: 1), (b) an inactivation of a gene, wherein the gene has the sequence identified by SEQ ID NO: 2 or a sequence with at least 90%, preferably at least 93%, more preferably at least 95%, even more preferably at least 97.5%, yet even more preferably at least 98%, especially at least 99% sequence identity thereto (i.e. to the entire sequence identified by SEQ ID NO: 2), (c) a truncating mutation in the coding sequence of a gene, wherein the gene has the unmutated coding sequence identified by SEQ ID NO: 3 or an unmutated coding sequence with at least 95%, preferably at least 96%, more preferably at least 97%, even more preferably at least 98%, yet even more preferably at least 99%, especially at least 99.5% or even at least 99.9% sequence identity thereto (i.e. to the entire sequence identified by SEQ ID NO: 3), and (d) a truncating mutation in the coding sequence of a gene, wherein the gene has the unmutated coding sequence identified by SEQ ID NO: 4 or an unmutated coding sequence with at least 95%, preferably at least 96%, more preferably at least 97%, even more preferably at least 98%, yet even more preferably at least 99%, especially at least 99.5% or even at least 99.9% sequence identity thereto (i.e. to the entire sequence identified by SEQ ID NO: 4).

The present invention further provides an *H. meleagridis* strain having at least one attenuating feature verifiable by:

(a) a genomic PCR of the strain with forward primer AGGATGTTTCAATTTCCTCGC (SEQ ID NO: 7) and reverse primer CGGTTGTCCATTTTTCAAACAG ((SEQ ID NO: 8) not yielding a product, (b) a genomic PCR of the strain with forward primer GCGGGAAAACAAACGAAAC (SEQ ID NO: 9) and reverse primer ATAGCCATTGGTCCTGGTC (SEQ ID NO: 10) yielding a product with a size between 850 bp to 950 bp (e.g. 894 bp) comprising the sequence identified by SEQ ID NO: 15 or a sequence with at least 90%, preferably at least 93%, more preferably at least 95%, even more preferably at least 97.5%, yet even more preferably at least 98%, especially at least 99% sequence identity thereto (i.e. to the entire sequence identified by SEQ ID NO: 15), (c) a genomic PCR of the strain with forward primer TTGATTATGGGGCAACAGAAG (SEQ ID NO: 11) and reverse primer TTGGCGAAGTCTTTCAAGAG (SEQ ID NO: 12) yielding a product with a size between 450 bp to 550 bp (e.g. 488 bp) comprising the sequence identified by SEQ ID NO: 16, or (d) a genomic PCR of the strain with forward primer AAATGTTATCCATCGTGACCTC (SEQ ID NO: 13) and reverse primer GATAGCCTTCTTTGGCTTCC (SEQ ID NO: 14) yielding a product with a size between 350 bp to 450 bp (e.g. 409 bp) comprising the sequence identified by SEQ ID NO: 17.

In a further aspect, the present invention provides a method of attenuating *H. meleagridis*, comprising the steps of obtaining *H. meleagridis* cells; and introducing at least one attenuating feature selected from the group consisting of:

(a) an inactivation of a gene, wherein the gene has the sequence identified by SEQ ID NO: 1 or a sequence with at least 90%, preferably at least 93%, more preferably at least 95%, even more preferably at least 97.5%, yet even more preferably at least 98%, especially at least 99% sequence identity thereto (i.e. to the entire sequence identified by SEQ ID NO: 1), (b) an inactivation of a gene, wherein the gene has the sequence identified by SEQ ID NO: 2 or a sequence with at least 90%, preferably at least 93%, more preferably at least 95%, even more preferably at least 97.5%, yet even more preferably at least 98%, especially at least 99% sequence identity thereto (i.e. to the entire sequence identified by SEQ ID NO: 2), (c) a truncating mutation in the coding sequence of a gene, wherein the gene has the unmutated coding sequence identified by SEQ ID NO: 3 or an unmutated coding sequence with at least 95%, preferably at least 96%, more preferably at least 97%, even more preferably at least 98%, yet even more preferably at least 99%, especially at least 99.5% or even at least 99.9% sequence identity thereto (i.e. to the entire sequence identified by SEQ ID NO: 3), and (d) a truncating mutation in the coding sequence of a gene, wherein the gene has the unmutated coding sequence identified by SEQ ID NO: 4 or an unmutated coding sequence with at least 95%, preferably at least 96%, more preferably at least 97%, even more preferably at least 98%, yet even more preferably at least 99%, especially at least 99.5% or even at least 99.9% sequence identity thereto (i.e. to the entire sequence identified by SEQ ID NO: 4), into at least one of the *H. meleagridis* cells. Also provided is a cell obtainable by such method.

In another aspect, the present invention provides a vaccine comprising cells of the strain as defined herein or cells as defined herein, wherein the cells are live or inactivated, and at least one pharmaceutically acceptable excipient. This vaccine is preferably for use in prevention of histomonosis. It is preferably formulated as a gel or as a semi-solid matrix.

In yet another aspect, the present invention provides a method of vaccinating a bird against histomonosis, comprising the steps of obtaining the vaccine as defined herein and administering the vaccine to the bird.

In the course of the present invention, the genomes of a virulent *H. meleagridis* strain as well as of an attenuated *H. meleagridis* strain were sequenced to obtain the first whole genome sequences of *H. meleagridis*. Four genes were identified whose inactivation or disruption by mutation was involved in attenuation. Based on this, the strain of the present invention can be obtained e.g. by guided selection for mutations acquired during passaging or acquired by mutagenesis or, more directly, genome editing such as by CRISPR-Cas. Further, the present invention simplifies and accelerates attenuation of *H. meleagridis*, in particular also of new genotypes, thereby enabling unimpeded production of vaccines against this commercially important disease in poultry.

DETAILED DESCRIPTION

Figure 1:
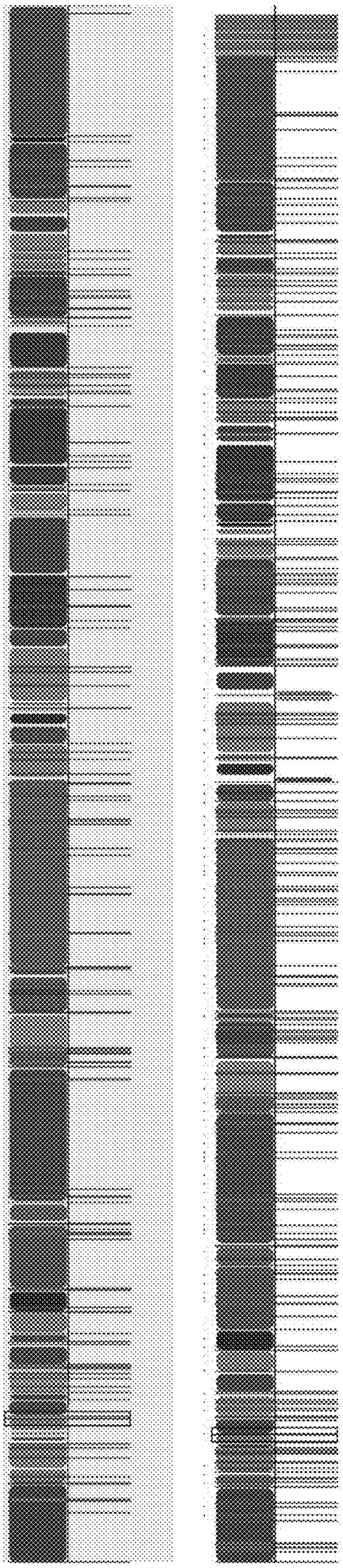
FIG. 1 Alignment of two *H. meleagridis* genomes by MAUVE (Darling et al, 2004).

The detailed description given below relates to all of the above aspects of the invention unless explicitly excluded.

The majority of early molecular studies focused on the phylogenetic positioning of *H. meleagridis*, with just a handful of research papers reporting genetic information on few protein coding genes (Bilic & Hess, 2020). Recently, omics-based approaches revealed a transcriptome, as well as the results of proteome and exoproteome analyses (Mazumdar et al, 2017; Monoyios et al, 2017; Monoyios et al, 2018; Mazumdar et al, 2019). However, the complete genome of *H. meleagridis* is not available in the prior art.

In vitro, the parasite *H. meleagridis* can typically be propagated only in the presence of bacteria (Hess et al., 2015). *H. meleagridis* is usually propagated through an in vitro xenic culture, together with turkey or chicken caecal flora. The culture may be set up by inoculating an intestinal content of a bird suffering from histomonosis into a suitable cell culture medium.

In order to standardize this procedure and to obtain a more defined culture, a clonal or mono-eukaryotic culture may be established by transferring a single *H. meleagridis* cell to fresh medium via micromanipulation (Hess et al., 2006). Further improvement of such culture can be achieved by the replacement of ill-defined caecal bacterial flora by a single bacterial strain, without compromising the virulence of the parasite (Ganas et al., 2012).

In the course of the present invention the genomes of two *H. meleagridis* strains, a monoxenic clonal virulent and an attenuated strain were sequenced. Both genomes were analysed in respect to their differing virulent phenotypes. Mutations in genes that were inactivated or modified in the course of attenuation were found. Details are disclosed in Example 1.

For stronger attenuation (and, in some cases, better growth in vitro) it is preferred when the *H. meleagridis* strain has at least two, preferably at least three, especially all of the attenuating features disclosed herein.

For similar reasons, according to a preferred embodiment, the attenuating feature(s) of the strain is/are homozygous (e.g. with respect to attenuating feature (a), (b), (c) and/or (d)).

Vaccine safety is a particular concern in live vaccines. Therefore, it is desirable when the attenuating features are stable, such that the probability for reversion to a virulent form is reduced. Accordingly, in a further preferred embodiment, the inactivation of the gene is a deletion of the gene, preferably a full deletion of the gene (e.g. with respect to attenuating feature (a) or (b)).

According to a further preferred embodiment, the truncating mutation (attenuating feature (c) and/or (d)) is a frameshift mutation or a point mutation leading to a premature stop codon. It is particularly preferred when the truncating mutation of attenuating feature (c) has the coding sequence identified by SEQ ID NO: 5 or a coding sequence with at least 95%, preferably at least 96%, more preferably at least 97%, even more preferably at least 98%, yet even more preferably at least 99%, especially at least 99.5% or even at least 99.9% sequence identity thereto (i.e. to the entire sequence identified by SEQ ID NO: 5). In addition, or alternatively thereto, it is particularly preferred when the truncating mutation of attenuating feature (d) has the coding sequence identified by SEQ ID NO: 6 or a coding sequence with at least 95%, preferably at least 96%, more preferably at least 97%, even more preferably at least 98%, yet even more preferably at least 99%, especially at least 99.5% or even at least 99.9% sequence identity thereto (i.e. to the entire sequence identified by SEQ ID NO: 6).

In a further preferred embodiment, the strain has attenuating feature (a), wherein a genomic PCR of the strain with forward primer AGGATGTTTCAATTTCCTCGC (SEQ ID NO: 7) and reverse primer CGGTTGTCCATTTTT-CAAACAG (SEQ ID NO: 8) does not yield a product. In yet another preferred embodiment, the strain has attenuating feature (b), wherein a genomic PCR of the strain with forward primer GCGGGAAAACAAACGAAAC (SEQ ID NO: 9) and reverse primer ATAGCCATTGGTCCTGGTC (SEQ ID NO: 10) yields a product with a size between 850 bp to 950 bp (e.g. 894 bp) comprising the sequence identified by SEQ ID NO: 15 or a sequence with at least 90%, preferably at least 93%, more preferably at least 95%, even more preferably at least 97.5%, yet even more preferably at least 98%, especially at least 99% sequence identity thereto (i.e. to the entire sequence identified by SEQ ID NO: 15).

In another preferred embodiment, the strain has attenuating feature (c), wherein a genomic PCR of the strain with forward primer TTGATTATGGGGCAACAGAAG (SEQ ID NO: 11) and reverse primer TTGGCGAAGTCTTT-CAAGAG (SEQ ID NO: 12) yields a product with a size between 450 bp to 550 bp (e.g. 488 bp) comprising the sequence identified by SEQ ID NO: 16.

According to another preferred embodiment, the strain has attenuating feature (d), wherein a genomic PCR of the strain with forward primer AAATGTTATC-CATCGTGACCTC (SEQ ID NO: 13) and reverse primer GATAGCCTTCTTTGGCTTCC (SEQ ID NO: 14) yields a product with a size between 350 bp to 450 bp (e.g. 409 bp) comprising the sequence identified by SEQ ID NO: 17.

In the context of the present invention, for introducing at least one attenuating feature as disclosed herein into *H. meleagridis* cells, all methods known in the art may be used. For instance, based on the gene sequences and coding sequences disclosed herein (in particular SEQ ID NOs: 1-4), targeted gene modification or knock out may be performed, in particular by CRISPR-Cas9. CRISPR-Cas9 methods have already been established in trichomonads, see e.g. Janssen et al., 2018, and Molgora et al., 2021; especially these methods may be used for the present invention. Alternatives to CRISPR-Cas9 are also available, such as gene knockout or gene replacement via selection markers, which has been established in trichomonads for a long time (see e.g. Land et al, 2003 and Bras et al, 2013. The attenuating features may also be introduced with less targeted approaches (e.g. if vaccination with genetically modified organisms is not allowed under certain regulatory regimes) long known in the art, such as by random mutagenesis followed by screening for appropriate mutants or by longer periods of in vitro cultivation followed by screening for appropriate mutants (in particular for mutants having an inactivation of the gene with the sequence identified by SEQ ID NO: 1, as this inactivation turned out to facilitate in vitro growth, thereby conferring a selective advantage).

For the present invention, the attenuating features disclosed herein can be introduced into virtually any isolate of *H. meleagridis*. Since also homogeneity of the obtained culture is usually preferred, it is a preferred embodiment of the present invention to start with a clonal culture of *H. meleagridis*, preferably a clonal culture established by micro-manipulation of a *H. meleagridis* culture. Such clonal cultures have been disclosed e.g. in EP 1 721 965 A and contain only *H. meleagridis* derived from a single cell. Such cultures are therefore homogeneous with respect to the parasite component of the culture and specifically preferred for making the strains and vaccines against *H. meleagridis* infections.

Typically, the strain or vaccine also comprises a bacterial component (which supports growth). According to a further preference, the strain is a single bacterial strain culture (as disclosed in WO 2014/006018 A1), for instance a single bacterial strain culture consisting of *H. meleagridis* and *E. coli*.

The vaccine according to the present invention is specifically for the prevention of histomonosis in birds, preferably in poultry, especially in turkey and chicken, and in game birds, especially pheasant, partridge, guinea fowl and quail.

The pharmaceutically acceptable excipient in the vaccine according to the present invention can be any compound usually contained in a vaccine, especially in a poultry vaccine. The pharmaceutically acceptable excipient can therefore be a buffer, an adjuvant, especially aluminium hydroxide, a preservative, a filler, a stabiliser, a nutrient, and usually consists of a combination of two or more of such compounds.

The vaccine can be formulated in any form suitable for a vaccine, e.g. as a tablet, especially a coated tablet, a capsule, a water-in-oil emulsion, a food product, a spray formulation, a liquid formulation, especially an additive to drinking water, an injectable formulation, especially already packaged in a syringe, as gel, as gel pad or combinations thereof. The formulation as a gel has turned out to be particularly effective for vaccinating flocks.

The vaccine according to the present invention usually comprises at least one pharmaceutically acceptable carrier or diluent such as water, saline, culture fluid, stabilisers, carbohydrates, proteins, protein containing agents such as bovine serum or skimmed milk and buffers or any combination thereof as pharmaceutically acceptable non-biological formulation compound. The stabiliser may be SPGA. SPGA contains 0.218 M sucrose (74.62 g), 0.00376 M KH2PO4 (0.52 g), K2HPO4 0.0071 M (1.25 g), potassium glutamate 0.0049 M (0.912 g) and 1% serum albumin (10 g). Various modifications of the foregoing amounts of ingredients of SPGA are known to those skilled in the art and sodium glutamate is frequently substituted for potassium glutamate, but the modified compositions are still designated as SPGA. For example, an SPGA stabilizer may contain monosodium glutamate rather than monopotassium glutamate; another SPGA stabilizer contains per liter of sterile distilled water, 74.62 g sucrose, 0.45 g KH2PO4, 1.35 g K2HPO4, 0.956 g monosodium L-glutamate, and 40 ml of a 25% solution of albuminosol (human albumin). In general, an SPGA stabilizer contains from about 2 to about 10% of sugar, e.g. sucrose; from about 0.05 to about 0.3% of a mono- or dibasic alkali metal phosphate salt or mixture thereof, e.g. KH2PO4, K2HPO4, NaH2PO4, or Na2HPO4, from about 0.05 to about 0.2% of a glutamic acid alkali metal salt, e.g. sodium or potassium glutamate; and from about 0.5% to about 2% serum albumin, e.g. bovine serum albumin or human albumin. Various substitutions of ingredients in the formulation of SPGA stabilizer can be made. For example, a starch hydrolysate, e.g. glucose or dextran may be substituted wholly or partly for sucrose and casein or PVP may be substituted wholly or partly for albumin. The carbohydrates include, for example, sorbitol, mannitol, starch, sucrose, glucose, dextran or combinations thereof. Additionally, proteins such as albumin or casein or protein containing agents such as bovine serum or skimmed milk may be useful as pharmaceutically acceptable carrier or diluents. Buffers for use as pharmaceutically acceptable carriers or diluents include maleate, phosphate, CABS, piperidine, glycine, citrate, malate, formate, succinate, acetate, propionate, piperazine, pyridine, cacodylate, succinate, MES, histidine, bis-tris, phosphate, ethanolamine, ADA, carbonate, ACES, PIPES, imidazole, BIS-TRIS propane, BES, MOPS, HEPES, TES, MOPSO, MOBS, DIPSO, TAPSO, TEA, pyrophosphate, HEPPSO, POPSO, tricine, hydrazine, glycylglycine, TRIS, EPPS, bicine, HEPBS, TAPS, AMPD, TABS, AMPSO, taurine, borate, CHES, glycine, ammonium hydroxide, CAPSO, carbonate, methylamine, piperazine, CAPS, or any combination thereof. The vaccine formulation may be lyophilized or freeze-dried. In some embodiments the vaccine according to the present invention may further comprise at least one adjuvant (in particular if the cells are inactivated). Examples of adjuvants include Freund's complete adjuvant or Freund's incomplete adjuvant, vitamin E, non-ionic block polymers, muramyldipeptides, saponins, mineral oil, vegetable oil, carbopol aluminium hydroxide, aluminium phosphate, aluminium oxide, oil-emulsions (e.g. of Bayol F® or Marcol 52®), saponins or vitamin-E solubilisate or any combination thereof. In some embodiments the vaccine may comprise adjuvants particularly useful for mucosal application for example *E. coli* heat-labile toxin or Cholera toxin. The vaccine formulation according to the present invention may be administered opthalmically (eye drop), in ovo, intradermally, intraperitoneally, intravenously, subcutaneously, orally, by spray vaccination, via the cloaca or intramuscularly. Eye drop, in ovo and spray administration are preferred when the subject is poultry. Spray administration is particularly preferred to administer the vaccine formulation to large numbers of subjects. It is specifically preferred to provide the vaccine according to the present invention in capsuled or coated form. This allows suitable preservation of the bacterium/protozoa mixture.

The vaccine according to the present invention preferably contains $1\times10^2$ to $1\times10^6$, preferably $1\times10^3$ to $5\times10^5$, especially $5\times10^3$ to $1\times10^5$ *H. meleagridis* cells per dose and/or $1\times10^5$ to $1\times10^{11}$, preferably $1\times10^7$ to $5\times10^{10}$, especially $5\times10^7$ to $1\times10^{10}$ bacterial cells (such as *E. coli*) per dose.

According to a preferred embodiment, the vaccine according to the present invention is formulated as a dose form, i.e. it is already formulated to be administered without further partition/formulation/separation steps.

The term "preventing" or "prevention" as used herein means to stop a disease state or condition from occurring in a bird completely or almost completely or at least to a (preferably significant) extent, especially when the bird is predisposed to such a risk of contracting a disease state or condition.

"Percent (%) sequence identity" with respect to a reference nucleotide sequence is defined as the percentage of nucleotides in a candidate sequence that are identical with the nucleotides in the reference sequence, after aligning the sequences and introducing gaps, if necessary, to achieve the maximum percent sequence identity, and not considering any conservative substitutions as part of the sequence identity. Gaps cause a lack of identity. Alignment for purposes of determining percent nucleotide sequence identity can be achieved in various ways that are within the skill in the art, for instance, using publicly available computer software such as BLAST, BLAST-2, ALIGN, ALIGN-2, Megalign (DNASTAR) or the "needle" pairwise sequence alignment application of the EMBOSS software package. Those skilled in the art can determine appropriate parameters for aligning sequences, including any algorithms needed to achieve maximal alignment over the full length of the sequences being compared. For purposes herein, however, % nucleotide sequence identity values are calculated using the sequence alignment of the computer programme "needle" of the EMBOSS software package (publicly available from European Molecular Biology Laboratory; Rice et al., EMBOSS: the European Molecular Biology Open Software Suite, Trends Genet. 2000 June; 16(6):276-7, PMID: 10827456).

The needle programme can be accessed under a web site or downloaded for local installation as part of the EMBOSS package. It runs on many widely-used UNIX operating systems, such as Linux.

To align two nucleotide sequences, the needle programme is preferably run with the following parameters:

Commandline: needle -auto -stdout -asequence SEQUENCE_FILE_A -bsequence SEQUENCE_FILE_B -datafile EDNAFULL -gapopen 10.0-gapextend 0.5-endopen 10.0-endextend 0.5-aformat3 pair -snucleotide1-snucleotide2 (Align_format: pair Report_file: stdout)

The % nucleotide sequence identity of a given nucleotide sequence A to, with, or against a given nucleotide sequence B (which can alternatively be phrased as a given nucleotide sequence A that has or comprises a certain % nucleotide sequence identity to, with, or against a given nucleotide sequence B) is calculated as follows:

100 times the fraction $X/Y$ where X is the number of nucleotides scored as identical matches by the sequence alignment program needle in that program's alignment of A and B, and where Y is the total number of nucleotides in B. It will be appreciated that where the length of nucleotide sequence A is not equal to the length of nucleotide sequence B, the % nucleotide sequence identity of A to B will not equal the % nucleotide sequence identity of B to A. In cases where "a sequence of A is at least N % identical to the entire sequence of B", Y is the entire length of B. Unless specifically stated otherwise, all % nucleotide sequence identity values used herein are obtained as described in the immediately preceding paragraph using the needle computer program.

"Sequence similarity", "sequence identity", "sharing a sequence" and similar terms shall also apply to the reverse complement of a sequence, i.e. the expression "sequence A is 80% identical to sequence B" shall also be true if "sequence A is 80% identical to the reverse complement (or antisense sequence) of sequence B".

The present invention is further illustrated by the following figures and examples, without being restricted thereto.

FIG. 1 Alignment of two *H. meleagridis* genomes by MAUVE (Darling et al, 2004) displaying the ortholog blocks between the virulent strain (top track) and the attenuated strain (bottom track). The red vertical lines represent the contig borders.

Figure 2:
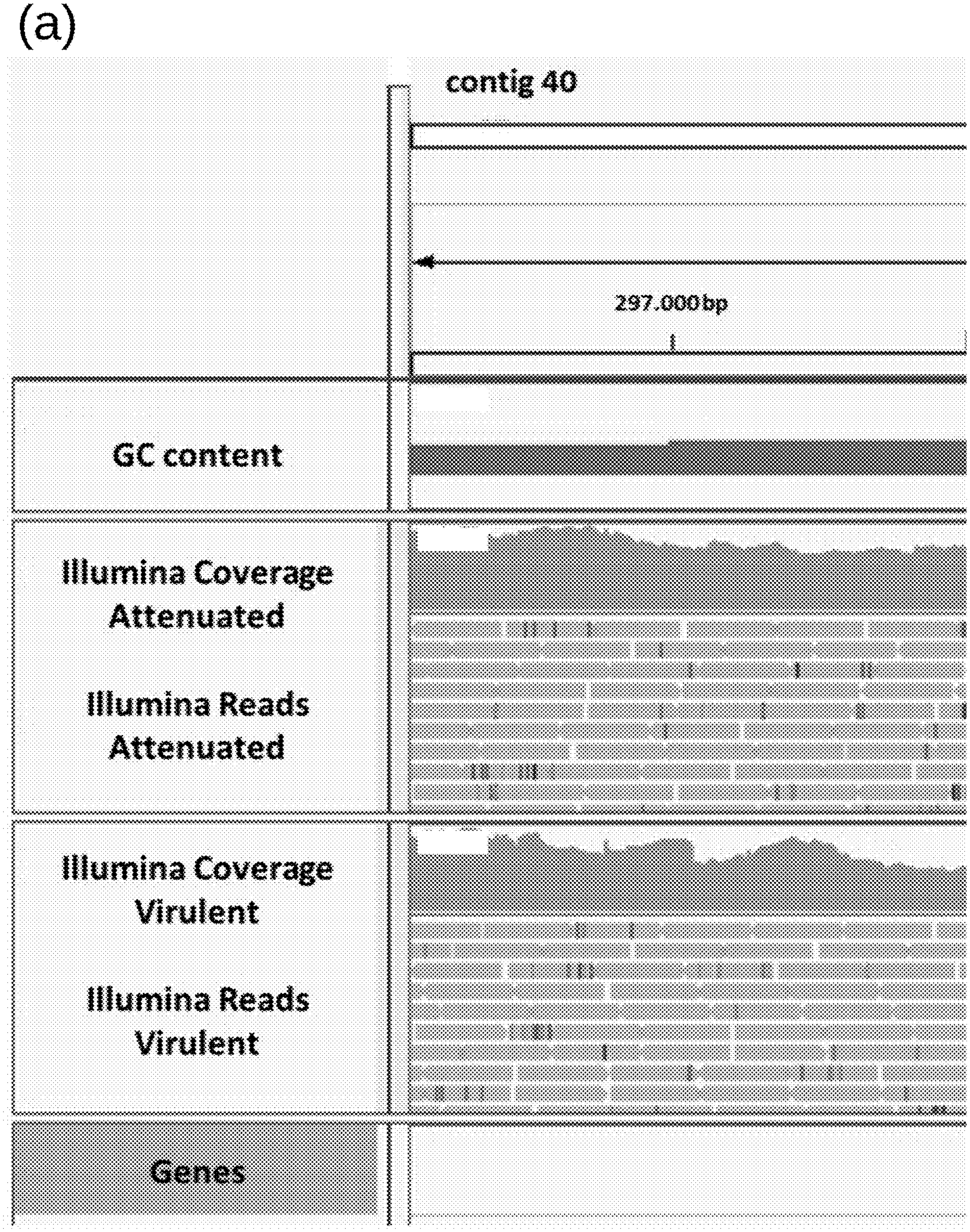
FIG. 2 Characterization of the deletion in g6116$_{vir}$: (a) Read coverage from Illumina data of both strains; (b) Domain prediction from InterProScan.

FIG. 2 Characterization of the deletion in g6116$_{vir}$: (a) Read coverage from Illumina data of both strains; (b) Domain prediction from InterProScan.

Figure 3:
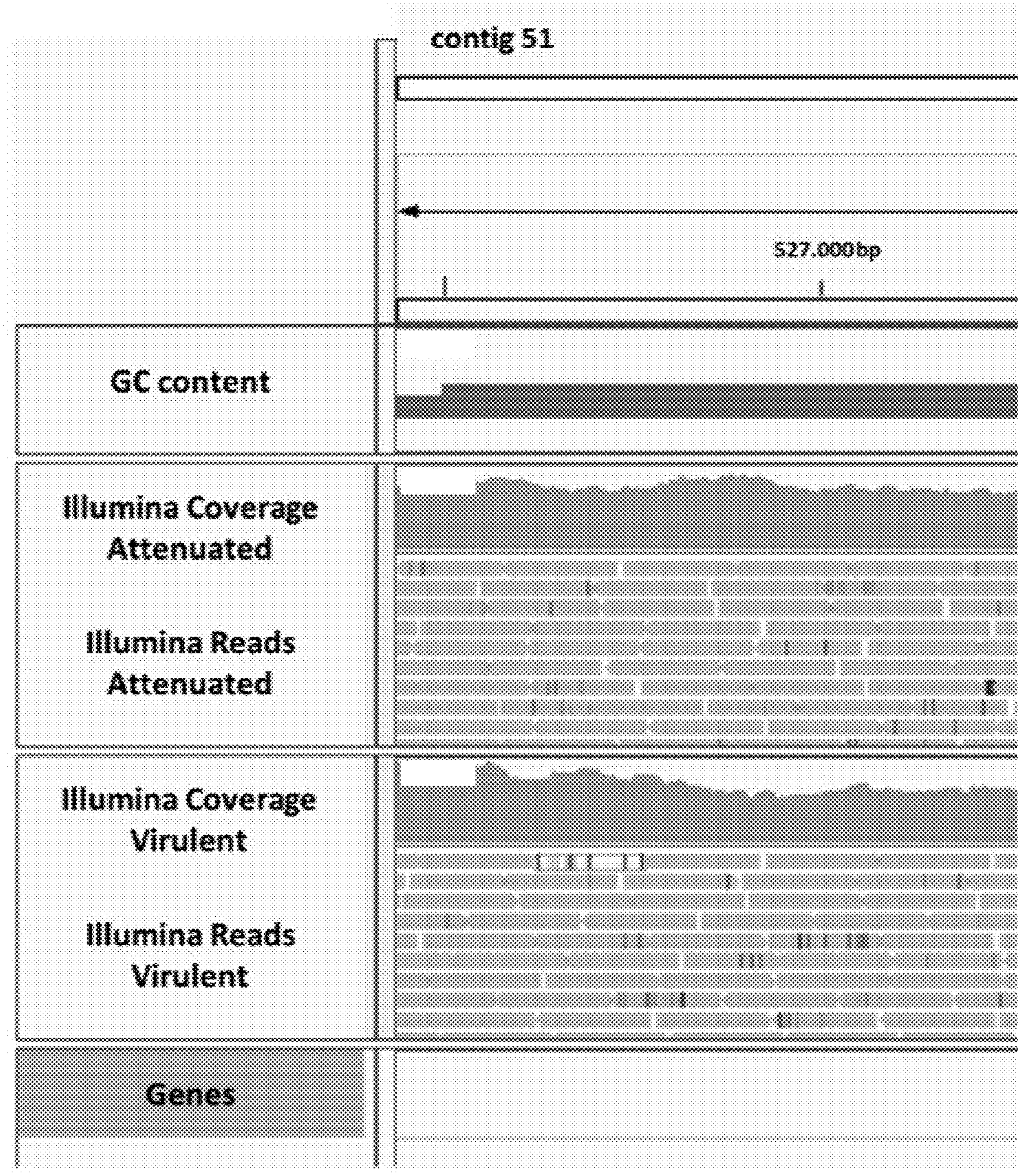
FIG. 3 Characterization of the deletion in g7085$_{vir}$: (a) Read coverage from Illumina data of both strains for the g7085$_{vir}$; (b) Pfam motif prediction showing the location of the motifs, note the presence of the BspA type motifs at the N terminus; (c) Domain prediction from InterProScan.

FIG. 3 Characterization of the deletion in g7085$_{vir}$: (a) Read coverage from Illumina data of both strains for the g7085$_{vir}$; (b) Pfam motif prediction showing the location of the motifs, note the presence of the BspA type motifs at the N terminus; (c) Domain prediction from InterProScan.

Figure 4:
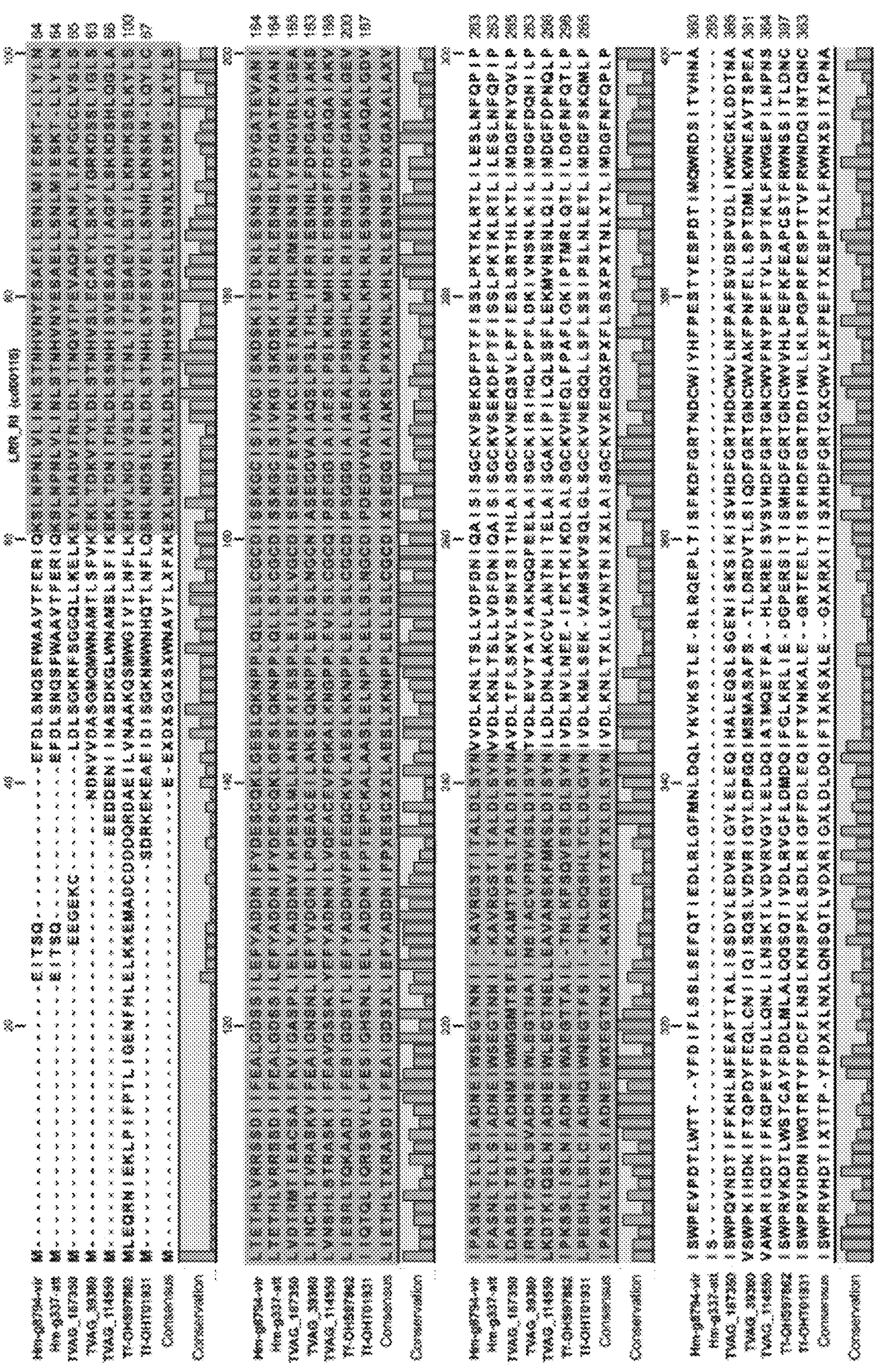
FIG. 4 Multiple amino acid alignment between the two *H. meleagridis* strains and the orthologs in *T. vaginalis* and *T. foetus* for genes displaying the truncation of the protein sequence in the attenuated strain. (a) g8794$_{vir}$/g337$_{att}$ with SNP and (b) g8786$_{vir}$/g346$_{att}$ with indel. Major protein domains are labeled. In the (a) orange box shows Leucine-rich repeats (LRRs), ribonuclease inhibitor (RI)-like subfamily conserved domain (LRR_RI (cd116)) and the grey box leucine-rich repeats, antagonist of mitotic exit network protein 1-like subfamily structural motif (LRR_AMN1 (sd00034)). In the (b) the green box designates protein kinase ATP binding site, orange box serine/threonine kinase active site, the purple a pleckstrin homology domain (PH) and the grey box a transmembrane domain in g346$_{att}$ formed due to a frameshift.

FIG. 4 Multiple amino acid alignment between the two *H. meleagridis* strains and the orthologs in *T. vaginalis* and *T. foetus* for genes displaying the truncation of the protein sequence in the attenuated strain. (a) g8794$_{vir}$/g337$_{att}$ with SNP and (b) g8786$_{vir}$/g346$_{att}$ with indel. Major protein domains are labeled. In the (a) orange box shows Leucine-rich repeats (LRRs), ribonuclease inhibitor (RI)-like subfamily conserved domain (LRR_RI (cd116)) and the grey box leucine-rich repeats, antagonist of mitotic exit network protein 1-like subfamily strucrural motif (LRR_AMN1 (sd00034)). In the (b) the green box designates protein kinase ATP binding site, orange box serine/threonine kinase active site, the purple a pleckstrin homology domain (PH) and the grey box a transmembrane domain in g346$_{att}$ formed due to a frameshift.

EXAMPLES

Example 1

Identification of Virulence Factors of *H. meleagridis*

Materials & Methods

Protozoan Cultures

Next generation sequencing experiments were performed using virulent and attenuated, monoxenic mono-eukaryotic *H. meleagridis* cultures propagated in vitro, both of which were derived from the same *H. meleagridis* cell. Cultivation was performed in the presence of *E. coli* DH5α. The cultures were incubated at 41° C. in Medium 199 containing Earl's salts, (Gibcom™, Invitrogen GmbH, Austria) supplemented with 15% heat-inactivated foetal bovine serum (FBS) (Gibco™, Invitrogen GmbH, Austria) and 0.25% of sterilized rice starch (Carl Roth GmbH+Co. KG, Germany). Cells were passaged every 3 days by transferring 2 ml of the old culture into a new T25 flask (Sarstedt, Inc., Germany).

In order to remove majority of the bacteria before sequencing, *H. meleagridis* cells were purified through a series of washing steps using pre-warmed M199 media without serum (Monoyios et al, 2017). The cell pellets were immediately frozen at −80° C. until further use.

DNA Extraction

For Illumina sequencing, DNA was extracted with QIAamp DNA Mini Kit (Qiagen, Hilden, Germany). The extraction of high molecular weight DNA, used for MINion sequencing, was performed according to a previously published protocol (Nicholls et al, 2019). Briefly, $10^8$ cells were pelleted by centrifugation at 4500×g for 10 min. The cells were re-suspended in 10 ml TLB (10 mM Tris-Cl pH 8.0, 25 mM EDTA pH 8.0, 0.5% (w/v) SDS, 20 μg/ml RNase A (Qiagen, Hilden, Germany)), vortexed at full speed for 5 seconds and incubated at 37° C. for 1 hour, with gentle mix by inversion every 30 minutes. Then, complete 100 μl of Proteinase K (Qiagen, Hilden, Germany) were added to obtain a final concentration of 200 μg/ml. The solution was gently mixed by inversion and incubated at 50° C. for 2 hours, with slow end-over-end rotations every 30 minutes. After completion, the sample was centrifuged at 200×g, and the viscous supernatant containing cell lysate was distributed into two 15 ml Falcon tubes prepared with phase-lock gel. Then, 5 ml of TE-saturated phenol pH 7.5 (Sigma-Aldrich) were added to the lysates and placed on a rotator at 20 rpm for 10 minutes. The preparations were centrifuged at 3000×g for 10 minutes and the aqueous phases were poured into two new 15 ml tubes containing phase-lock gel; followed by the addition of 2.5 ml buffer saturated phenol pH 7.5 and 2.5 ml chloroform-isoamyl alcohol 24:1 mix to each tube. Phase separation was carried out as described above and both aqueous phases were combined. The DNA was precipitated by the addition of 4 ml 5M ammonium acetate and 30 ml ice-cold 96% ethanol, for 4 days at −20° C. Precipitated DNA was collected by centrifugation at 10,000×g and washed twice in 70% ethanol. After the final spin down, the sample was air dried for 15 minutes at room temperature and 200 μl EB (10 mM Tris-Cl pH8, 0.02% (v/v) Triton X-100) were added to the DNA pellet that was kept at +4° C. until completely dissolved. DNA quantity and quality were assessed using Qubit™ dsDNA BR Assay Kit (Invitrogen, Life technologies), NanoDrop 2000 (Thermo Fisher Scientific) and Agilent 4200 TapeStation System using Genomic DNA Screen tape (Agilent technologies).

Illumina Sequencing

For each *H. meleagridis* strain a paired-end Illumina library was prepared from 1.5 μg DNA using TruSeq DNA PCR-Free Library Kit (Illumina). Sequencing (150 bp PE) was carried out on Illumina HiSeq 3000/4000 platform. Resulting reads were imported into CLC Genomics Workbench 12.0 quality trimmed and adapters were removed. The processed reads were assembled into contigs using the De Novo Assembly workflow.

Libraries for Nanopore sequencing were prepared from 0.8 μg of high molecular weight *H. meleagridis* DNA using SQK-LSK109 1D ligation kit (Oxford Nanopore Technologies, Oxford, UK). Libraries were sheared by using the g-TUBE (Covaris) and centrifuged at 6,000 rpm in an Eppendorf 5424 centrifuge for 2×1 min, inverting the tube between centrifugations. DNA repair (NEBNext® FFPE DNA Repair Mix, M6630S, New England Biolabs GmbH, Frankfurt am Main, Germany) and End repair/dA-tailing (NEBNext® Ultram II End Repair/dA-Tailing Module, New England Biolabs GmbH, Frankfurt am Main, Germany) were performed by adding 27 μl nuclease-free water (NFW), 3.5 μl FFPE Repair Buffer, 2 μl FFPE DNA Repair Mix, 3.5 μl Ultra II End-prep reaction buffer and 3 μl Ultra II End-prep enzyme mix to 20 ul of the previously sheared DNA in a 0.2 ml thin-walled PCR tube. Using a thermocycler, the mixture was incubated at 20° C. for 5 minutes and 65° C. for 5 mins. The preparation was transferred to a 1.5 ml Eppendorf DNA LoBind tube and cleaned up using a 60

μl of Agencourt AMPure XP beads (Beckman Coulter Life Sciences, Vienna, Austria), incubated at room temperature with end over end mixing for 5 min, washed twice with 200 μl fresh 70% ethanol and allowed to air dry for 30 seconds. Adapter Ligation was performed by adding 60 μl DNA sample from the previous step, 25 μl Ligation Buffer (LNB), 10 μl T4 DNA Ligase (NEBNext® Quick Ligation Module) and 5 μl Adapter Mix (AMX) in a 1.5 ml Eppendorf DNA LoBind tube, incubating the preparation at room temperature for 10 min. The adaptor-ligated DNA was cleaned up by adding 40 μl of Agencourt AMPure XP beads (Beckman Coulter, Life Sciences, Vienna, Austria), incubated at room temperature with end over end mixing for 5 min. The beads were washed twice with 250 μl Long Fragment Buffer (LFB) and allowed to air dry for 30 seconds. The DNA was eluted by adding 15 μl Elution Buffer (EB) and incubated for 10 minutes at 37° C. Flow Cell Priming was carried out with the introduction of 800 μl of the priming mix into the flow cell via the priming port, with a 5-minute incubation period. The DNA Library was prepared for loading adding 37.5 μl Sequencing Buffer (SQB) and 25.5 μl Loading Beads (LB) to 12 μl of the previously generated DNA Library. Flow cells (FLO-MIN106) were run with the standard MinKNOW software. Base calling option was enabled for a run duration of ~48 h, with a Bias Voltage of −180 mV and time between mux scans of 1.5 h.

Genome Assembly and Annotation

For processing of Nanopore reads, FAST5 files were converted to FASTQ using the Guppy basecaller followed by adapters trimming with Porechop. A draft assembly was generated using Flye (parameters –g 50 m—meta) from the Nanopore reads. To scan for *E. coli* contigs and contaminations, the draft assembly was divided into 1 Kb windows and analyzed through the Taxonomic Profiling tool of CLC Genomics Workbench 12, Microbial Genomics Module (Qiagen, Hilden, Germany) against the complete bacterial genome database. Contigs matching in their entirety to bacteria were removed from the draft assembly. For assembly refining, Illumina reads were subsampled to 30 million and aligned to the draft assembly by minimap2 (Li, 2018) (default parameters) followed by three rounds of refining with racon (Vaser et al, 2017) (default parameters). The quality of the refined assembly was evaluated in the following way: a reference assembly made only from Illumina reads was constructed using the De Novo Assembly tool from CLC Genomics Workbench 12 (Qiagen, Hilden, Germany), as Illumina reads have higher base-level accuracy compared to Nanopore reads. Then, the average similarity between the refined assembly and the Illumina assembly was computed by the program dnadiff of the MUMmer package (Marcais et al, 2018). To evaluate genome completeness, a set of eukaryotic core genes was downloaded from the CEGMA web page and BLASTed to the refined assembly (E-value<$10^{-3}$) in order to estimate the percentage of eukaryotic core genes in the refined assembly. For genome annotation, the transcriptome dataset from Mazumdar et al., 2017, was used as input for training of the AUGUSTUS gene predictor using the web interface of this tool (Hoff & Stanke, 2013). After training, the local version of AUGUSTUS (Stanke et al., 2006) was run on the refined assembly of each strain (parameters—strand-both—genemodel=partial). Functional annotation of coding genes was made using the Blast2GO tool from CLC Genomics Workbench 12 (Qiagen, Germany). Annotation of repetitive sequences and transposons was performed by RepeatMasker 4.0.7 assessed in November 2019 (parameters—species "trichomonas") (Smit et al, 2013).

Identification of variants between the genomes of virulent and attenuated *H. meleagridis* strains For variants identification (single-nucleotide polymorphisms—SNPs—and indels), the assembly of the attenuated strain was aligned against the virulent strain using nucmer from the MUMmer package (Marcais et al, 2018) followed by variant calling with the show-snps tool (parameters -C -l -r). To validate the accuracy of variant calling, Illumina reads from both strains were aligned to the assembly of the virulent strain with Bowtie2 (default parameters) (Langmead & Salzberg, 2012). Then, variants with minimum coverage of 30 in both strains and minimum reference allele frequency of 80% were regarded as true homozygous SNPs (or indels) between the two strains. SNPs located in coding regions were extracted and their potential impact on protein stability was predicted using the online tool PROVEAN (Choi & Chan, 2015).

Confirmation of variants between virulent and attenuated strains

In order to validate variants that caused premature stops in the corresponding coding regions, conventional PCRs were performed. To confirm the two deletions, conventional and real-time PCRs were employed. Real-time PCRs were done in 20 μl reaction mixture on the AriaMx real time cycler (Agilent Technologies, USA) using Brilliant III Ultra-Fast qPCR Master Mix (Agilent Technologies, USA) with 30 nM ROX as reference dye, 500 nM primers and 100 nM TaqMan probe. Thermal profile of real-time reactions was as follows: 15-minute at 95° C., followed by 40 cycles of 15 seconds at 95° C. and of 30 seconds at 60° C. Fluorescence was detected and reported at each cycle during the 60° C. step. All conventional PCRs were performed in 25 μl reaction by using HotStar Taq Master Mix Kit (Qiagen, Vienna, Austria) and 0.4 μM of each primer. Thermo-cycling conditions for all conventional PCRs were: one cycle of 95° C. for 15 minutes; 40 cycles of 95° C. for 30 seconds, 51° C. or 52° C. (depending on the target region) for 30 seconds and 72° C. for 1 minute; followed by final elongation step at 72° C. for 10 minutes. Amplification products (25 μl) were electrophoresed in a 1.0% Tris acetate-EDTA-agarose gel, stained with ethidium bromide and visualized under UV light (Biorad Universal Hood II, Bio-Rad Laboratories, California, USA). Fragment sizes were determined with reference to a lkb ladder (Invitrogen, Life Technologies, Austria). Amplification products (25 μl) were electrophoresed in a 1.0% Tris acetate-EDTA-agarose gel, stained with ethidium bromide and visualized under UV light (Biorad Universal Hood II, Bio-Rad Laboratories, California, USA). Fragment sizes were determined with reference to a 1 kb ladder (Invitrogen, Life Technologies, Austria). PCR products of the expected sizes were excised from the gel and purified using the QIAquick Gel Extraction Kit (Qiagen, Vienna, Austria) according to the manufacturer's instructions. Direct fluorescence-based sequencing was performed by LGC Genomics GmbH (Berlin, Germany) using the PCR primers.

Sequences

TABLE 1 lists *H. meleagridis* sequences found in the course of the present invention:

| SEQ ID NO | description | sequence |
|---|---|---|
| 1 | g6116$_{vir}$ gene sequence | ATGGCAACAACTAATACAACAGCGGCGATTACAATGCCGACAACTGCCTCTGTTGTAACA<br>GAACTTTCTTGTGCGGGTTCCTCTGATGTTGATGGAACTTGTTCGGATGAAACTGCTGTG<br>CTTGTGACGGGCTCTGGTTCTTGTGTCTCTGTTCCTTCAGTGGCTTCTGTTGTCTCAGTA<br>ACTATAGAAGTAACTGCAGAAGAGTGTTCTTCAGTGGTGTGAACTGAAGATGAAGATTCG<br>GTTGAGGATTCGACGGATGATTCTGATGCAGGCTCACTGGATGACTCAATAGAAGATTCA<br>GATACTGATTCACTTGATGATTCTGATACTGATTCAGATGAGGACTCAGATGATGATTCT<br>GATGAAGATTCTGATACTGATTCACTTGAAGATTCACTAGATGATTCACTAGATGATTCA<br>GATGAAGATTCACTAGAGGATTCTGATGAAGATTCACTAGATGATTCACTAGATGATTCA<br>GATGAAGATTCACTAGAGGATTCTGATGAAGATTCACTAGATGATTCACTTGAGGATTCT<br>GATGAAGATTCACTAGATGATTCACTTGAGGATTCTGATGAAGATTCACTAGAGGATTCT<br>GATGAAGATTCACTAGATGATTCACTTGAGGATTCTGATGAAGATTCACTAGATGATTCA<br>CTTGAGGATTCTGATGAAGATTCACTTGAGGATTCACTAGATGATTCAGATGAAGATTCA<br>CTAGATGATTCACTTGAGGATTCTGATGAAGATTCACTTGAGGATTCTGATGAAGATTCA<br>CTTGAGGATTCTGATGAAGATTCACTAGATGATTCACTTGAGGATTCTGATGAAGATTCA<br>CTTGAGGATTCTGATGAAGATTCACTTGAGGATTCTGATGAGGACTCACTTGAGGATTCT<br>GATGAAGATTCACTTGAGGATTCTGATGAAGATTCACTTGAGGATTCTGATGAAGATTCA<br>CTAGATGATTCACTTGAGGATTCTGATGAAGATTCACTAGAGGATTCTGATGAAGATTCA<br>CTAGATGATTCACTTGAGGATTCTGATGAAGATTCACTTGAGGATTCTGATGAAGATTCA<br>CTAGATGATTCACTTGAGGATTCAGATGAAGATTCACTAGATGATTCAGATGAAGATTCA<br>CTTGAGGATTCTGATGAAGATTCACTTGAGGATTCTGATGAAGATTCACTTGAGGATTCT<br>GATGAGGACTCACTTGAGGATTCTGATGAAGATTCACTTGAGGATTCTGATGAAGATTCA<br>CTTGAGGATTCTGATGAAGATTCACTAGATGATTCACTTGAGGATTCTGATGAAGATTCA<br>CTTGAGGATTCTGATGAAGATTCACTAGATGATTCACTTGAGGATTCAGATGAAGATTCA<br>CTAGATGATTCAGATGAAGATTCACTTGAGGATTCTGATGAGGACTCACTTGAGGATTCT<br>GATGAAGATTCAGATGAAGATTCACTTGAGGATTCTGATGAAGATTCACTAGATGATTCA<br>CTTGAGGATTCTGATGAAGATTCACTAGATGATTCACTTGAGGATTCTGATGAAGATTCA<br>GATGAAGATTCACTTGAGGATTCTGATGAAGATTCACTAGATGATTCACTTGAGGATTCA<br>GATGAAGATTCACTTGAGGATTCTGATGAAGATTCACTTGAGGATTCTGATGAAGATTCA<br>CTTGAGGATTCTGATGAAGATTCACTAGATGATTCACTTGAGGATTCTGATGAAGATTCA<br>CTTGAGGATTCTGATGAAGATTCAGATGAAGATTCACTTGAGGATTCTGATGAAGATTCA<br>CTAGATGATTCACTTGAGGATTCAGATGAAGATTCACTAGATGATTCAGATGAAGATTCA<br>CTTGAGGATTCTGATGAAGATTCACTAGATGATTCACTTGAGGATTCTGATGAAGATTCA<br>CTTGAGGATTCTGATGAAGATTCACTTGAGGATTCTGATGAGGACTCACTTGAGGATTCT<br>GATGAAGATTCACTAGATGATTCACTTGAGGATTCTGATGAAGATTCACTTGAGGATTCT<br>GATGAAGATTCACTAGATGATTCACTTGAGGATTCTGATGAAGATTCACTTGAGGATTCT<br>GATGAAGATTCACTTGAGGATTCTGATGAGGACTCACTTGAGGATTCTGATGAAGATTCA<br>CTTGAGGATTCTGATGAAGATTCACTAGATGATTCACTTGAGGATTCTGATGAAGATTCA<br>CTAGATGATTCACTTGAGGATTCTGATGAAGATTCACTAGAGGATTCTGATGAAGATTCA<br>CTAGAGGATTCTGATGAAGATTCACTTGAAGATTCTGATGAGGACTCACTTGAGGATTCT<br>GATGAAGATTCACTTGAGGATGTTTCAATTTCCTCGCCGCCGCCCTGGCCGCCACCGCCT<br>TCTTCTTCGTCGCCGTCGCCGCCGCCGCCTTCTTCGCCGCCTTCGTTGCCATCAGCTAGT<br>AATTGGAGATTGAATTTTTTCATTGATTTTGTTAAGCGTTCTAGTTCTGTTTCTTGGCCA<br>AAAAGGGCTTGTTCGAGATTACTTTCTTTTTTGTTTATATTGGCTGGTCTTGCGAGTAGG<br>ATCAGGAAGAGTCCAAACATGATAGTGACAAAAAATCAAGTTTTTGAGAGCTGCTCTGAA<br>TTTTGA |
| 2 | g7085$_{vir}$ gene sequence | ATGATTAAAGTTTCCAGCGAAAATGCAAATTATTGCAATTATAACGAAGATGGGATTTTA<br>TATAACAAAAACGTCACTAAAATTATATGTTATCCATGCGGGAAAACAAACGAAACATAT<br>ACATTCCCAACAAATGCCAGTGTTATTGATATTAATGCATACTGTAATTGTATTTCATTA<br>AGGAACATTGAAATTCCATGCAATATAACGTCAGTTGGAAGCAAAGCATTTGCATCATGC<br>TGCAATCTCACATGTATTTTTTTTTTTTTTTTTACAGTCCCAACGAATACATCGAATGTA<br>CCTGATGACAACAATTTAATCAGAAGTGTCCTGACAATCGATTCATATAACGGCCAAACA<br>TTCTGCGGTATAAAAGTCAGTAAAGGAAAAGTCATTGATGAATGTCTCCCACCGACGCAA<br>TCGTTCACACGATCGAACACATACTCAAACACATTTACTCAGTCGAATACGTTCACTAAG<br>TCGAATACATTCACTAAGACGAATACATTTACTCAGTCGAATACATTATTACCTTCGAAT<br>GTAACGCTGACACTTTCGTTTACGAATTCATATTCCATCACTGAAACTGTTACAATTTCT<br>GGTACATATTCTTATTCATATGTTTTGACTTTAATTGGAGTTAGTAGTACATATGTCAGA<br>ACAGATTTAATTTATTATGAATATATTGTGACTCGTTATTCGACGTTATATAGTTTTTAT<br>TCGAATTTCTTCACAATTATCGACGTCATAAATCCTGTTGGAAATGGTATTTCTCAAAAG<br>GCTTTGATAGGTATTATCTGCGGCACAATAATTGCAGTTTTGCTGATTATGGGAATTATC<br>ATATTCCTTGTGAAGAAATCAAAGAAAAGTAACAGCGAATCAACAGCGATAAAATTCGAA<br>ACTAAAAATTCAACTGGAAGCGATATGAGATCAGATGAAGTAAATCAGGAATATAATGAA<br>CTCGTGTTGGAAGACCAGGACCAATGGCTATAA |
| 3 | g8794$_{vir}$ coding sequence (CDS) | ATGGAAATTACTTCCCAAGAATTTGATCTTTCAAACCAATCATTTTGGGCAGCAGTCACA<br>TTTGAGCGAATTCAAAAAAGCCTAAATCCGAATCTAGTTTTAATTAATCTTTCTACAAAT<br>CATGTTAATTATGAATCAGCAGAACTTTTATCAAACTTAATGATAGAGAGCAAGACTTTA<br>CTTTACTTAAATCTTACAGAAACCCATTTAGTTAGGCGCTCTTCTGATATAATTTTTGAA<br>GCTCTTGGAGATTCATCAATTCTTGAATTTTATGCAGATGATAATATTTTTTACGACGAA<br>AGTTGTCAAAAGCTTGGTGAGTCATTACAGAAAAATCCACCTCTTCAACTCTTAAGCTTG<br>TGTGGATGCGACATTTCATCAAAAGGGTGCATTTCAATTGTAAAAGGAATTTCAAAGGAT |

TABLE 1-continued lists *H. meleagridis* sequences found in the course of the present invention:

| SEQ ID NO | description | sequence |
| --- | --- | --- |
| | | TCAAAAATAACCGATTTACGGTTAGAGTCAAATTCTTTATTTGATTATGGGGCAACAGAA<br>GTTGCAAATATTATACCAGCATCAAACTTAACCTTACTCAGTATCGCTGACAATGAAATA<br>TGGAGTGAAGGGACAAATAATATCATTAAAGCTGTTCGAGGTAGTACTATCACTGCATTA<br>GATTTAAGTTATAACGTGGTTGACTTAAAAAACCTCACTAGCTTGTTGGTAGATTTTGAT<br>AACATACAAGCCATTAGTATCAGTGGATGTAAAGTTTCTGAAAAAGATTTTCCAACTTTT<br>ATTTCGTCACTTCCAAAAACAAAATTAAGAACTCTTATCTTGGAAAGCCTTAATTTCCAA<br>CCTATTCCAATCTCTTGGCCCGAAGTTCCTGATACCTTATGGACAACATATTTTGATATC<br>TTTTTATCATCTTTATCAGAATTCCAAACGATAGAAGATCTTCGACTTGGCTTTATGAAT<br>CTAGATCAACTTTATAAAGTCAAGTCAACTCTTGAAAGACTTCGCCAAGAACCTTTAACA<br>ATTAGTTTTAAAGATTTTGGTCGAACTAATGATTGTTGGATATATCATTTTCCTGAATCC<br>ACGTATGAAAGTCCAGATACCATTATGCAATGGCGCGATAGCATCACAGTGCACAACGCG<br>TTCTTCATCGGCCACATCATCAATCACACCACCGCATCAAATAACCGTCAAATTGAAATT<br>TTGAATTTGAGTCAGTGTCAAATTGACGATGAAATTTTATCCAAAATCATCAACAGCATC<br>GACGGCCATAACCTTAAGAGCATCGATTTAAGTGATAATAATGGCATTACTGATGAATCC<br>GTCGAATATCTTCTTCAATATATCTCTCAATCGCAACTTGAATCAATTAATCTTTATGAA<br>acaaaaatcacagattcaggctatgaccgcattttctctcttccacttctccctcttaag<br>AACATTTCTCTCTCATTTGAAACACATCAATTAAATGAAGATCAACATCATCAATTTTTT<br>AGTAGCATCGCATCACTCTTACGAACGCAAGAATGTGTTCTCGAGGACTTACGGATGACG<br>GGCTATATCACTCCAGTTGACGCCAAAGAAATTGTCGAATCGTTACACGAGAACACAAGT<br>TTGAGGCATTTGGAAATCGACAGTTTGCACTGCGAGAAGTACGAAAACCCCGATCCAGTG<br>ATAGATCCGAACATACAGAGCCTCTACGACGACTTCACCGAAGCGCTTGCGGATGCAGTG<br>ATGGGCGAAGGCACTTCATGCAGACTATGCTCACTCGTGTACCCGCTGCTGACTGAGGTA<br>TATGTGTTCAGCGAACGAGGAATGAAAATATTCGCTGACATTGAGGATAAGCTGAAAGAA<br>AATATGGAAATGTATGGGAAGGATAATGAGTGA |
| 4 | g8786$_{vir}$ CDS | ATGTCGAAACAGACAGCATTTCGCCTTGAAGATTTTATTGTTGAATCCCCAATAGGCCAA<br>GGCGCATACGGTCAAATTTATAAAGCTGTTGAAGTTGGAACTGGAAAAGTTTATGCATTA<br>AAAGCAATGAATAGAAGATGTCTTATGAAGATGAAAAAACAAAGCCTACCAATTGTAGAA<br>AAAAATGCACTAATTAAGTGTGCTAGTACTTTTGTTGTTCGTTTATATGGAACGTTCAAG<br>GATGATTCAAATTTGTATTTTGTACTTGAATTAGCAGAACATGGTGACCTTGCAGAAGCC<br>GTAGGGGATATTGGAAGTCTTAACACTAATGTAGTTAAACTTCTTTCTGCTCAAATTTTT<br>GAAGCAATCTGTGTATGTCATAAAGCAAATGTTATCCATCGTGACCTCAAGCCAGAAAAC<br>ATTCTCCTCGACTCGCAAAACCACGTTCTTCTCTCAGATTTTGGTACAGCCCTAATTGAA<br>AAATCTGATAGTCAAGAATTAAATCGTTCATCCATTGTTGGAACTCCAGCCTTTGTTGCC<br>CCAGAGCTCCTTAATGATGGAAAAATCTGTTATAGTTCTGATATGTGGTCATTTGGTTGT<br>GTCATATTCAATCTTCTTACAGGCACAGCACCTTTTAGTGGACAAAACACAGTTGAATTA<br>ATGAACAACATCACTGAGCTTAAGTTTAATCCAGTCATTAAAACACTTCCGAAAACCGCC<br>AAAGATCTCATCACATCCTTACTTAAGCTTGATCCACACGAGCGTATTGGATACGGGGAA<br>GCCAAAGAAGGCTATCCCTCCATTCGTAACCATGCCTTTTTCAAAGGCATTGATTGGAAT<br>AATTTGTCAAATATCAAAATGCCTGTTTTCACCAAATTCGAAGAAGAACAACAACCAACC<br>ATTGCAGATTCCATGCTAAATGAAGGGGAGACCATTCTAATGAATAGTATTGTCGACAGA<br>AAGCGATTATTTGGTTGGAAAGAGCGTTCGATATTTTTGACTAATCAAAAGAGACTTTTG<br>TTATTTAACAACAAAACGCACGAGTTTAAGATGGCAATAGCATTAACGAATGGAGTCAAA<br>GTGAATGTTGCACAAGATGGGAAAGAATGGACAATCACTTGGGGAAAAGGCCAAACGCAA<br>ACATTTAGATCAAATGATGGAACTGGCGGAATGTGGGCAGCATCAATAATGAGGGAATCA<br>ATCAAACCATAA |
| 5 | g337$_{att}$ CDS | ATGGAAATTACTTCCCAAGAATTTGATCTTTCAAACCAATCATTTTGGGCAGCAGTCACA<br>TTTGAGCGAATTCAAAAAAGCCTAAATCCGAATCTAGTTTTAATTAATCTTTCTACAAAT<br>CATGTTAATTATGAATCAGCAGAACTTTTATCAAACTTAATGATAGAGAGCAAGACTTTA<br>CTTTACTTAAATCTTACAGAAACCCATTTAGTTAGGCGCTCTTCTGATATAATTTTTGAA<br>GCTCTTGGAGATTCATCAATTCTTGAATTTTATGCAGATGATAATATTTTTTTACGACGAA<br>AGTTGTCAAAAGCTTGGTGAGTCATTACAGAAAAATCCACCTCTTCAACTCTTAAGCTTG<br>TGTGGATGCGACATTTCATCAAAAGGGTGCATTTCAATTGTAAAAGGAATTTCAAAGGAT<br>tcaaaaataaccgatttacggttagagtcaaattctttatttgattatggggcaacagaa<br>GTTGCAAATATTATACCAGCATCAAACTTAACCTTACTCAGTATCGCTGACAATGAAATA<br>TGGAGTGAAGGGACAAATAATATCATTAAAGCTGTTCGAGGTAGTACTATCACTGCATTA<br>GATTTAAGTTATAACGTGGTTGACTTAAAAAACCTCACTAGCTTGTTGGTAGATTTTGAT<br>AACATACAAGCCATTAGTATCAGTGGATGTAAAGTTTCTGAAAAAGATTTTCCAACTTTT<br>ATTTCGTCACTTCCAAAAACAAAATTAAGAACTCTTATCTTGGAAAGCCTTAATTTCCAA<br>CCTATTCCAATCTCTTGA |
| 6 | g346$_{att}$ CDS | ATGTCGAAACAGACAGCATTTCGCCTTGAAGATTTTATTGTTGAATCCCCAATAGGCCAA<br>GGCGCATACGGTCAAATTTATAAAGCTGTTGAAGTTGGAACTGGAAAAGTTTATGCATTA<br>AAAGCAATGAATAGAAGATGTCTTATGAAGATGAAAAAACAAAGCCTACCAATTGTAGAA<br>AAAAATGCACTAATTAAGTGTGCTAGTACTTTTGTTGTTCGTTTATATGGAACGTTCAAG<br>GATGATTCAAATTTGTATTTTGTACTTGAATTAGCAGAACATGGTGACCTTGCAGAAGCC<br>GTAGGGGATATTGGAAGTCTTAACACTAATGTAGTTAAACTTCTTTCTGCTCAAATTTTT<br>GAAGCAATCTGTGTATGTCATAAAGCAAATGTTATCCATCGTGACCTCAAGCCAGAAAAC<br>ATTCTCCTCGACTCGCAAAACCACGTTCTTCTCTCAGATTTTGGTACAGCCCTAATTGAA<br>AAATCTGATAGTCAAGAATTAAATCGTTCATCCATTGTTGAACTCCAGCCTTTGTTGCCC<br>CAGAGCTCCTTAATGATGGAAAAATCTGTTATAGTTCTGATATGTGGTCATTTGGTTGTG<br>TCATATTCAATCTTCTTACAGGCACAGCACCTTTTAGTGGACAAAACACAGTTGAATTAA |

TABLE 1-continued lists *H. meleagridis* sequences found in the course of the present invention:

| SEQ ID NO | description | sequence |
| --- | --- | --- |
| 15 | sequence of attenuated strain contained in PCR product of primers with SEQ. ID NOs: 9 and 10 | ATTTGATAATAGTTTTTATTGGAGAAAATGTGGAAAGAATTGGAACTTCTGCATTTTCAT<br>ATTGCACATCATTAATAAATATTACAATTCCCAATAAAGTAACAGAAATTGGAAATTATG<br>TATTTTCATCATGTTCTAATTTGAGAATAGTTTTTATTGGAGAAAATGTGGAAAGAATTG<br>GAACTTATGCATTTTCATATTGCACATCATTAGTAAATATTACAATTCCCAATAAAGTAA<br>CAGGAATTGGAATTTCTTCATTTGAATTTTGTACCAACCTTCAAATGATTAAAGTTTCCA<br>GCGAAAATGCAAATTATTGCAATTATAACGAAGATGGGATTTTATATAACAAAAACGTCA<br>CTAAAATCCCACCGACGCAATCGTTCACACGATCGAACACATACTCAAACACATTTACTC<br>AGTCGAATACGTTCACTAAGTCGAATACATTCACTAAGACGAATACATTTACTCAGTCGA<br>ATACATTATTACCTTCGAATGTAACGCTGACACTTTCGTTTACGAATTCATATTCCATCA<br>CTGAAACTGTTACAATTTCTGGTACATATTCTTATTCATATGTTTTGACTTTAATTGGAG<br>TTAGTAGTACATATGTCAGAACAGATTTAATTTATTATGAATATATTGTGACTCGTTATT<br>CGACGTTATATAGTTTTTATTCGAATTTCTTCACAATTATCGACGTCATAAATCCTGTTG<br>GAAATGGTATTTCTCAAAAGGCTTTGATAGGTATTATCTGCGGCACAATAATTGCAGTTT<br>TGCTGATTATGGGAATTATCATATTCCTTGTGAAGAAATCAAAGAAAAGTAACAGCGAAT<br>CAACAGCGATAAAATTCGAAACTAAAAATTCAACTGGAAGCGATATGAGATCAGATGAAG<br>TAAATCAGGAATATAATGAACTCGTGTTGGAAGACCAG |
| 16 | sequence of attenuated strain contained in PCR product of primers with SEQ. ID NOs: 11 and 12 | CATCAAACTTAACCTTACTCAGTATCGCTGACAATGAAATATGGAGTGAAGGGACAAATA<br>ATATCATTAAAGCTGTTCGAGGTAGTACTATCACTGCATTAGATTTAAGTTATAACGTGG<br>TTGACTTAAAAAACCTCACTAGCTTGTTGGTAGATTTTGATAACATACAAGCCATTAGTA<br>TCAGTGGATGTAAAGTTTCTGAAAAAGATTTTCCAACTTTTATTTCGTCACTTCCAAAAA<br>CAAAATTAAGAACTCTTATCTTGGAAAGCCTTAATTTCCAACCTATTCCAATCTCTTGAC<br>CCGAAGTTCCTGATACCTTATGGACAACATATTTTGATATCTTTTTATCATCTTTATCAG<br>AATTCCAAACGATAGAAGATCTTCGACTTGGCTTTATGAATCTAGATCAACTTTATAAAG<br>TCAAGTCAACTCTTGAAAGACT |
| 17 | sequence of attenuated strain contained in PCR product of primers with SEQ ID NOs: 13 and 14 | CGTTCTTCTCTCAGATTTTGGTACAGCCCTAATTGAAAAATCTGATAGTCAAGAATTAAA<br>TCGTTCATCCATTGTTGAACTCCAGCCTTTGTTGCCCCAGAGCTCCTTAATGATGGAAAA<br>ATCTGTTATAGTTCTGATATGTGGTCATTTGGTTGTGTCATATTCAATCTTCTTACAGGC<br>ACAGCACCTTTTAGTGGACAAAACACAGTTGAATTAATGAACAACATCACTGAGCTTAAG<br>TTTAATCCAGTCATTAAAACACTTCCGAAAACCGCCAAAGATCTCATCACATCCTTACTT<br>AAGCTTGATCCACACGAGCGTATTGGATACGGGGAAGCCAAAG |

TABLE 2 lists primers and probes used:

| PCR assay | Sequence (5'-3') | Ta | product size | purpose |
| --- | --- | --- | --- | --- |
| indel: AGC Kinase | Forward AAATGTTATCCATCGTGACCTC (SEQ ID NO: 13)<br>Reverse GATAGCCTTCTTTGGCTTCC (SEQ ID NO: 14) | 52° C. | 409 bp | verification of indel |
| SNP: LRR | Forward TTGATTATGGGGCAACAGAAG (SEQ ID NO: 11)<br>Reverse TTGGCGAAGTCTTTCAAGAG (SEQ ID NO: 12) | 51° C. | 488 bp | verification of SNP |
| deletion $g6116_{vir}$ conventional PCR | Forward AGGATGTTTCAATTTCCTCGC (SEQ ID NO: 7)<br>Reverse CGGTTGTCCATTTTTCAAACAG (SEQ ID NO: 8) | 52° C. | 910 bp | verification of $g6116_{vir}$ deletion |
| deletion $g6116_{vir}$ qPCR | Forward TTTCAATTTCCTCGCCGCC (SEQ ID NO: 18)<br>Reverse CGCAAGACCAGCCAATATAAAC (SEQ ID NO: 19)<br>Probe HEX-TCGCCGCCGCCGCCTTCT-BHQ (SEQ ID NO: 20) | n/a | n/a | |

TABLE 2-continued

| lists primers and probes used: | | | | |
|---|---|---|---|---|
| PCR assay | Sequence (5'-3') | Ta | product size | purpose |
| deletion g7085$_{vir}$ conventional PCR | Forward GCGGGAAAACAAACGAAAC (SEQ ID NO: 9) Reverse ATAGCCATTGGTCCTGGTC (SEQ ID NO: 10) | 51° C. | 894 bp | verification of g7085$_{vir}$ deletion |
| deletion g7085$_{vir}$ qPCR | Forward ACATTCCCAACAAATGCCAG (SEQ ID NO: 21) Reverse GTGGGAGACATTCATCAATGAC (SEQ ID NO: 22) Probe FAM-CCAACGAATACATCGAATGTACCTGATGACAA-BHQ1 (SEQ ID NO: 23) | n/a | n/a | |

Further sequence information with respect to the attenuating features found in the course of the present invention:

(a)

g6116_vir is on contig_40_vir (SEQ ID NO: 24), on negative strand; coordinates of the gene:298557 . . . 301202. Coordinates of CDS: 298557 . . . 300901 and 300998 . . . 301202. Gene has one intron, coordinates of the intron: 300902 . . . 300997.

Corresponding locus is located on the contig_94_att (SEQ ID NO: 25), on the positive strand, coordinates: 243676 . . . 244657.

(b)

g7085_vir is on contig_51_vir (SEQ ID NO: 26), on negative strand; coordinates of the gene and CDS 528435 . . . 529427.

The corresponding locus in attenuated strain is located on contig_20_att (SEQ ID NO: 27) on positive strand with coordinates: 204754:205422.

(c)

g8794_vir is located on contig_72_vir (SEQ ID NO: 28), on positive strand; coordinates of the gene and CDS: 56499 . . . 58331

The corresponding locus in attenuated strain is g337_att. It is located on contig_106_att (SEQ ID NO: 29) on the negative strand, coordinates of the gene and CDS: 96062 . . . 96859.

(d)

g8786_vir is located on contig_72_vir (SEQ ID NO: 28), on negative strand; coordinates of the gene and CDS: 35920 . . . 37131.

The corresponding locus in attenuated strain is g346_att located on contig_106_att (SEQ ID NO: 29) on the positive strand; coordinates of the gene and CDS: 116227 . . . 116886.

RESULTS

Genome Assembly and Annotation

The whole genomes of two *H. meleagridis* strains—a virulent and an attenuated strain—were sequenced and annotated with the goals of expanding genomic information on this important poultry pathogen and investigating the genomic basis of attenuation. The strains used for whole genome sequencing originated from a single parasitic cell that was transferred via micromanipulation from the initial culture into the fresh suitable medium, establishing a so called "mono-eukaryotic clonal culture". Further prolonged in vitro cultivation resulted in the attenuation of the parasite. As aliquots of every cultivation passage were cryopreserved, retracement to the original virulent *H. meleagridis* was possible.

In order to achieve megabase-sized contigs with high base-level accuracy, the genomes of both strains were assembled using a combination of ONT long reads and Illumina short reads. The genome of *H. meleagridis* is 43 Mb in size, is GC poor (28%) and contains about ~11,000 genes, with little variation between strains. Introns are scarce, with 5.2-5.7% of genes containing at maximum one intron. Repetitive regions account for about ~2% of the genome in both strains and include microsatellites (1.63-1.75%), low complexity sequences (0.51-0.53%) and different classes of transposable elements. The overall genome duplication level in *H. meleagridis* was computed directly as the fraction of the genome that is duplicated instead of inferring this figure by indirect methods (i.e. Manekar & Sathe, 2019). To calculate this, the contigs were aligned to themselves with nucmer and extracted homologous regions with the show-coords tool (Marcais et al, 2018). This resulted in a duplication level of 20% for both strains. To evaluate the accuracy of the assemblies three metrics were employed: i) base-level accuracy, ii) presence of eukaryotic core genes and iii) completeness of gene models. Base-level accuracy was computed by aligning the assembly of each strain to another assembly generated using only Illumina read and computing the average genome similarity with the dnadiff (Marcais et al, 2018) tool, based on the assumption that accuracy from Illumina reads is higher compared to the ONT reads (McNaughton et al., 2019). Using this approach, 99.82% accuracy for the virulent strain and 99.79% for the attenuated strain were obtained. Next, the percentage of eukaryotic core genes was computed from the CEGMA database using BLAST. Out of total 458 core genes 395 (86%) in the virulent strain were detected and 395 (86%) in the attenuated strain, with 100% overlap between the two datasets, which was in accordance with the high similarity in gene content between strains. Last, the completeness of gene models was evaluated by classifying the CDS into complete (having stop and start codon) or partial (having only stop or only start) and found that 100% of the genes have complete CDS in both strains, underlining the high quality of the assemblies. To get an overview of genomic rearrangements for both assemblies, the contigs were aligned from the virulent strain to the attenuated strain using MAUVE (Darling et al, 2004). The alignment shows high colinearity between the two strains, no genomic rearrangements within contigs and two inverted contigs in the attenuated strain (FIG. 1). Overall, higher genome fragmentation was observed for the attenuated strain, concordant with the higher number of contigs.

Differences in Gene Content Between Strains

In order to find strain-specific losses/deletions or gene duplications that have occurred during the prolonged passaging of *H. meleagridis*, gene content between the two sequenced strains was compared. For this analysis, the protein sequences of both strains were clustered using OMA (Altenhoff et al, 2019) to detect gene families. A total of 11,119 genes from the virulent strain and 11,137 genes from the attenuated strain were clustered into 10,063 gene families. From this dataset, 400 genes were extracted that were found only in the attenuated strain and 281 of them aligned to the virulent strain using Exonerate (Slater & Birney, 2005) (parameters-model protein2genome –percent 90–bestn 1), indicating that these genes simply represent missing annotations in the attenuated strain. Of the remaining 119 genes, five of them ($g8917^{att}$→$g8921_{att}$ on contig 49) had no support from Illumina reads in the virulent strain, pointing to a deletion in the virulent strain. As these genes did not have any marked functional annotation, additional BLAST searches were conducted, which revealed that these five genes belonged to a phage contamination located on a chimeric contig. Using the same approach, 335 genes were extracted that were found only in the virulent strain and found that 234 of them aligned the attenuated strain using Exonerate. Of the remaining 101 genes, 99 of them had full support from Illumina reads, indicating missing annotations, while two of them (g6116vir on contig 40 and g7085vir on contig 51) had only partial support from Illumina reads in the attenuated strain (FIG. 2*a*, FIG. 3*a*), pointing to a deletion that occurred in the attenuated strain. The g6116vir gene encodes for a hypothetical protein with transmembrane domain towards the C-terminus as identified by InterProScan (Quevillon et al, 2005) (FIG. 2*b*). The g7085vir encodes a leucine-rich repeat (LRR) domain-containing protein. As LRR proteins of the BspA family are involved in virulence in trichomonads (Handrich et al, 2019), the presence of BspA motifs in this protein was checked with the online tool MOTIF and a single BspA motif at positions 38→88 was identified (FIG. 3*b*). Additionally, the protein encoded by $g7085_{vir}$ also contains four predicted transmembrane helices (FIG. 3*c*).

Confirmation of Gene Deletions

In order to confirm deletions of $g6116_{vir}$ and $g7085_{vir}$ in the attenuated strain and narrow the time point, i.e. passage number, when the deletion occurred, a range of different passages was tested for the presence/absence of loci by conventional and real-time PCR. The $g6116_{vir}$ deletion was confirmed in the attenuated strain. The analysis showed that the deletion of the $g6116_{vir}$ occurred already in the xenic background between the passage 83 and 145. In addition, testing low and high passages of other unrelated *H. meleagridis* strains, grown as xenic clonal cultures, demonstrated that $g6116_{vir}$ did not change and remained as wild type throughout the in vitro cultivation.

Variants Identification Between Strains

Next, SNPs and indels between strains were analyzed to find variants affecting the coding regions (non-synonymous and missense mutations), as these are correlated with a change of gene function that occurred during the attenuation process. The critical step in this analysis is to distinguish true variants from sequencing errors introduced by the ONT reads (layer et al., 2015). After aligning the genome of the attenuated to the virulent strain with nucmer, an initial set of 17,170 SNPs was identified using the show-snps tool (Marcais et al, 2018). After removing sequencing errors (see Methods, Identification of variants between strains, above), a filtered set of 68 homozygous SNPs and 2933 heterozygous SNPs was obtained. Only homozygous SNPs were considered for the following analyses. Of the 68 homozygous SNPs, 17 were located within coding regions: of these, 4 were synonymous, 12 non-synonymous and 1 caused a premature stop codon in a protein of the attenuated strain ($g337_{att}$) (FIG. 4*a*). Using the local BLAST search against transcriptomes of virulent and attenuated strain (Mazumdar et al, 2017) it became evident that both strains express this gene, with the transcript from the attenuated gene displaying the SNP. Both versions, a complete ($g8794_{vir}$) and a truncated ($g337_{att}$) contain LRR_RI superfamily domain (sd00116) located in the N-terminal part, however the truncated version lacked the second LRR domain (LRR_AMN1 (sd00034)) (FIG. 4*a*). The characterization of the truncation with PROVEAN tool (Protein Variation Effect Analyzer) (Choi & Chan, 2015) marked the event as deleterious for the protein function. The remaining non-synonymous SNPs were also characterized with PROVEAN; 2 out of 12 were marked as deleterious, although both of them did not affect functional domains. Indels were detected from the alignment of the attenuated to the virulent strain using the show-snps tool (Marcais et al, 2018) with the indel option selected. The initial unfiltered set contained 21,822 indels. After extracting homozygous indels supported by the Illumina reads 2 true indels were obtained: the first was an insertion of an A located in a non-coding region: a microsatellite located at position $151{,}264_{vir}$ of contig 33, which was disregarded as common microsatellite variation. However, the second was a deletion of a G located in the coding region of gene $g346_{att}$ which generated a frameshift introducing a premature stop codon. Alignment of $g346_{att}$ together with the corresponding orthologs in the virulent strain ($g8786_{vir}$) and the other sequenced *Parabasalia* species confirmed that the truncation of $g346_{att}$ is specific to the attenuated strain (FIG. 4*b*). Both $g346_{att}$ and $g8786_{vir}$ encode for an AGC family protein kinase, as evident by the presence of a protein kinase ATP binding site and the serine/threonine kinase site in both coding sequences (FIG. 4*b*). However, due to the indel in $g346_{att}$ coding sequence, the pleckstrin homology domain located in the C-terminal part of $g8786_{vir}$ and other Parabasalid orthologues was lost in $g346_{att}$ (FIG. 4*b*). The PROVEAN tool characterization of the mutations that were caused by the frameshift, such as the exchange 38 amino acids and the truncation, labelled the indel event as deleterious for the protein. Interestingly, the complete exchange of the last 38 amino acids before the premature stop codon, produced a short transmembrane domain at the C-terminus of $g346_{att}$ (FIG. 4*b*). It turned out that neither of the strains expressed this gene during in vitro growth.

Confirmation of Variants

Similar to the confirmation of gene deletions, virulent and attenuated *H. meleagridis* strains from monoxenic cultivation were analyzed, which were used for NGS analysis, for the presence/absence of both truncating mutations, the SNP and the indel, by conventional PCR coupled with Sanger sequencing of PCR products. In order to narrow the timepoint in which the mutations occurred, a set of xenic cultures of different passages spanning the period during which the attenuation occurred was used for this analysis. Both truncating mutations could be confirmed in the attenuated strain grown as monoxenic culture, whereas the gene was intact in the virulent strain grown under same conditions. Moreover, the analysis showed that both the SNP and the indel already occurred in xenic conditions with the indel appearing between passage 83 and 145, and the SNP occurring later between passages 145 and 237.

Discussion

Comparison of the two *H. meleagridis* genomes (of the virulent and an attenuated strain, respectively) with each other showed that the gene content is very similar between the two strains, which was expected considering that the origin of both strains can be traced to a same parent cell. But it also singled out two coding regions that showed only partial support from Illumina reads in the attenuated strain. This indicated that during long term in vitro cultivation a deletion within these genes occurred in the virulent strain, which during this process became attenuated. In addition to confirming the g6116$_{vir}$ deletion independently in the attenuated strain, it was demonstrated that the deletion occurred already during in vitro cultivation in xenic conditions between passage 83 and 145, and not in the course of the monoxenization process through which both virulent and attenuated strains went independently. The gene g6116$_{vir}$ encodes for a hypothetical protein, however further BLAST searches revealed that the orthologue of g6116$_{vir}$ in *T. vaginalis* encodes for a putative cell-surface adhesin. The probable membrane association of g6116$_{vir}$ is supported by the presence of a transmembrane domain towards the C-terminus. This potential surface adhesin function and its loss in the attenuated strain speaks for its role in the virulence of the parasite. Aside from the role in virulence of *H. meleagridis*, the loss of protein encoded by g6116$_{vir}$ is supportive for the adaptation to the in vitro growth. Long-term cultivated parasites, which lack this gene, turned out to be much easier to cultivate and grow to much higher numbers in vitro than the parasites that were in culture for just few passages.

Further investigations on determining possible genes involved in the attenuation focused on the analysis of SNPs and indels between two genomes. A total of 13 homozygous nonsynonymous SNPs were detected in coding regions, with one of them resulting in the truncation of the protein in the attenuated strain due to the premature stop codon. The affected gene, g8794$_{vir}$/g337$_{att}$, encodes for LRR domain containing protein. As compared to its wild type partner in the virulent strain (g8794$_{vir}$), the g337$_{att}$ lacks a second LRR domain located at the C-terminus, and by that may represent a pseudogenization event. This mutation was identified by the PROVEAN software tool as deleterious.

The analysis identifying indels that modify coding regions detected a single event, which due to the frameshift introduced an exchange of 38 amino acids and a premature stop codon. The gene g8786$_{vir}$ and its counterpart in the attenuated strain (g346$_{att}$), encode a serine/threonine kinase as judged by the presence of the protein kinase ATP binding site and the serine/threonine kinase site in both coding sequences. However, due to the indel the g346$_{att}$ lacks a C-terminally located pleckstrin homology (PH) domain, which binds phosphoinositides and by that targets the protein to the cellular membrane. The frameshift that occurred in the mutated g346$_{att}$ changed the last 38 amino acids, that now are predicted to form a short transmembrane domain at the C-terminus. The functionality prediction by PROVEAN tool characterized the mutant as deleterious. The fact that its transcript could not be detected in the transcriptome of the in vitro grown parasites indicates that g8786$_{vir}$/g346$_{att}$ might only be expressed in vivo, during the infection of the host. Expression during infection of the host is typical for virulence factors.

In conclusion, combining the sequence data from two conceptually different sequencing platforms: Nanopore long reads and Illumina short reads enabled us to assemble high-quality genome sequences from two phenotypically different *H. meleagridis* strains, a parasite with limited sequence data available so far. Two gene deletions and two gene truncations differing between virulent and attenuated strain were found, as disclosed above.

Example 2

Application of the Inventive Vaccine

An *H. meleagridis* strain having all of attenuating features (a)-(d) disclosed hereinabove is cultivated with a single bacterial strain (namely an *E. coli* strain). The cells are pelleted and washed in phosphate-buffered saline. Then, phosphate-buffered saline with guar gum as a thickener is added. Thereby, a live *H. meleagridis* vaccine with a bacterial component is obtained.

This vaccine is administered orally (at about $1\times10^5$ *H. meleagridis* cells per dose) to 30 one-day-old turkeys (Converter, Hybrid Europe, Malguénac, France). Feed (commercial turkey starter feed) and water are provided ad libitum, except for a 5-hour period of feed restriction immediately after administration.

NON-PATENT REFERENCES

Altenhoff A M, Levy J, Zarowiecki M, Tomiczek B, Warwick V A, Dalquen D A, Muller S, Telford M J, Glover N M, Dylus D, Dessimoz C (2019) OMA standalone: orthology inference among public and custom genomes and transcriptomes. Genome Res 29: 1152-1163.

Bilic, Ivana, and Michael Hess. "Interplay between *Histomonas meleagridis* and Bacteria: Mutualistic or Predator-Prey?." Trends in parasitology 36.3 (2020): 232-235.

Brás, Xavier Pereira, et al. "Knockout of the abundant *Trichomonas vaginalis* hydrogenosomal membrane protein TvHMP23 increases hydrogenosome size but induces no compensatory up-regulation of paralogous copies." FEBS letters 587.9 (2013): 1333-1339.

Choi Y, Chan A P (2015) PROVEAN web server: a tool to predict the functional effect of amino acid substitutions and indels. Bioinformatics 31: 2745-2747.

Clark S, Kimminau E (2017) Critical Review: Future Control of Blackhead Disease (Histomoniasis) in Poultry. Avian Dis 61: 281-288.

Darling A C, Mau B, Blattner F R, Perna N T (2004) Mauve: multiple alignment of conserved genomic sequence with rearrangements. Genome Res 14: 1394-1403.

Ganas P, Liebhart D, Glosmann M, Hess C, Hess M (2012) *Escherichia coli* strongly supports the growth of *Histomonas meleagridis*, in a monoxenic culture, without influence on its pathogenicity. Int J Parasitol 42: 893-901.

Handrich M R, Garg S G, Sommerville E W, Hirt R P, Gould S B (2019) Characterization of the BspA and Pmp protein family of trichomonads. Parasit Vectors 12: 406.

Hess M, Kolbe T, Grabensteiner E, Prosl H (2006) Clonal cultures of *Histomonas meleagridis, Tetratrichomonas gallinarum* and a *Blastocystis* sp. established through micromanipulation. Parasitology 133: 547-554.

Hess M, Liebhart D, Grabensteiner E, Singh A (2008) Cloned *Histomonas meleagridis* passaged in vitro resulted in reduced pathogenicity and is capable of protecting turkeys from histomonosis. Vaccine 26: 4187-4193

Hess M, Liebhart D, Bilic I, Ganas P (2015) Histomonas meleagridis—New insights into an old pathogen. Vet Parasitol 208: 67-76.

Hoff K J, Stanke M (2013) WebAUGUSTUS—a web service for training AUGUSTUS and predicting genes in eukaryotes. Nucleic Acids Res 41: W123-W128.

Janssen, Brian D., et al. "CRISPR/Cas9-mediated gene modification and gene knock out in the human-infective parasite *Trichomonas vaginalis*." Scientific reports 8.1 (2018): 1-14.

Land, Kirkwood M., et al. "Targeted gene replacement of a ferredoxin gene in *Trichomonas vaginalis* does not lead to metronidazole resistance." Molecular microbiology 51.1 (2004): 115-122.

layer T, Harrison J, O'Neill P A, Moore K, Farbos A, Paszkiewicz K, Studholme D J (2015) Assessing the performance of the Oxford Nanopore Technologies MinION. Biomol Detect Quantif 3: 1-8.

Liebhart D, Ganas P, Sulejmanovic T, Hess M (2017) Histomonosis in poultry: previous and current strategies for prevention and therapy. Avian Pathol 46: 1-18

Manekar S C, Sathe S R (2019) Estimating the k-mer Coverage Frequencies in Genomic Datasets: A Comparative Assessment of the State-of-the-art. Curr Genomics 20: 2-15.

Marcais G, Delcher A L, Phillippy A M, Coston R, Salzberg S L, Zimin A (2018) MUMmer4: A fast and versatile genome alignment system. PLoS Comput Biol 14: e1005944.

Mazumdar R, Endler L, Monoyios A, Hess M, Bilic I (2017) Establishment of a de novo Reference Transcriptome of *Histomonas meleagridis* Reveals Basic Insights About Biological Functions and Potential Pathogenic Mechanisms of the Parasite. Protist 168: 663-685.

Mazumdar R, Nobauer K, Hummel K, Hess M, Bilic I (2019) Molecular characterization of *Histomonas meleagridis* exoproteome with emphasis on protease secretion and parasite-bacteria interaction. PLoS One 14: e0212429.

McNaughton A L, Roberts H E, Bonsall D, de C M, Mokaya J, Lumley S F, Golubchik T, Piazza P, Martin J B, de L C, Brown A, Ansari M A, Bowden R, Barnes E, Matthews P C (2019) Illumina and Nanopore methods for whole genome sequencing of hepatitis B virus (HBV). Sci Rep 9: 7081.

Molgora, Brenda M., et al. "A Novel *Trichomonas vaginalis* Surface Protein Modulates Parasite Attachment via Protein: Host Cell Proteoglycan Interaction." Mbio 12.1 (2021).

Monoyios A, Patzl M, Schlosser S, Hess M, Bilic I (2017) Unravelling the differences: comparative proteomic analysis of a clonal virulent and an attenuated *Histomonas meleagridis* strain. Int J Parasitol.

Monoyios A, Hummel K, Nobauer K, Patzl M, Schlosser S, Hess M, Bilic I (2018) An Alliance of Gel-Based and Gel-Free Proteomic Techniques Displays Substantial Insight Into the Proteome of a Virulent and an Attenuated Histomonas meleagridis Strain. Front Cell Infect Microbiol 8: 407.

Mazumdar R, Nobauer K, Hummel K, Hess M, Bilic I (2019) Molecular characterization of *Histomonas meleagridis* exoproteome with emphasis on protease secretion and parasite-bacteria interaction. PLoS One 14: e0212429.

McDougald, L. R. "Blackhead disease (histomoniasis) in poultry: a critical review." Avian diseases 49.4 (2005): 462-476.

McDougald L R, Fuller L (2005) Blackhead disease in turkeys: direct transmission of *Histomonas meleagridis* from bird to bird in a laboratory model. Avian Dis 49: 328-331.

Langmead B, Salzberg S L (2012) Fast gapped-read alignment with Bowtie 2. Nat Methods 9: 357-359.

Li H (2018) Minimap2: pairwise alignment for nucleotide sequences. Bioinformatics 34: 3094-3100.

Nicholls S M, Quick J C, Tang S, Loman N J (2019) Ultra-deep, long-read nanopore sequencing of mock microbial community standards. Gigascience 8. 5486468.

Quevillon E, Silventoinen V, Pillai S, Harte N, Mulder N, Apweiler R, Lopez R (2005) InterProScan: protein domains identifier. Nucleic Acids Res 33: W116-W120.

Slater G S, Birney E (2005) Automated generation of heuristics for biological sequence comparison. BMC Bioinformatics 6: 31.

Smit A, Hubley R, Green P (2013) RepeatMasker Open-4.0.

Stanke M, Keller O, Gunduz I, Hayes A, Waack S, Morgenstern B (2006) AUGUSTUS: ab initio prediction of alternative transcripts. Nucleic Acids Res 34: W435-W439.

Vaser R, Sovic I, Nagarajan N, Sikic M (2017) Fast and accurate de novo genome assembly from long uncorrected reads. Genome Res 27: 737-746.

---

SEQUENCE LISTING (43 sequences)

SEQ ID NO: 1 - DNA, 2646 bp, Histomonas meleagridis
  misc_feature: g6116vir
atggcaacaactaatacaacagcggcgattacaatgccgacaactgcctctgttgtaacagaactttcttgtgcgggttcctctgatgttgatggaacttgttcggatgaaactgctgtgcttgtgacgggctctggttcttgtgtctctgttccttcagtggcttctgttgtctcagtaactatagaagtaactgcagaagagtgttcttcagtggtgtgaactgaagatgaagattcggttgaggattcgacggatgattctgatgcaggctcactggatgactcaatagaagattcagatactgattcacttgatgattctgatactgattcagatgaggactcagatgatgattctgatgaagattctgatactgattcacttgaagattcactagatgattcactagatgattcagatgaagattcactagaggattctgatgaagattcactagatgattcactagatgattcagatgaagattcactagaggattctgatgaagattcactagatgattcacttgaggattctgatgaagattcactagatgattcacttgaggattctgatgaagattcactagaggattctgatgaagattcactagatgattcacttgaggattctgatgaagattcactagatgattcacttgaggattctgatgaagattcacttgaggattcactagatgattcagatgaagattcactagatgattcacttgaggattctgatgaagattcacttgaggattctgatgaagattcacttgaggattctgatgaagattcactagatgattcacttgaggattctgatgaagattcacttgaggattctgatgaagattcacttgaggattctgatgaggactcacttgaggattctgatgaagattcacttgaggattctgatgaagattcacttgaggattctgatgaagattcactagatgattcacttgaggattctgatgaagattcactagaggattctgatgaagattcactagatgattcacttgaggattctgatgaagattcacttgaggattctgatgaagattcactagatgattcacttgaggattcagatgaagattcactagatgattcagatgaagattcacttgaggattctgatgaagattcacttgaggattctgatgaagattcacttgaggattctgatgaggactcacttgaggattctgatgaagattcacttgaggattctgatgaagattcacttgaggattctgatgaagattcactagatgattcacttgaggattctgatgaagattcacttgaggattctgatgaagattcactagatgattcacttgaggattcagatgaagattcactagatgattcagatgaagattcacttgaggattctgatgaggactcacttgaggattctgatgaagattcagatgaagattcacttgaggattctgatgaagattcactagatgattcacttgaggattctgatgaagattcactagatgattcacttgaggattctgatgaagattcagatgaagattcacttgaggattctgatgaagattcactagatgattcacttgaggattcagatgaagattcacttgaggattctgatgaagattcacttgaggattctgatgaagattcacttgaggattctgatgaagattcactagatgattcacttgaggattctgatgaagattcacttgaggattctgatgaagattcagatgaagattcacttgaggattctgatgaagattcactagatgattcacttgaggattcagatgaagattcactagatgattcagatgaagattcacttgaggattctgatgaagattcactagatgattcacttgaggattctgatgaagattcacttgaggattctgatgaagattcacttgaggattctgatgaggactcacttgaggattctgatgaagattcactagatgattcacttgaggattctgatgaagattcacttgaggattctgatgaagattcactagatgattcacttgaggattctgatgaagattcacttgaggattctgatgaagattcacttgaggattctgatgaggactcacttgaggattctgatgaagattcacttgaggattctgatgaagattcactagatgattcacttgaggattctgatgaagattcactagatgattcacttgaggattctgatgaagattcactagaggattctgatgaagattcactagaggattctgatgaagattcacttgaagattctgatgaggactcacttgaggattctgatgaagattcacttgaggatgtttcaatttcctcgccgccgccctggccgccaccgccttcttcttcgtcgccgtcgccgccgccgccttcttcgccgccttcgttgccatcagctagtaattggagattgaattttttcattgattttgttaagcgttctagttctgtttcttggccaaaaagggcttgttcgagattactttcttttttgtttatattggctggtcttgcgagtaggatcaggaagagtccaaacatgatagtgacaaaaaatcaagtttttgagagctgctctgaattttga

SEQ ID NO: 2 - DNA, 993 bp, Histomonas meleagridis
  misc_feature: g7085vir
atgattaaagtttccagcgaaaatgcaaattattgcaattataacgaagatgggattttatataacaaaaacgtcactaaaattatatgttatccatgcgggaaaacaaacgaaacatatacattcccaacaaatgccagtgttattgatattaatgcatactgtaattgtatttcattaaggaacattgaaattccatgcaatataacgtcagttggaagcaaagcatttgcatcatgctgcaatctcacatgtatttttttttttttttttacagtcccaacgaatacatcgaatgtacctgatgacaacaatttaatcagaagtgtcctgacaatcgattcatataacggccaaacattctgcggtataaaagtcagtaaaggaaaagtcattgatgaatgtctcccaccgacgcaatcgttcacacgatcgaacacatactcaaacacatttactcagtcgaatacgttcactaagtcgaatacattcactaagacgaatacatttactcagtcgaatacattattaccttcgaatgtaacgctgacactttcgtttacgaattcatattccatcactgaaactgttacaatttctggtacatattcttattcatatgttttgactttaattggagttagtagtacatatgtcagaacagatttaatttattatgaatatattgtgactcgttattcgacgttatatagtttttattcgaatttcttcacaattatcgacgtcataaatcctgttggaaatggtatttctcaaaaggctttgataggtattatctgcggcacaataattgcagttttgctgattatgggaattatcatattccttgtgaagaaatcaaagaaaagtaacagcgaatcaacagcgataaaattcgaaactaaaaattcaactggaagcgatatgagatcagatgaagtaaatcaggaatataatgaactcgtgttggaagaccaggaccaatggctataa

SEQ ID NO: 3 - DNA, 1833 bp, Histomonas meleagridis
  misc_feature: g8794vir CDS
atggaaattacttcccaagaatttgatctttcaaaccaatcattttgggcagcagtcacatttgagcgaattcaaaaaagcctaaatccgaatctagttttaattaatctttctacaaatcatgttaattatgaatcagcagaacttttatcaaacttaatgatagagagcaagactttactttacttaaatcttacagaaacccatttagttaggcgctcttctgatataatttttgaagctcttggagattcatcaattcttgaattttatgcagatgataatattttttacgacgaaagttgtcaaaagcttggtgagtcattacagaaaaatccacctcttcaactcttaagcttgtgtggatgcgacatttcatcaaaagggtgcatttcaattgtaaaaggaatttcaaaggattcaaaaataaccgatttacggttagagtcaaattctttatttgattatggggcaacagaagttgcaaatattataccagcatcaaacttaaccttactcagtatcgctgacaatgaaatatggagtgaagggacaaataatatcattaaagctgttcgaggtagtactatcactgcattagatttaagttataacgtggttgacttaaaaaacctcactagcttgttggtagattttgataacatacaagccattagtatcagtggatgtaaagtttctgaaaaagattttccaacttttatttcgtcacttccaaaaacaaaattaagaactcttatcttggaaagccttaatttccaacctattccaatctcttggcccgaagttcctgataccttatggacaacatattttgatatctttttatcatctttatcagaattccaaacgatagaagatcttcgacttggctttatgaatctagatcaactttataaagtcaagtcaactcttgaaagacttcgccaagaacctttaacaattagttttaaagattttggtcgaactaatgattgttggatatatcattttcctgaatccacgtatgaaagtccagataccattatgcaatggcgcgatagcatcacagtgcacaacgcgttcttcatcggccacatcatcaatcacaccaccgcatcaaataaccgtcaaattgaaattttgaatttgagtcagtgtcaaattgacgatgaaattttatccaaaatcatcaacagcatcgacggccataaccttaagagcatcgatttaagtgataataatggcattactgatgaatccgtcgaatatcttcttcaatatatctctcaatcgcaacttgaatcaattaatctttatgaaacaaaaatcacagattcaggctatgaccgcattttctctcttccacttctccctcttaagaacatttctctctcatttgaaacacatcaattaaatgaagatcaacatcatcaattttttagtagcatcgcatcactcttacgaacgcaagaatgtgttctcgaggacttacggatgacgggctatatcactccagttgacgccaaagaaattgtcgaatcgttacacgagaacacaagtttgaggcatttggaaatcgacagtttgcactgcgagaagtacgaaaaccccgatccagtgatagatccgaacatacagagcctctacgacgacttcaccgaagcgcttgcggatgcagtgatgggcgaaggcacttcatgcagactatgctcactcgtgtacccgctgctgactgaggtatatgtgttcagcgaacgaggaatgaaaatattcgctgacattgaggataagctgaaagaaaatatggaaatgtatgggaaggataatgagtga

SEQ ID NO: 4 - DNA, 1212 bp, Histomonas meleagridis
  misc_feature: g8786vir CDS
atgtcgaaacagacagcatttcgccttgaagattttattgttgaatccccaataggccaaggcgcatacggtcaaatttataaagctgttgaagttggaactggaaaagtttatgcattaaaagcaatgaatagaagatgtcttatgaagatgaaaaaacaaagcctaccaattgtagaaaaaaatgcactaattaagtgtgctagtacttttgttgttcgtttatatggaacgttcaaggatgattcaaatttgtattttgtacttgaattagcagaacatggtgaccttgcagaagccgtaggggatattggaagtcttaacactaatgtagttaaacttctttctgctcaaatttttgaagcaatctgtgtatgtcataaagcaaatgttatccatcgtgacctcaagccagaaaacattctcctcgactcgcaaaaccacgttcttctctcagattttggtacagccctaattgaaaaatctgatagtcaagaattaaatcgttcatccattgttggaactccagcctttgttgccccagagctccttaatgatggaaaaatctgttatagttctgatatgtggtcatttggttgtgtcatattcaatcttcttacaggcacagcaccttttagtggacaaaacacagttgaattaatgaacaacatcactgagcttaagtttaatccagtcattaaaacacttccgaaaaccgccaaagatctcatcacatccttacttaagcttgatccacacgagcgtattggatacggggaagccaaagaaggctatccctccattcgtaaccatgcctttttcaaaggcattgattggaataatttgtcaaatatcaaaatgcctgttttcaccaaattcgaagaagaacaacaaccaaccattgcagattccatgctaaatgaaggggagaccattctaatgaatagtattgtcgacagaaagcgattatttggttggaaagagcgttcgatatttttgactaatcaaaagagacttttgttatttaacaacaaaacgcacgagtttaagatggcaatagcattaacgaatggagtcaaagtgaatgttgcacaagatgggaaagaatggacaatcacttggggaaaaggccaaacgcaaacatttagatcaaatgatggaactggcggaatgtgggcagcatcaataatgagggaatcaatcaaaccataa

SEQ ID NO: 5 - DNA, 798 bp, Histomonas meleagridis
  misc_feature: g337att CDS
atggaaattacttcccaagaatttgatctttcaaaccaatcattttgggcagcagtcacatttgagcgaattcaaaaaagcctaaatccgaatctagttttaattaatctttctacaaatcatgttaattatgaatcagcagaacttttatcaaacttaatgatagagagcaagactttactttacttaaatcttacagaaacccatttagttaggcgctcttctgatataatttttgaagctcttggagattcatcaattcttgaattttatgcagatgataatattttttacgacgaaagttgtcaaaagcttggtgagtcattacagaaaaatccacctcttcaactcttaagcttgtgtggatgcgacatttcatcaaaagggtgcatttcaattgtaaaaggaatttcaaaggattcaaaaataaccgatttacggttagagtcaaattctttatttgattatggggcaacagaagttgcaaatattataccagcatcaaacttaaccttactcagtatcgctgacaatgaaatatggagtgaagggacaaataatatcattaaagctgttcgaggtagtactatcactgcattagatttaagttataacgtggttgacttaaaaaacctcactagcttgttggtagattttgataacatacaagccattagtatcagtggatgtaaagtttctgaaaaagattttccaacttttatttcgtcacttccaaaaacaaaattaagaactcttatcttggaaagccttaatttccaacctattccaatctcttga

SEQ ID NO: 6 - DNA, 660 bp, Histomonas meleagridis
  misc_feature: g346att CDS
atgtcgaaacagacagcatttcgccttgaagattttattgttgaatccccaataggccaaggcgcatacggtcaaatttataaagctgttgaagttggaactggaaaagtttatgcattaaaagcaatgaatagaagatgtcttatgaagatgaaaaaacaaagcctaccaattgtagaaaaaaatgcactaattaagtgtgctagtacttttgttgttcgtttatatggaacgttcaaggatgattcaaatttgtattttgtacttgaattagcagaacatggtgaccttgcagaagccgtaggggatattggaagtcttaacactaatgtagttaaacttctttctgctcaaatttttgaagcaatctgtgtatgtcataaagcaaatgttatccatcgtgacctcaagccagaaaacattctcctcgactcgcaaaaccacgttcttctctcagattttggtacagccctaattgaaaaatctgatagtcaagaattaaatcgttcatccattgttgaactccagcctttgttgccccagagctccttaatgatggaaaaatctgttatagttctgatatgtggtcatttggttgtgtcatattcaatcttcttacaggcacagcaccttttagtggacaaaacacagttgaattaa

SEQ ID NO: 7 - DNA, 21 bp, Artificial Sequence
  primer
aggatgtttcaatttcctcgc

SEQ ID NO: 8 - DNA, 22 bp, Artificial Sequence
  primer
cggttgtccatttttcaaacag

SEQ ID NO: 9 - DNA, 19 bp, Artificial Sequence
  primer
gcgggaaaacaaacgaaac

SEQ ID NO: 10 - DNA, 19 bp, Artificial Sequence
  primer
atagccattggtcctggtc

SEQ ID NO: 11 - DNA, 21 bp, Artificial Sequence
  primer
ttgattatggggcaacagaag

SEQ ID NO: 12 - DNA, 20 bp, Artificial Sequence
  primer
ttggcgaagtctttcaagag

SEQ ID NO: 13 - DNA, 22 bp, Artificial Sequence
  primer
aaatgttatccatcgtgacctc

SEQ ID NO: 14 - DNA, 20 bp, Artificial Sequence
  primer
gatagccttctttggcttcc

SEQ ID NO: 15 - DNA, 938 bp, Artificial Sequence
  PCR product fragment
atttgataatagtttttattggagaaaatgtggaaagaattggaacttctgcattttcatattgcacatcattaataaatattacaattcccaataaagtaacagaaattggaaattatgtattttcatcatgttctaatttgagaatagtttttattggagaaaatgtggaaagaattggaacttatgcattttcatattgcacatcattagtaaatattacaattcccaataaagtaacaggaattggaatttcttcatttgaattttgtaccaaccttcaaatgattaaagtttccagcgaaaatgcaaattattgcaattataacgaagatgggattttatataacaaaaacgtcactaaaatcccaccgacgcaatcgttcacacgatcgaacacatactcaaacacatttactcagtcgaatacgttcactaagtcgaatacattcactaagacgaatacatttactcagtcgaatacattattaccttcgaatgtaacgctgacactttcgtttacgaattcatattccatcactgaaactgttacaatttctggtacatattcttattcatatgttttgactttaattggagttagtagtacatatgtcagaacagatttaatttattatgaatatattgtgactcgttattcgacgttatatagtttttattcgaatttcttcacaattatcgacgtcataaatcctgttggaaatggtatttctcaaaaggctttgataggtattatctgcggcacaataattgcagttttgctgattatgggaattatcatattccttgtgaagaaatcaaagaaaagtaacagcgaatcaacagcgataaaattcgaaactaaaaattcaactggaagcgatatgagatcagatgaagtaaatcaggaatataatgaactcgtgttggaagaccag

SEQ ID NO: 16 - DNA, 442 bp, Artificial Sequence
  PCR product fragment
catcaaacttaaccttactcagtatcgctgacaatgaaatatggagtgaagggacaaataatatcattaaagctgttcgaggtagtactatcactgcattagatttaagttataacgtggttgacttaaaaaacctcactagcttgttggtagattttgataacatacaagccattagtatcagtggatgtaaagtttctgaaaaagattttccaacttttatttcgtcacttccaaaaacaaaattaagaactcttatcttggaaagccttaatttccaacctattccaatctcttgacccgaagttcctgataccttatggacaacatattttgatatctttttatcatctttatcagaattccaaacgatagaagatcttcgacttggctttatgaatctagatcaactttataaagtcaagtcaactcttgaaagact

SEQ ID NO: 17 - DNA, 343 bp, Artificial Sequence
  PCR product fragment
cgttcttctctcagattttggtacagccctaattgaaaaatctgatagtcaagaattaaatcgttcatccattgttgaactccagcctttgttgccccagagctccttaatgatggaaaaatctgttatagttctgatatgtggtcatttggttgtgtcatattcaatcttcttacaggcacagcaccttttagtggacaaaacacagttgaattaatgaacaacatcactgagcttaagtttaatccagtcattaaaacacttccgaaaaccgccaaagatctcatcacatccttacttaagcttgatccacacgagcgtattggatacggggaagccaaag

SEQ ID NO: 18 - DNA, 19 bp, Artificial Sequence
  primer
tttcaatttcctcgccgcc

SEQ ID NO: 19 - DNA, 22 bp, Artificial Sequence
  primer
cgcaagaccagccaatataaac

SEQ ID NO: 20 - DNA, 18 bp, Artificial Sequence
  probe
tcgccgccgccgccttct

SEQ ID NO: 21 - DNA, 20 bp, Artificial Sequence
  primer
acattcccaacaaatgccag

SEQ ID NO: 22 - DNA, 22 bp, Artificial Sequence
  primer
gtgggagacattcatcaatgac

SEQ ID NO: 23 - DNA, 32 bp, Artificial Sequence
  probe
ccaacgaatacatcgaatgtacctgatgacaa

SEQ ID NO: 24 - DNA, 616573 bp, Histomonas meleagridis
  misc_feature: contig_40_vir
cggttattcccacaatttacgactttttgaattcgctgtaaaacaaccgtctcatttttccaaaattttggataaaaaaaaaaaaaaaaaaataaagcttaacaaaatagaataatttcaacaatagtaagaactatatcaatatgattattcatgaatagtatagaattaaataataatgagtattcgtggaaaaaaacgattttgaaaataatcataaaatattataaaataaatagtataatcgaattctccatatgttaaaacatattactgtattctttttttgccaaaatacaaaatgtatattgtgttattagcaaatgttttttgatgtccattatgcattattgaattcatgttcaaaaagtgggaattgtgaagaaataatttcattaaattttaatttcaatactttacatttttgccacaataaattctgaacaaataaaaaaatgacaaagaaaaacaaaataatttaaatgaataatcaataaataagaataattatatacattaagcattgacaaacaatgagctacaaaatatattctttaataagcattaaattacaataatttatgaataacattatttacaatcattgataaataatgaattataatgattatcattaattaaacattaatatacaatgatttatcatgattatcattaattaaacattaatatacaatgatttataatcatttatttcattaaatattaataaacaatgatttataatcatttatttcattaaacattgatatacaatgatttataatggttttctacattatatattaacaaacaatgaattttaattatttagttctttaaacattcatttattaaacatttattaattttgatgaatatctttatatgacattaacaagcattgaattacaatgattttgttaattatatcttttttaacaataatttttcctgaacttaattctaaaacattaactaacacatataattttgtgattcataaattataaattttttattgaatatcaataaaccatatgttatatttccttattaaacaacattaaattattatttttatttaacatcaataatattctatattatgatatgctaaacttataaaaacaataaaatatgatgaaacatttttcttattgtgaaatacaataaatttctataatatcaaactgtaaaccttgataaacaatgaatttgatattcaaattacaaaatatgttgatttcatgttaaacatgattgtcgatgaaataataaacgaaatcaactttttcaataaatatttggccatcatatttgtaaaaaatgatcgcgagttggcctgggcgttatgatggtatgcatcgtagagtatcctatatgatcgaaattaacaactataaatatcagtttgagcgcaacggaagtaaaaaacatcgaagggctttctatagatgcattcatggcaatcgaagcatgccaggttattgcaaatgccgtctttcatgtgatttttctgcagatttatcgtcttattcatatattattcatggaattcattattgcgatcaaaatacacagaatgattcaccattttggaacaaagaagacatcgaaaaaaaaatcatagaattgttcaatgacaacaaatatcatcggatgccatttttaattttcaatgaattgttgaattggatcgagaagaaaacgcctataggcaaaaccaaaaattccatttctctgcggaaagtacagaactttgttggagaattgaacagacaatatagatcgaacactgattttaaacaaactttaaatggagatcgagtattgttatttgaagtacctatagatgctgataaagttatttatgggttttcatcggatttcatgttaaaaagagttcaagaatcttcaataatcggtattgatggaactttcaaaatttcaccaataaattcttatcaattagttacttttattggaagaacaccgattatgaatattcctttgttatatttatgtctaccaaacaaaaaggaagaaacatataaaatgcatttagtctatataatgcatacttgcaaatctgtggttattctttcaagcaagatgttaagtttgtttgtgacgttgaattagctattatgataaattcaatcaaaagaatattcttgcacaataattcatgcttgcaactatgctattttcattatgttcaaactttaaaaaaacataaattctattttaagagatctcaaaatatatttcttattgatctgttgaaaattctcaagctccttccatatattgaaattaattccgcaaaaaaatttattgattttatgactaaacttaaatgtggggaaaagccaattgatgaatttattgactattttcgaaaaacatatttaacaatatatactattgatctttggaatacgactgggaaaccaatgcctgaaagatctataaataatggaaacgaaagcttcaataggacgatgaatagatacattaatacatataagccttccttttcatgaatttttcgttcatattcaaacattagaggatgtgcagaaaaacaaatatcttaattgagaaagagacaattcagttattccgaaataattttatgaaaaaccatttcacaatgaaagtctagagtttattgaacaaattaaatatatgagaaacaaatatttttattttaataaagcgatggaacttgaaaacacatatgattttggtgttaccccaaattttgaagaaatgctgagttcgttagtatttcgagatattaaaataacaccaccattttatgctaaagataaaatgggtcgttttacacctataaatactagagccagaaaagtgaaaagaaattatggaataccatggacaatagttaaaaaatatttgaaatcaagtaaaaaagataaaaataaaataattacgaaatttttcgatagaggtggttgggaaaatatgtcgcaatcggaaaaaaaaatggaacatgaagttcaactaattaaaagattagaaaaagtataatatatttaattgaagttcaaggtaaattaaagtcaattattattcatgaatatttataatttactttcatttcatttcattgcattatcatgcgtaacacaaattcatgatttgctttattgttgcacatttattcaattaatttgttttttcaaatttaacaatgatttatttgatatataagtgcttataatatttagcacatactcaaaaaactattgcttttattcattcatataatgtaattcatgaattacattgattattgatgttttacaaataattttaatgcatttataattttcattatttgttctcattatctattattggcttttataaatttaacctgcacctcgatattaacttttttgtaggaaagcaaatattgttattatattcatttgcttataaatgttcatcaaataataaattattgctttctgaagtatagtaagattaaaaaatgattcataactttttagatgatcaaaaattttttgtttacaacaagttgttgtctattgattcacataaaagattcttatataagaatcgattatcgataaaataattaaaagtttattatattatagataatattttattcattttatcataatttattgcatttcgaatgttaagcattttgctttgacaaaattgactgattatttcatttatatatttaataaaaattgatatattaattgattgttttttaaatgcttgtttttaatttttatgacaataaatatgtgctcattgcttaacattttacttgaaaatattcattgcctaattgaaattataaatcattgtatattaatgtttaatgaaataaatgattataaatcattgtatgttaatgtttagttaatgataatcattataaatcattgtatattaatatttaatgaaataaatgattataaatcattgtatattaatgtttaattaatgataatcattataaatcattgtatatgaatgtttaattaatgataatcattataaatcattgtatatgaatgtttaattaatgataatcattataaatcattgtatatgaatgtttaattaatgataatcattataaatcattgtatatgaatgtttaattaatgataatcattataaatcattgtatattaatgtttaatgaaataaatgattataaatcattgtatgttaatgtttagttaatgataatcattataaatcattgtatattaatgtttaattaatgataatcattataaatcattgtatatgaatgtttaatgaaataaatgattataaatcattgtatgttaatgtttagttaatgataatcattataaatcattgtatattaatatttaatgaaataaatgattataaatcattgtatattaatgtttaattaatgataatcattataaatcattgtatattaatgtttaatgaaataaatgattataaatcattgtatgttaatgtttagttaatgataatcattataaatcattgtatatgaatgtttaattaatgataatcattataaatcattgtatatgaatgtttaattaatgataatcattataaatcattgtatatgaatgtttaattaatgataatcattataaatcattgtatattaatgttttattaatgataatcattataaatcattgtttattaatatttaatgaaataaatgattataaatcattgtatattaatgtttaattaatgataatcatgataaatcattgtatattaatgtttaattaatgataatcattataattcattatttatcaatgattgtaaataatgttattcataaattattgtaatttaatgcttattaaagaatatattttgtagctcattgtttgtcaatgcttaatgtatataattattcttatttattgattattcatttaaattattttgttttacaatgtcattttttatttgttcagaatttattgtggcaaaaatgtaaagtattgaaattaaaattgaatgaaattatttcttcacaattcccactttttgaacatgaattcaataatgcataatggacatcaaaaaacatttgctaataacacaatatacattttgtattttggcaaaaaaagaatacagtaatatgttttaacatatggagaattcgattatactatttattttataatattttatgattattttcaaaatcgtttttttccacgaatactcattattatttaattctatactattcatgaataatcatattgatatagttcttactattgttgaaattattctattttgttaagctttattttttcgaaattttttttatccaaaattttgaaaaaatgagacggttattttacatcgaattcaaaaagtcgaaaattgtgggaataaccgtccaaaagtgggtatgttttgggtatgctacccagactctcggtttcacatgcttctttcaaatagattttaccgtcaatattaaaactatatcttatttgtggatttaagaagcatgttcgtgaatattgacttcgtctgaatacagtaaacatagtatcacaatgtttaagtcctattgttgctgctgtgttaaatgatgttggagcacttgttgaattacttccgagtggttgtgtgaaatctcttacttgacaaacgtgaattggaaatagcatcggaacttgaatatattttgcagcaagagcattaaacacatccattttcaataaatatgttgcaagcttgatttttacgtcttttgtgacttgactcttgcaaacaaattgctgtggtgcatccattgtagcataagttgttgttccgctcgatgatgttgctttaatgttgctctttcctgattcattaacatttctaaatccaaggtcgcataaatatactccttcgactacggttttgcagcaactaacgattcatgatcgcatacaggagcaataacaatattttgatatgaaggcatcagttcgattgaaagcttaccgctccagtttggataatatcgcatattaaataacatcaaaaaataacttattggaattcttaatggaatcttaactataacttcttttgctgaggtaatagcgctaaaatcacaatatacgcgaggaaccattgaatcgtgagctcttattttatcgatatttgcgaaacaatcattacctgctttagcttcatctgatagtgagttgtaaagcatgaaccattcataccttgcgttatgaacgtcttgaattttatctgtgtttgaataaattctgtattgatctatagcatcgcatgaacatttataaccgacataatattctttaaacaaaagatttgattgtgacggaacggtaattggtacttcttgttctaaagtaatatatgaatcatctaaaccaataatcttaaatctatccgtgaaaatgtcaacgtatgttgtatctccttcgtttatgtctccaacattgccgtaagaagtagcggtcgtgtattcataatttccaggaataatttcagaagctataaccacttcatttacttcattgtaccaatcctgcaggtttccagtcattgcagggagtgtggaatgcatacgcacttttatacgcgcttttcgtaataaactattcaaatacgcacttttatgaatgcacgccgatctaaccgaaaaaattccaatttttttgattttttttaaacttcgaaaatcaaacttaatgattttcgataaaattgatatataatatagctcatataaagtaataaaataatttaatgttaaatcttcaaaaaattaattctaaaatgagataagatcaatttaaaaaaatatttatattttaaaattccaatagcattaatcgaattcacacattcaagaatatatatctataatgtttttttggattaaaatatcttgtattcatgggaaaaaatgaagatattttccaaaaaaattgagttgtattgaattattgaatgagtattcaattcttacgtgggaaaaccgtaaataaaaacaacacattcaaaaaaatttgacgtacgatatttaactcaaaagtgattttctgttcaaaataaaaatatttccattaaaaatgataaactgataatttcattactattatatgaataaatatcaataattattgactatatcagagttttattaattttattaaattaaatttttaaatctcaattagattgcattcaaaatttagttgatgattattaaaacattatatgctaatttatgcatttattcatcattaattattctattcattcattattatttatcataatgtattttaaatatttatcattcatcattatttattattgatcatttattattatatttatttatgaataacattatgcattacattaatgaataacattatacattatattatacgatatattatacattacattaataatgaataacaatattcgttacaccgatgaacacacacacacacacagcgctatgtgagcttcgtgctacgcactcgctcccactcgcgctacataaactaaaggatgaacggctaaaatcgattgaattatcataaatcggttggttttgattgaaagtaataaaatatatttaaattcatgatgacatttatatttaaaatgtgaataattgtttgaagaaaaaatgatttccaaaaattattgggttattcgtaatgttaaaaatttataaaggacaaaattcaaaggtttcgttatttttataattttacaaagagatacatttaggaatgaaacttgatttgccgcgaaaaaagaggtcgtttagcgatagaggccgtttgtgtttttttgacgttaaaagtgaactttttgtttattctcaaatttgtttgttttttaaatataaatattttattatattttcaggaaaagttcctccaaaatggtgttgacatcgattctcccatcaggtataggtctgtagcaataccagatatacttcaaaatggaccatcgctgatttgtgcagctgcatacttttcagcattaaaatgctttagatacctattcttgaacggtgctgatactttatttgttgatgacttccaaaggaagcttgttcactttgcttctgctggaggatcaaccgaaataaaatattttctgacaacccaaaatattgacttttcagctgttgacaaagagggaaacacaccagtccattacgcagtgatgtttaatcgtacaagaatggtttattacctttgggcaattcatcatatatctttagacatcttaaacaaaagaaatatgtctcctcttcacattgctgtcacaaacgaagaaattaagatggttaagttcctttgtgaaaatggttgtaacatgtaatgcaaaaaaatgattttggattcactccacttcatattgcagcatgtaagccaaatatcgggttggtaagcacaatgatgcaggatggcgctgaggtgaggcttagggataacactggttgccttccttatcattgggcaattctgatgaagcatcaacacatccaaaactttcttttggaaagtggatccttccaagacaccgttgttactcgctaatttttgtttaataaaacttttatatgaaatcaatttgaaaaattctgtgtaaatgttttggccaaatcatcaccattcctacagtgataattattaacaattatctctaaatctattgatcaaaatcgaaataagagaacggctctttatttcgatatctcaagatcaaattttataatcgttatggtttctcattagatgctgatttatatgagccaattaattctcaaagcaaacttccagtaattgcagcttgtggtcccctcggagctgataaagaataagaagctggtctttatgcacaaactttagctgaaagtggctttttaacaattgttacatttgacccatcatatacaggcgaaagttgcatacaacttatgttgcttatccagatatcaacaatgaagattatcaagcagctgttggttatatatcaatacctaataacgttgatactaaaaagattggaatcattggtgtctatagctggggacgctttgtaatgctgcagcaactgttacatcaataatgtaagatatgacacacattacagcgcaaggatactttggtagcgaaaacactaaagaagttctttatcaaaataaataaactgtctatatcaaaataaataaataaacacatgattaaataaagatgtatttggaaatatttaatatataaaagattcgattaaaagtttttttacatattattttcagtaaaaaaataaatgattttaaataaaacatattacaagcttcgaagccattccgacataataaaagtttctttcatcgaaaaaatctttaatatgaaattgtgatgtacaattgattgattctcaaatattttattcatttgtattaacatttgttatttctttattcaaacaaattaattaattcattaatcattttctcacttcgacgaatttttttcttggcaaaaccccattcatcgtcatcataatacggcttgcatgcaaaacattttccagtgcagcagtaatcatttttcacgtcttcttcgttcgggaatgctcctcttttgattccctattctttcatggtactgatgcagataaattgggcgcacagaacatttgcgcggaaccaggcaacagcttcattaacctcgcgatgaacaccatatcactgtttggattcattggcacttcagggaaccctttcattacgatccataattcctttgacaacaaaatgaaatctccagcgacacattcttcagcattttctttatatttatcacatgagtccaaaatcgcgaaattgttttttgcaatacatctttgatatatgtccatattctttagtttccatgtttcggaaatcatttttatcattttattaattgtaatgtttttgttgattgtgttttcatttaaatcccatcgattacctcgataagaaacaaacgaattaaattgacgcgatgcaattaattcgaataattcggtggaaaataatgaatcgccattagtagtcaatacaaatttagcattcgatcttcggattccaatatttttagcgatgtattcgaagaatggatattttacattaaatttagtttcaagttcttgatgtacaattggtggaactattataaaacgaacatttttcttcaaatgtttcggtatttttaatatactatgaagtaatgtattatttgtaggtgttgcataatcatcaattattacttcgactttagctaatggcactgttttaattccattgtttattgatttaagtaagttttggacacgcgtttcgaaattattcgaataattatcatgtcgaccagtgaatactattgataaatatatgttattatatttataaggattagcaaaatcgaaaattgctttttatgcattaattctacatcattaattcgattatttttcataattttttctttgattatattcgtcttaagttttggtattttatgtgaatactttttaaaatgtattttacaatttacaatgccattcgatttaactgtacaatgtttactgctgtcttaatatctatggatgaattgccttgtaataaaatatgatttcgtgtgttgtttttaagatgttttattacaaattgcgctgcatcatcagatgtaatactttgatatgttaaataaggataatattcaatgttggaataaccagccgatcgacactcacgaacagctctcatcgttggattctcgatgtctttggtggcaattgtatcaacaagaaatggcatttcaatgactgtgccttgatgacgcaagtattgattttactacatctgggaaaactggttgagatactgcaaatataaaaggaatgttatgttgctctaaataatttgaaattccatcaatataattggtcgcaatgtgattaatatgatcaaaaccatctgaaaaagtatgtcgaattaatggtggctgataagctatatatgcttccttgatgttaatgatgtcgaaatagtgggaatgttttctttgataaattgtcgctttagggatgaaccaagaactgtggatccgccaattataaggatatgtggatttttaagtgcaggaatgtcaatgtccttgtcaaatatacgagcaaattccgacctatacaatgttctattaatgcatttgttgtttgctttggaatttaatttatgattggaaatattgtttacttgagaatatggatgtggctgaggaataacaatgggatcaaatgaacttggttgtcgaaagaaattgtgaaaagatgcccgggatttaatccttaccctataaccgcgtaaacttgatttaagaattgcaatatatatataaacaaaaaagattaacataactattgaaaaatatgtaaatcgtgtagctttttttgtttgtttcataaatatactattataaattttgtttcagatgtataaatataaaataataatatctatgacattcaaaaattgacaattttcaaaaagaatgacgaaaaagtaacacaaaaaatataaatcgataatatccatctttatttaataaaatttagatcttttcgatatatattatttatttttattcgttaatttataccatttattatttaaatagattgtgaatattaattaaaatatttttattttattgtttgtttataaactattgaaaaaacgtgtgacaaattgaggatttaccagtggtaaatatataatgcggtagggaatgatcacgaggaccctaggggccccgccccccggcggggcccctagggtcctcgtgatcattccctaccctattttaagttttcactgggggcactgggggaattgaaggggtctgagacctccggaggtgcccttcggacccctccggaggtctcagaccccttcaatcccccgagtgtgctcgctccgctcgcaacaaaaatcaaaatgatttttgtgagccatacaattcgtctgaaaatttgaatgcgcattcgattttgagagagcacgaaactttttgataggaacgatattatttttagcaccacttttcgcataaacctatcaaaaacctcacataaccaacacgaattgtccccggttatctttggtcggacatttatcttattcaatttatctttgccaggaggttaatagacaaaaaacgacgaatattttttgaatacatggcaaactttattttaaatagtaaataactgttataaattatcacttcattttttcttcatgtatgcgaatattttttccattgctcaaattgcagacaatatcaaaaataaggatcttgatgctattgatgttgcaatattctttgatcctaaatataataaaatgggaaattacaacaattttattatcaatccaattgggatgataataaaacatagtaattcttccgattttttattttattcaaagagaaataatagaattctttgacaatccaatactaatatcaattccaattactgaaaataagaaaccacctataaatcaaaatgttcattatttagaaatagacttatttccattgaaatgtaaatttggacgatggtatgcgtcatatatctatgagtcatataatgatgaaattaatcgtacattattagataatgtgatcgttaatagtcaaaataaagacataactcatcaatctgcttttgatttaaagcaggatcttttcaagagtgcctaaaaaataaaaaaatgattttaatttttttatttattttgattctataaaaaactagaaggtgatgaatatattctactatttagttatttaattggataatttgttaatttttcaaaataaattgaattactaatagtttattttggtaactttatatactggatagatggatctattaactcagtttctttctctatcgttgatgaatttaatgtctcatcgtcataataagtcttgatcaccttcgtgctaccagacattaataaaaatgaaaatttcattaaattataatgaatttttgaaactaaactatgacaaatgggacacaggtgttctttaaggacgcctgggatttggaatagtttcaaaacaatatatatataaataatattttattatttcttttgtccaactagacacacacacacacagcgctatgtgagcttcgtgctacgcactcgctcccactcgcgctacataaactaaaggatgaacggctaaaatcgattgaattatcataaatcggttggttttgattgaaagtaataaaatatatttaaattcatgatgacatttatatttaaaatgtgtgaggcattaatccggctgagttgttgttaatcctatgtggattttagtgttttgttgttaatcctatgtagattttagtgtttggagcttaaagttgttattaactgaggttttgaatgtaaaaagtaccttttaattttcaaagatgtttttttaaccctttttctaaccctttttttaaccctttttttaaccctttacgaaacggagaaaatgagcattttttgaaggatttaacgcaaaagttgacggttgatatatcagtaagaatttgacgtttatcctatgtggattttagtgtttggagcttaaagttgttattaactgaggttttgaatgtaaaaagtaccttttaattttcaaagatgtttttttaaccctttttttaaccctttacgaaacggagaaaatgagcatttattgaaggatttaacgcaaaagttgacggttgatatatcggtaagaatttgacgtttatcctatgtggattttagtgtttggagcttaaagttgttatcaactgaggttttgaatgtaaaaagtaccttttaattttcaaagatgtttttttaaccctttttttaaccctttacgaaacggagaaaatgagcattttttgaaggatttaacgcaaaagttgacggttgatatatcggtaagaatttgttgttaatcctatgtggattttagtgtttggagcttaaagttgttattaactgagattttgaatgtaaaaagtaccttttaattttcaaagatgtttttttaaccctttttttaaccctttacgaaacggagaaaatgagcatttattgaaggatttaacgcaaaagttgaatgacaaaaaaataaatttttttaatattagctttaatttttaattttgtaaaatcatccgaaaaacgcttattttatccgattcgttaagggttaaaaaaagggttcatttttttatttttttaaccctcaaaaattttgtgtcacttttggtgtcacttttgtgtaaattttcatatcacatgtctgtgtcacttttatataaacatttcacataacatttctgtttttcattttcacatgtcgtttccgaaaaatcatttcatatcacatgtcttttcatttcatatcacatgtcttttcatttcatatcacatgtcttttcatttcaaatcacatgtcttttcatttcatataacatgtcagttgatgtcaaattaacgttcgttagtgatacgtttacgaaaaattaacggacggagaaaatgacggttgatgaattttaacggtcgagtaattgttgtaaaatgtgttgtaaaaaatattcgaatagataaagaaaaatatctacgatgaatggcaaatgtaaaaatttttgaattgacattgaatttagtggcaaaacgattaataattgaatgagtactgaaaaattggcgggcaaaatgatttgaatgagttctgaaaaagttaattttgcattgaaatcttaaaacgcgtgtttctccacacaggagcatttttttttcaatgacgtaaaaagtaaagtattgaattattttacaatgaaaaaaattttagtggtaattgaacgttaaggatgaaaaattggcgggcaaaaatgatatttgaatgagttcagaaaacaagatttgaatgatgttttcaattagtgtcaaacgtaaaattttttgaatcgacattgaatttagtggcaaaacgattaataattgaatgagtactgaaaaattggcgggcaaaatgatttgaatgagttctgaaaaagttaattttgcattaaaattctaaaacgcgtgtatctccacacaggagcattttttttcaatgacgtaaaaagtaaagtattgaattattttacaatgaaaaaaatttaggtggtaattgaacgttaaggatgaaaaattggcgggcaaaaatgatatttgaatgagttcagaaaacaagatttgaatgatgttatcaattagtgtcaaacgtaaaattttttgaatcgacattgaatttagtggcaaacgtaaaaaatattttatgacgaagtttatgacgaaggataatgtgaacgttaaggatgagtgttagagtcgaacgttaaggaaaaatgaaatgttatgtgaaatacaaggaagagcaaaaaaaatgttcaaaaattaaattcaataggtttgggaatcgaacttggagcgttgataaaaaacgctacgtaagggaattgaacgtaaggcgttcattgaaaaagtgaaaaactgacattgaaatttaaaaattaaaatatctcgttatgtgatagttatttttatataatttacatatcaaacgatttcttgtcgtttgtacttcccgggaaagttatttttaagccttcaaactcttttgaaaacgtgatattttcatttccaacgtaagcatttaatgatataattttattgtcaatttcttctcgtttctcgactaattcgtcagtgatgcgtttgacaatatcatttctggctttcataaatctattatttaattctgcaggagcaatatttacaagtttcttttcatttgttttagtaagaatgttatcggtaaactttaaatttactgattcaagaagttttaaattcttatcataaaatttaacgcctacaagaatattattatgaagtataggtttatttgttggtttatctatcttcactgttgtattatgattatatttgaactcaacggcggcgtaaggcgtcttgccggagcaagacttgtcttgcgacttaattttatattctgatatcaaataatcttggaatgattcgagtccttgactctcagagaacgaagttctttccatttattaacggtaaaaaatttatttttataaataaaaaataatgcgaaaaatttctttaaaagaggttgataaaaaatttgatgagatagaagaattgtttgataaattagaaaaacaaaacaaagaaattttagagaatgcaaagataaaaccaatacatgaaaaattcttatttgctcaaaacggaataacagcttttatagcgccgatgggttcaggcaaatcatatctttacgttaaactcggagcgaaacaagaagtattatttaacgaaccgttttttgaattaataactatttgtagtacatcctcaaaatttgatgaaacagtaaatacttataaggaagcaataaagaaaacgaaacttgttgcgataaaagatactgatttgttagactggattaataaatatattcggagaattttaaaatataattctatcattaaatatatcaattctgattttaagaaaacggatgaagaagtagaaagattatttatgaaatataatttgaataattcaaagaagaaattaaaatacatttctgaaaagttagcgaaatatcaatggaaaacttatccgcatagatgtttgttgatattagatgattttgctaatcatcctttgctgaggagtaaagaaacggagatgtcaagattacttaaaaaactcagacactttaatattaacgttatcatttgtgtgcaaacaacaaaaagtataccaaaagatataaaaagaactttgtcagatattgttttgtttaatggtattggacaagaagactttttcgatctgttgaaggaatcaccagcgagtgtttttgacgcaaaagctttatggaaagaatatagcaaaatgaaagacccacacggtacgtttagtattcacattaaagcacgaagagttattataaatcaaaaaatgaaagaatcttaagattcggaaacaatgtttcataaaaattatttttgattttgaatctcaccaacaaataaatcttcatctggcattccttgaacagaaattgttatatacattggattcagtaaatgtacttcgtgaaggtttgcgtcaacgagtgtcaactgtatatgtgacaaatcattagaatttatgtcaatttcaaaatcagcgtttgatacaatattcggaaaatttgccgaaaaagagttattgattctaagaacgatttttgagatgttaatggtttcgtttaaatttctataagaactttttccaacattccacaaaagatataatactggagttgataaagtatttccgactgattcagcgaatatttcaaatgtatctgtaccattaaatgttgatggtataggaagaatttgtgagtataatcctgatatttgaattatattatatgaagcattatttattgtaaaggcatttgaagaagtaaatacaattcttccggcttcgtcgacttcagacgtaacgcctgattcttgaattaaagaattcaacagtaatataaacgtttgtgagtttaagtcagtgtaatcattattgaaatagtattttttaccgttaatctgtataaaatcatctttctcaataacaacaatagaacatttagtcgttaacgatgttacaatcatttttgcttgacgtgttggcggtgacggtaagtttacgtcaattctattgtaatgttcagcgtcgtaggaagaaattgtataatcaattactgcattatacattttatatattgtaaaaatttatgaataacatatataaaaaattcaagggttaaaaaatcacaaaaagttaacctttcagtaactcgagcaaacatgcaatattcgcgtcaaatcattcgaaaaacgctaattttctccgtttcgttgagggttcaaaaaaagggttaaaaaaaaggttaagttaacctcaaaattttaatggtactttttaacatacttttttaacatacttttttaacattttaatttatgtaaaatgttttttattggtgtttggatgtgtgttattggaaccatttacgttttaaattcaatcgtaaatacaatgataaaaatatatgttgtatttaacgaagaggaaggagataaaaaagaaatccctgaagatattaaaaggtcactttactcttaaagtacaacagtttttctgtaattataaagaaatactaattgaatgataaacctgcaatatttcggataaatattatttttaccgtttgttgtaaatctaatgttaaatgttgagccatcagttggcgcgttatataatacagtaggtttttcataaaaatcacctttgatgccaatgaatcgtctcttcgaatcactaaatgaagcatgaaattctaaatactctctgttccaaacattattaaaagtcattatttccgtttgagttgacaaataacttatactttctgacgttacatcttgatttaagaatttcaaaaaactttctaaattagatgtagtacttcctgaatcaacaatcgcgaatttttgcgacaagattttggctttcatccgagcctacataaggacaagcaaaatataaattgcctgagtcttcgtattcataagataatctataactcgcaaatgaattattaaaactattacaaattgacgttaaaatttcaaataaagtattttgcgccataacttgaattttaatgatacgtggattaggtgaagaaccactgacgctttcaggtttagttacttcaaactgtaatgagaaaacgtgagcggtcggcgttatatctaatcttcttatgccaatagctttattctgtgacggagactctaaccaacgttgaggataacggaaagtataaccattttgaggatttaatacttcatacttatctaaatcaagatttgtataattttcttcaatcggtaactgagacgcagttgttgtaaattgattttcagttttatacatttttatcttattaaaaatgtcaaaaaaaaaaaaaaaaaaaattgaaaatatagtaagagcattaatgaataaaaacagtgttgtatacagtaatcaaaaaaaaacatctgatacattatcaaatggtatatgtacattacagataaatagttatgacaaatcatttgttttcacttacggaagaaatcatgttgtaatatcaccgttagataatagtataaaaaatttaaagtatatcaataataatattaaagttgatgatatacttactggagaagatataatgaaaaatgcatatataattgaaatgttcggtaatattaatagagttttagacttatatccacaattcgtaaaaatcaatgaagatagtaataatgtttcaattacaaatttaattattgataccattaatggttattctatcagtgattttgcattaaaaaatcatacacatgaaataattaataatgatttagctattaatggtagtcttgtcgcaaattccattaacggatattatatttcaaagagtattggtggaggttctaattcaacagtaaatattccatcaatcgcgactattaaatcagatggtgtaatggaagtcggtgagtatattgattttcattatagagatgatcataataaagataatacgtggagaattagagcaataaccgatacattaagttttcaagcaaaaggtggaagtacaattagttttaataataacggtaatataacagtaaatagtattaataatatttctacaaatgatatatcattaaacacacataatcacgacgacaaatactctccgttaaatcatattcatagtgattatctaactaatgccaacttagaaagtattaatcataaattaaccggaatatattataatgaagaaacgattactaatgaagaagaagaagaagaagatattatcgaaaaatatactttaataaatcaagatcttatagttaatggtacgattaatgatattaacacagaagaaatagctttagttcgagacggaattttatctatcggagacgttatatcatttgaaaacggagtcagtatatcaacttatgataatactactgatgaaggaattactgaaaataatttattaataaattatcctaatggtaatagtatcatgttagaggatagcggacatacttatggtataattaataatgatggagaattaaaaacagaatactatttaacaaaacaaatgatcattgatgatgaagacatacaagaaattttaatgggacctccaggagaagacggtgaatccacatataaagaaagttttgttgatagtatatttgatataatagatacattttttacagctgctgatacagcatatactatagctcaaattgtaaaaaaaataaaaaattttgggtgggcaggatttttatataatagttttgggattaatgttatgaagtcaaaaggttatttaccgttaccatcattgaaatcagtagtttttgatgaatatgatatatcgacaggtggaatgttggaagatttagaagttccaaacgctgaagatatagaccaagaatttaatgaatataattatttaataaatctatttcctgaaatgaatattatatttaaaaatttgaagtattattataaagacgtctctaaaggtcaaagaacaaatgaattaggtcttttattagtcgattgtcagatatataaacgtttcgttaatcataaacatgataattatttaatagctgctgatttaaataattatacaggaataacttatcataaagatttattagaaactgatggagaggaggaagaaatatatgaaatctacacgtcaattaatcaagatttaaaggttaatggatcgctgatcttcgatagctttagctgtcgcggtaatgttgaatgtacaacaattaatggtattgatttagatgaattatccgtgataagtaatgatatatttaatattaacaataaattaacaggtattacttttaataaagattatgtcgaaacaaatgaagaagaagatatttatgaaatttacacgtcaattaatcaagatttaaaaataaatggtaatatagaatgtacaactattaatggtattgatactaataacttttcttttaacaaatcatactcacaatcaatatttaactaatgataatttaactgatataaataaggctttaacaggaatatcatataatgaatatggcgattggactaagattaaacatgatttattagtaggtaatgatatttcatgtagaatattgacagcaagtcgtaatatcaatattgattgtagtaaatattcagatgatacaaatatttatgggggattgtttattcatagaactaatgcagtgccaggtaattctattagaatggaaataggtgtattgccttatggagatgattgtagcgtaatagaacattacgtaggttctgatgataatattgatacttgtctaagattcaaagtttgtgatggcaattatgtaagtatatttagaaacggtaatattagttgtaatagtattaatggaattgatactaataatatttcattaacaacacataatcatgatgataaatattctttattaaatcataatcatacagaatttaataatgctattactattaatggtgaacttattgtaaatagtgatatatttattgatggtaatataaattgtatttctattaataatatttctgttgataatttctcattaaaaaatcatactcatgatactattgataatgatttaaatgttaatggtaatttatattgtgaaacaattaatggaaaaatacctgaagaattctcattaaaatatcataatcatgacgatagatattctttaacaacacataatcatgatgataaatactcttcgttaaatcatacacataatgaatattcattaacaacacataatcataatgataaatactcttcgttaaatcatactcataatgaatactcattaacaacacataatcatgatgataaatactcttcgttaaatcatacacatgaaataattaataatgatttagctattaatggtagtcttgtcgcaaattccattaacggatattatatttcaaatagtattggaggaggttctaattcaacagtaaatattccatcaatcgcgactattaaatcagatggtgtaatggaagttggacaatatattgactttcatgataataatgatttaaatagtgattattcttgaagaataagaactgccggcaatgttatgtatttcggtaaacttgataataatgatggtgttattagtttcaatggaattgatggtaatataaattgtatttctattaatgatatacctgttaataattttctttaaatacacatactcatagttataatgatattactgataaaccatcaacatttactccatcatctcatactcatcaacctgctgatattgttccttatcaaaattctgtattaaaaacaggaagatttttagatttcgtttttcataataattcaacagaagcaccaggtatttatacttggagaatagcatcatatgaaaatgaattaggattttggcatatatcagatggtacatacagaaaaagctattatatcaagtagtggtggaggtcagattaataaaactattgtgcataatgcgccgatagacgaaacattaacattaaatgattttgatattggctcttttgtatttataacaggtaacgtatataaattaaataataataattatacttcagttactgattctactaattgtattcctagtgttaaatcatcaggaacttataaagaatttatcggaatttgtacatcaaaacataactctggtgaaatttttcaaataggagacacaattaaacaagacatatcgattaatcaagatacaattgattttgcaactcacggagattattattttaaagttactgattcatcaaaatataatattggcgatacagtgctttatgattaaactatattagatgacgaaacaccattaacggcaaaaataaataatatgattattggaaaagtcaccgctattatatctgattctctgttagctgtattcggctcttagagcctcaaggcattttatgccatttcggcaataatatcgcgaattctttttaatgattcattcacataaattaacacttcatttatttttttatgttgttctgcaataatatttttattctttttacttcttttattcttcggttcgttaatttctaaatattgtttacaaatttctaatggtgatttttctattaaatcattttctacaataaatatagtcattaaatgaatatataattcatttaaatgaatttttgcagtttctatttcttcgtcaatattttcatttattttctttatatcaaaaaatctttccattttatataaaataaaaaaataaaaaaaaataaaaattaactttaaaaaaataatgctaatttataaaaaatttatttttttaatttctataaaaatgttaatgaaaaattcttgttctgctcttgtttcggaaaatcaaacgtctgctttatgcttaactaaattaaataatataaagattgaaaataaaattaatgattcagtaaatgattattcaaatactattaaagaatataaaaataaaatcttaaatcatcaacttccctgtgagaaaggaatttaatgagtttaatattgaaatgtatgatgttgataaagttattgaagcttcaatgaatttttcggctgaagtttataatttcaacgctaagtatcattcactgaaatgtgataaatgtgaaaaattgatgaaagaatatgaatattcattagaagatatagaagatagaagaaaagaagcggaagaaagattacaagatgaaattaaaaggattcaagaagaagttgatgaaatagaagataaagagaatattaatgattttgttaaagagtattttccaaataaagatagaattcctgttatgtcaatcgttaaaatgtggaaagcagttaaaaagcgtatgattcggaaagatgagattaaaggaatgcttgaggaaacaggaaattggaaaataacaaacgttcataatacactttatgctacaaaaataaaagaataaagattcgggaacaaagtttaatgaaaaaaattaaacttagttttaaaaaaaattatttttttatttttgataaaatgccaaaaaaattagacaaaaaagaagttagaaatttatttgaaaaatacggttacactttaccgaaaaattttgtttatagaaatacttcaactccacttcatcttactgaagcaatcttactgatctaaacaatcttaatgatctaaaaaatcttaatttaaacaatcttactgatctaaacaatcttactgatctaaacaatcttactgatctaaacaatcttaatgatctaaaaaatcttaatctaaacaatcttactgatctaacaatcttactgaagcaatcttactgatctaaacaatcttactgatctaaacaatattaatttaaacaatcttactgatctaaacaattctactgaagcaatcttactgatctaaacaatcttactgaaataatcttactgatctaaacaatcttgctgaagcaatcttactgatctaaacaatcttactgaagcaatcttactgatctaaacaatcttgctgaagcaatcttactgaagcaatcttactgaagcaatcttactgatctaaacaatcttactgaagcaatcttactgatctaaacaatcttgctgaagcaatcttactgatctaaacaatcttaatttaaacaatcttactgatctaacaatcttactgaagcaatcttactgatctaaacaatcttactgaaataatcttactgatctaaacaatcttactgaagcaatcttactgatctaaacaatcttgctgaagcaatcttactgatctaaacaatcttaatttaaacaatcttaatgatctaaaaaatcttaatttaaacaatcttactgatctaaacaatcttactgatctaaacaatcttaatgatctaaaaaatcttaatctaaacaatcttactgatctaacaatcttactgaagcaatcttactgatctaaacaatcttactgatctaaacaatcttacttatctaacaatcttactgaagcaatcttatcgatctaaacaatcttactgaaataatcttactgatctaaacaatcttactgatctaaacaattctactgaagcaatcttactgatctaaacaatcttactgatctaaacaatcttactgatctaaacaatcttactgaagcaatcttactgatctaaacaatcttactgaagcaatcttactgatctaaacaatcttactgaagcaatcttactgatctaaacaatcttactgaagcaatcttactgatctaaacaatcttgctgaagcaatcttactgaagcaatcttactgaagcaatcttactgatctaaacaatcttactgaaataatcttactgatctaaacaatcttgctgaagcaatcttactgatctaaacaatcttaatttaaacaatcttactgatctaacaatcttactgaagcaatcttactgatctaaacaatcttactgaaataatcttactgatctaaacaatcttactgaaataatcttactgatctaaacaatcttacttatctaacaatcttactgaagcaatcttactgatctaaacaatcttaatctaaacaatcttactgatctaacaatcttactgaagcaatcttactgatctaacaatcttattgatctaaacaatcttactgaagcaatcttaatgatctaacaatcttactgatctaaacaatcttactgatctaaacaatcttactgatctaaacaatcttaatttaaacaatcttactgatctaaacaatcttaatttaaacaatcttactgatctaaacaatcttactgaagcaatcttactgatctaaacaatcttactgatctaaacaatcttactgatctaaacaatcttactgaaataatcttactgatctaaacaatcttactgatctaaacaatcttactgatctaaacaatcttactgaagcaatcttactgatctaaacaatcttactgaagcaatcttactgatctaaacaatcttgctgaagcaatcttactgatctaaacaatcttaatttaaacaatcttattgatctaacaatcttactgaagcaatcttactgatctaaacaatcttaatttaaacaatcttactgatctaacaatcttactgaagcaatcttactgatctaaacaatcttaatttaaacaatcttactgatctaacaatcttactgatctaaacaatcttactgatctaaacaatcttactgatctaacaatcttactgaagcaatcttactgatctaacaatcttacttatctaaacaatcttaatttaaacgatcttactgatctaaacaatcttacttatctaaacaatcttactgaagcaatcttactgatctaaacaatcttactgatctaacaatcttactgaaataatcttactgatttaaacaatcttactgatctaaacaacgttactgaagcaatcttactgatctaaacaatcttactgatctaaacaatattaatttaaacaatcttactgatctaaacaattctactgaagcaatcttactgatctaaacaatcttactgaaataatcttactgatctaaacaatcttgctgaagcaatcttactgatctaaacaattctactgaagcaatcttactgatctaaacaattctactgaagcaatcttactgatctaaacaatcttactgatctaaacaatcttactgatctaaacaatcttactgaagcaatcttactgatctaaacaatcttactgaagcaatcttactgatctaaacaatcttactgaagcaatcttactgatctaaacaatcttactgaagcaattatactgatctaaacaattttactgaagcaatcttaatgatctaaacaattttactgaagcaatcttactgatctaaacaatcttactgaagcaatcttactgatctaaacaatcttgctgaagcaatcttactgatctaaacaatcttactgaagcaattatactgatctaaacaattttactgaagcaatcttaatgatctaaacaattttactgaagcaatcttactgatctaaacaatcttactgaagcaatcttactgatctaaacaatcttactgatctaacaatcttactgaaataatcttactgatctaaacaatcttactgatctaaacaacgttactgaagcaatcttactgatctaaacaatattaatttaaacaatcttactgatctaaacaatcttactgatctaaacaattctactgaagcaatcttactgatctaaacaatcttactgaagcaatcttactgatctaaacaatcttactgaagcaattatactgatctaaacaattttactgaagcaatcttactgatctaaacaattctactgaagcaatcttactgatctaaacaatcttactgaagcaatcttactgatctaaacaatcttactgaagcaatcttactgatctaaacaattttactgaagcaatcttaatgatctaaacaattttactgaagcaatcttactgatctaaacaatcttactgaagcaatcttacttatctaaacaatcttactgaagcaatcttactgatctaaacaatcttactgatctaacaatcttactgaaataatcttactgatctaaacaatcttactgatctaaacaacgttactgaagcaatcttactgatctaaacaatattaatttaaacaatcttactgatctaaacaatcttactgatctaaacaattctactgaagcaatcttactgatctaaacaatcttactgaaataatcttactgatctaaacaatcttgctgaagcaatcttactgatctaaacaattctactgaagcaatcttactgatctaaacaattctactgaagcaatcttactgatctaaacaatcttactgatctaaacaatcttactgatctaaacaatcttactgaagcaatcttactgatctaaacaatcttactgaagcaatcttaatgatctaaacaatcttactgaagcaatcttactgatctaaacaatcttactgaagcaattatactgatctaaacaattttactgaagcaatcttaatgatctaaacaattttactgaagcaatcttactgatctaaacaatcttactgaagcaatcttactgatctaaacaatcttgctgaagcaatcttactgatctaaacaatcttactgatctaagcaatcttactgatctaaacaatcttaatctaagcaatcttactgatctaaacaatcttactgaagcaatcttactgatctaaacaatcttactgaagcaatcttaatgatctaaacaatcttactgaaataatcttactgatctaaacaatcttactgaaataatcttactgatctaaacaatcttactgaaataatcttactgatctaaacaatcttactgatctaaacaatcttactgatctaagcaatcttactgatctaaacaatcttgctgatctaaacaatcttaatttaaacaatcttactgatctaaacaatcttgctgaagcaatcttactgatctaaacaatcttactgatctaaacaatcttactgatctaaacaatcttactgatctaaacaatcttactgatctaaacaatcttactgatctaaacaatcttactgatctaaacaatcttactgatctaaacaatcttgctgaagcaatcttactgatctaaacaatcttactgaagcaatcttactgatctaaacaatcttactgaagcaatcttactgatctaaacaatcttaatttaaacaatcttactgatctaacaatcttactgatctaaacaatcttaatttaaacaatcttactgatctaaacaatcttactgatctaacaatcttactgaagcaatcttactgatctaaacaatcttactgaagcaatcttactgatctaaacaatcttactgaagcaatcttactgatctaaacaatcttactgaagcaatcttactgatctaaacaatcttactgaagcaatcttactgatctaaacaatcttaatgatctaaaaaatcttaatctaaacaatcttactgatctaacaatcttactgaagcaatcttactgatctaaacaatcttactgatctaacaatcttactgaagcaatcttactgatctaaacaatcttactgaagcaatcttactgatctaaacaatcttaatgatctaaaaaatcttaatctaaacaatcttactgatctaacaatcttactgaagcaatcttactgatctaaacaatcttactgaaataatcttaatgatctaaacaatcttactgatctaacaatcttactgaagcaatcttactgatctaaacaatcttaatgatccaaataatcttactgaagcaatctatctgaagtaatcttactgatctaaacaatcttaatgatctaaaaaatcttaatctaaacaatcttactgatctaacaatcttactgaagcaatcttactgatctaaacaatcttactgaagcaatcttactgatctaacaatcttactgaagcaatcttactgatctaaacaatcttaatgatccaaataatcttactgaagcaatctatctgaagtaatcttactgatctaaacaatcttaatgatctaaaaagtcttaatctaaacaatcttactgatctaaacaatcttactgatctaaacaatcttactgaagcaatctcactgatctaaacaatcttactgaagcaatcttactgatctaaacaatcttactgaagcaatcttactgatctaaacaatcttgctgaagcaatcttactgatctaaacaatcttactgatctaaacaatcttactgatctaaacaatcttaatctaaacaatcttactgatctaagcaatcttactgatctaaacaatcttaatctaaacaatcttactgatctaaacaatcttgctgaagcaatcttactgatctaaacaatcttactgaagcaatcttactgatctaaacaatcttactgatctaacaatcttactgaagcaatcttactgatctaaacaatcttaatgatccaaataatcttactgaagcaatctatctgaagtaatcttactgatctaaacaatcttaatgatctaaaaagtcttaatctaaacaatcttactgatctaaacaatcttactgatctaaacaatcttactgaagcaatcttactgatctaaacaatcttactgaagcaatcttaatgatctaaacaatcttactgaaataatcttactgatctaaacaatcttactgaaataatcttactgatctaaacaatcttactgaaataatcttactgatctaaacaatcttactgatctaaacaatcttactgatctaaacaatcttaatttaaacaatcttactgatctaacaatcttactgaagcaatcttactgatctaaacaatcttactgaaataatcttactgatctaaacaatcttactgaaataatcttactgatctaaacaatcttacttatctaacaatcttactgaagcaatcttactgatctaaacaatcttaatctaaacaatcttactgatctaacaatcttactgatctaacaatcttactgatctaaacaatcttactgatctaaacaatcttactgatctaaacaatcttactgatctaaacaatcttactgaagcaattatactgatctaaacaatcttactgatctaacaatcttactgaaataatcttactgatctaaacaatcttactgaaataatcttactgatctaaacaatcttactgatctaaacaatcttactgatctaaacaatcttactgatctaacaatcttactgatctaacaatcttactgatctaaacaatcttactgatctaaacaatcttactgaaataatcttactgatctattctttatgatctaaaccatccaataaattctaagattataatgtctatattataattttcatcattcaacaattgttattattttattattattattattattttattcttcttattttttttattataattttattattattaattcaagtagttttaattaaaatttaaagaaatttaatttttgaatttttattgatatactttaaagaagatttaattcaggtggaactatcattcttgggtttaaaaggacatgtcgaagcataatgattttttttatggcagttactacaacaaggtgatctttttcttcgaaagtgctgacaaacattcgcagatggggctgttggttgtgcgcctggggtcactagtacatcccttgccatcgggtttattgttttcttcaatttttgtccattaataaaaaactctttaataaggtttcttgctggttctgaacgttgggcaacatcagcccgatatttaaatttctccattgttgaattatagtcccagatttcttctttgttatcttcaacaatgattttttcatttatttcaggatatgtttcagaaaaattattaaaaaaataaatttctggtatttcattttcataaattatattttcgaattttgaagaattaattaattattcaaaaattatatgaatgcaaggtaaatcatttttgacacagctacagttatttaaattatttattgcatatgaggagatttcttcatttttatctttagatgcaacaattaaatctttacatttttgaattcttttttgaatcttatttacagcatacataccaagttttctaccattgtatatacttacatccaattgattatactttagatttatatgcttctttattaacattcggcattcatttacaaataattctaaaattttttatctagtggttgcatcttgtgatctgtccatttctttagatttccaaattcaccttcagcaccattagttgttaaatgttttcgaagtctcaaatttttcaaataatatggattataatatttaatatcatctaacagattttacaaatgtttagaatcagttctattaatttcgttttcaagttcacttctataatcatcttccgatattcttttatttataaatttccaaaacaaatctagaattttagaattttttcccatttttacttttatattacgcgaaatgtgtgaataacaaaatattacattcgaatcgggatatattttcttaattgcagaaatttggctttgtaatcgatcaacaatgaaaattcgaatattacatattaacatatttagtgattgtaaaatatcactaaaacttttttgttctttattaataattattccaactgcaagtatttgtattttattattttcatcaaaaactaaaaatggaatgaagaaataattaaaataattcgtacatgccgtatcatctagtaatacaatatcatttgcgaatggacaacttttaattatccaatttataattaacaaactcttaaatttattatcttcatcatctttccgaattacattaaaatcttcattttttaaagcttgagtataatcaaataatttttgaattcgattttcaaattgattattttttgaatttctaattatgttatataattgatcgggtaaaatatcaggcgcattaaagcgacgtattaatgatgaaggcattccaatacttgtttctgttttcattttttgaattgtttcgaatgttaataatgtaaatttacttccaacaaataatttatcaattctgtgattatgattaacttcaataaaggtaattgaatatatcacatgattttggaagttgattttaaagcatgaagagcattcaccaaggcgtttggtgtgaaatctgcaaacgaatttaatatattgaaagtttgaatctttcttatttaaatttgaatgaatgcatgaatatggacaattgtttctgatggattcatctgaaaccaattgtttaagattgtaaaaatcatttagatttttcccgattaaactatttaaaaaatgaataaactcttctggtgttgaattttgaactttttcgaaattttttttatttgaaaaacctgcactttagagttcaaattctaacctttcttccaaagaaaaatttgagtaataatcatttctgttttgaatattttcttgtataatatcatcatcactattttcactttcatttttcatttcaggtttaacttttacaaaagcttgtattaagttgtgaaaaagagagcattgtgatagttgatgctggctcatattgaaataaataataataaacgtatgagattttcaataacctgaattgaatagcataataaaataatatattttagaataattaaacttattatattatgtttaataatctttattgaatatcaatatatatatatatatatatatatatatattagtgtttcttataatttattgaaatatataataatgtattaatatatttataataatacaataacaaacataaatatatgtaaatatatgatagtatatatgctaataaattattatataaatgttaatacattattgtatatatgtagatatattattgcatacattatgttaatggattatgataataatgtattaatatatttataataaaataacaaacataaatatatgtaaatatataataatgtaataataaatatataataaagtattaatcaatatactattatatatatatatatatatataatattaataaatatatggtattgatgctcgttttttaatggccaaagttcaagccacagaagtattcaattaattacgttatttctttcaaactaacccatttttgggtatatatatcttaattacgtattagttaaaatcaaaagtctaagtatgatcttaaaatctagtgttaaaggaagaaatattgtctcaaacattacatttcgacaaggtactaaaacattattaattcaagatttaaacatgttataaaatgcattgtttatatcatggttcaaatcctaaatattatgatgaatttattttagatttaccatatccaataaaaaaagatatatttatagattttaaattatatcatttagagagtaaatcacaatctacacaatctgaatcaagttcaattgaacatattggtgcaggatcaatatcaattttacaagatggtagaatattagcaaatggagaacataaagttaatattattgatagtaagaattggtattataaagcagtattatttatagatgttaaagtaatttcatcgaattattcaccaaatgctacaacaaatgaaatgatgttaggtaattgtgaacatactgatcaagtaaattatttttcagttgccatatatttaaatcctttattcgataaaatacttaaagatatttcagaatataaaaaaaattcatttttagctttattaattattattaatcaattaccatttaataaaaaagatttaagatatcaaggtaaagtttgtagattatcacaataatattattcaaccttgatttattagatttttatgttcaacattgtgctttacatcatttagatcttaataaattctttcaattttatgtaactttttggaatgattatataaaacaaccagcttctgatgatagaattgattttcaatctgttttttttattagatttattacttaaatgtaaattaggaaaatcatttgtttataatgattcttataaagttttaaaaaaatcattacaaaatgcaataatttattttagatatgatgattctgataaagtttgtcaatgttttataaagatctttgtgaattttgtgatcgtggaattattttacaattaatttcgaatcatattctcatatttgaaattagaaggaataaatatttatttttgatcaataatgttttattgatttcttaaattgttttttgacttcaaaaactttttaattttatgtattcctttagaaaatgatgatattaattcttgtgctttttgtaagtttattttacctatttttgaagaaactctgcctacttatgaacaaacttataaattttttgctttattatattggaatgtaagaatttgtctttgtttatatttccttttataattattttatttttattatctagatatgatttatctaaattaaattatgaaattattcaaacttgtagtttattacccttgtttctctccaattcgctgctgtattcaattttcttgacacataaattgaataaaaaaccgttttcatccatatttcgtgcaagcattttccttttgctgattacaaatgtctggatttgtacgggttaatggacctctgtatttaaccgcgttgccctcatgtcatttttttaagaatcatttctttcaaattattcatatatttgtttttaacctaaaaaaggtcaagagacaaattttaagccaatgatgacttttagatacaacataagggaacataaagccactcaacaaaaaaaaatgaaattcgcaaaaataaattatttgtttaattatccaattcttcaatatttttaatgatcaacattccctacagtatcatgcaattgttcttcaagttataacaatctttgcctttttgcatgtgataatttgagatttcactaaatcataatttgggattacactctgagcattttcattcatatagcttcctcatttcttttgtagtcgaaagacaaacaggaataatgaattttttattcatcataaatggaccatgattctgtgattgtatgcatttgtaagtgttcccaagctgccagtacacacacacacacagcgctattgaagcttcgcgtgatacgctcgcttcaagccgcgctacataaaataaagcattaacgacgagaggatgattgaaaattaggattaacggtcgagtttaaaataagcatgtgcgaaaaatctaactataacttgtaacgtaacgttacctgtaactttgacattttggaaaaaagaagaagaataaagaacatgagatgcaaaaaccaaggttacgttacgttacaggttataaattaagtctagttttaaagtagtaatttgattttttaatgcaactaaaaagatgtcagaagttacaatcgacataaacgacaaattctgtttaatggacattagaaaaaaataaaaactatgatttaaacggagatgaagcaataaatgatttaaagaaatgttttttagtatgtgattcaacacctgaagtatttatgtttaaagattatgacgcagtgaatgattatgttaaagtaagttatacatcagaaaacgttgcgaaacaaaagctaaagaaaataattattggaagaaggaccgaaggaaacaaaacaaaaaatgtttccgcttgggatttatatttagaaaatacagaaatatttacggtaaaagcattaaaattttattcaaatgaccctcaaattttttcttactttagaggttatgattataaaaagcttgataaagtaaaaacagaaattatacaaccgtttttagatcacgtcagagaagtaatagcaaatggtaatgaagaaatttatagatatattctaatttgggatcgcgagcattcttcaaaaaccaaatttcaaaactggagttgctttagttatattaggaaatcaaggaacaggaaaaaatacattctttacagatgtaatttgcaaattaatggcaagatacgcaaatgaaaatgttacgaatatagaatcagtagtcggtaaatttaatgcaacattagaaaacaaaaaaattactggtttttaaatgaactacaaagtattgatactaataaatttttaaattccgatgcattaaaatctattataacagataaaacaataaatataaatcaaaagaatgaaccgatgagagaaacagaaaacgttgcgaattttataatggtatcgaataatgatgttccaataaagattgaaagttatgatagaagatatgttgtaacaaaaacaaatgataagcatttacaagatttcaaatattttgcaaatttagcgaaaacattcacgcctgaattttatgaaaatttatttacattctttatgttaatggacgtgtcgataaagctaaaataaaaaaatgaaataaaaattatttttgattttgaatttcaccgacaaataaatcttcatcctgtatgccttgaacagaaatagttatatacattggattcagtaaatgtacttcgtgaaggtttgcgtcaacgagtgtcaactgtatatgtgacaaatcattagaatttatgtcaatttcaaaatcagcgtttgatacaataatcggaaaatttgccgaaaaagagttattgattctaagaacgatttttgaaatgttaatggtttcgtttaaatttctataagaactttttccaacattcgacaaaagatataatactggagttgataaagtatttccgactgattcagcgaatatttcaaatgtatctgtaccattaaatgttgatggtataggaagaatttgtgagtataatcctgatatttgaattatattatatgaagcattatttattgtaaaggcatttgaagaagtaaatacaattcttccggcttcgtcgacttcagacgtaacgcctgattcttgaattaaagaattcaacagtaatataaacgtttgagagtttaagtcagtgtaatcattattgaaatagtattttttaccgttaatctgtataaaatcatctttctcaataacaacaatagaacatttagtcgttaacgatgttacaatcatttttgcttgacgtgttggcggtgacggtaagtttacgtcaattctattgtaatgttcagcgtcgtaggaagaaattgtataatcaattactgcattatacattttatatattgtaaaaatttatgaaaaacatatataaaaaattcaagggttaaaaaatcacaaaaagttaacctttcagtaactcgagcaaacatgcaatattcatgtcaaatcattcgaaaaatgctcattttctccgtttcgttgagggttaaaaaaagggttaaaaaaaaaattagagttaaccctcaaaattttaatggtactttttaacatacttttttaacattttatatgtaaaatgttttttattggtgtttggatgtgtgttattggaaccatttacgttttaaattcaatcgtaaatacaatgataaaaatatatgttgtatttaacgaagaggaaggagataaaaaagaaatccctgaagatattaaaaggtcactttactcttaaagtacaacagtttttctgtaattataaagaaatactaattgaataataaacctgcaatatttcggataaatattattttttaccgtttgttgtaaatctaatgttaaatgttgagccatcagttggcgcgttatataatacagtaggttttttttttttttcacctttgatgccaatgaatcgtctcttcgaatcactaaatgaagcatgaaattctaaatactctctgttccaaacattattaaaagtcattacttccttttgagttgacaaataacttatactttctgacgttacatcttgatttaagaatttcaaaaaactttctaaattagatgtagtacttcctgaatcaacaatcgcaaattttgcgacaagattttggctttcatccgagcctacataagtacaagcaaatataaattgcctgagtcttcgtattcataagataatctataactcgcaaatgaattattaaaactattacaaattgacgttaaaatttcaaataaagtattttgcgccataacttgaattttaatgatacgtggattaggtgaagaaccactgacgctttcaggtttagttacttcaaactgtaatgagaaaaacgtgagcggtcggcgttatatctaatcttcttatgccaatagctttattctgtgacggagactctaaccaacgttgaggataacggaaagtataaccattttgaggatttaatacttcatacttatctaaatcaagatttgtataattttcttcaatcggtaactgagacgcagttgttgtaaattgattttcagttttatacatttttatcttattaaaaatgtcaaataaaaagaaagaaaaaattgaaaatatagtaagagcattaatgaataaaaacagtgttgtatacagtaatcattcaaaaacatctgatacattatcaaatggtatatgtacattacagataaatagttatgacaaatcatttgttttcacttacggaagaaatcatgttgtaatatcaccgttagataatagtataaaaaatttaaagtatatcaataataatattaaagttgatgatatacttactggagaaaatataatgaaaaatgcatatataattgaaatgttcggtaatataaataaagtattggatttatataaacaattcgtaaaaatcaatgaagatagtaataatgtttcaattacaaatttaattattgataccattaatggttattcaacagatgattttgcattaaaaaatcatacacatgaaataattaataatgatttagctattaatggaagtttagttgcaaattccattaacggatattatatttcaaacagtattggaggaggttctaattcaacagtaaatattccatcaatcgcgactattaaatcagatggagtcatggaagtcggtgagtatattgattttcattatagagatgattataataaagataatacgtggagaattagagcaataaccgatacattaagttttcaagcaaaaggtggaagtacaattagttttaataataacggtaatataacagtaaatagtattaatggtatttctacaaatgatatatcactaacgacgcataatcacgacgacaaatactctccgttaaatcatattcatagtgattatctaactaatgctaacttagaaagtattaatcataaattaacaggaatatattataatgaagaaacaattactaatgaagaagaagaagaagatattactgaaaaaatatactttaataaatcaagatcttatagttaatggtacgattaatgatattaacacagaagaaatagctttagttcgagacggaattttatctaccggagacgttatatcatttgaaaacggagtcagtatatcaacttatgataatactactgatgaaggaattactgaaaataatttattaataaatttttcctaatggtaatagtatcatgttagaggatagcggacatacttatggtataattaataatgatggagaattaaaaacagaatactatttaacaaaacaaatgatcattgatgatgaagacatacaagaaattttaatgggaccgccagggagaagacggtgaatccacatataaagaaagttttgttgatagtatatttgatataatagatacattttttacagctgctgatacagcatatactatagctcaaattgtaagtcaaataaaaaattttgggtgggcaggatttttatatattagtttcggtattgatgttatgaactcaaaaagttatttaccgttattatcattgaaatcagtgatttttgatgaatatgatatatcgacaggtgaaatgttggaagatttagaagttccaaacgctgaagatatagaccaagaatttaatgaatataattatttaataaatctattttctgaaatgaatattatatttaaaaatttgaagtattattataaagacgtctctaaaggtcaaagaacaaatgaattaggtcttttattagtcgattgtcagatatataaacgtttcgttaatcataaacatgataattatttaatagctgctgatttaaataattatacaggaataacttatcataaagatttattagaaactaatgaagaggaggaagaaatatatgaaatctacacgtcaattaatcaagatttaaaggttaatggatcgctgatctccgatagctttagctgtcgcggtaatgttgaatgtacaacaattaatggtattgatttagatgaattatctgttatcagtaatgatatatttaatattaacaataaattaacaggtattacttttaataaagattatgtcgaaacaaatgaagaagaagatatttatgaaatttacacgtcaattaatcaagatttaaaaataaatggtaatatagaatgtacaactattaatggtattgatactaataacttttctttaacaaatcatactcacaatcaatatttaactaatgataatttaactgatataaataaggctttaacaggaatatcatataatgaatatggcgattggactaagattaaacatgatttattagtaggtaatgatatttcatgtagaatattgacagcaagtcgtaatattaatattgattgtagtaaatattcagatgatacaaatatttataaaggattgtttattcatagaactaatgcaatgccgggtgattctattagaatggaaataggtgtattgcctaatggagatgattgtagcgtaatagaacattacgtaggttctgatgataatattgatacttgtctaagattcaaagtttgtgatggcaattatgtaagtatatataaaaatggtaatattagttgtaatagtattaatggaattgatactaataatatttcattaacaacacataatcatgatgataaatattctttattaaatcataatcatacagaatttaataatgctattactattaatggtgaacttattgtaaatagtgatatatttattgatggtaatataaattgtatttctattaataatatttctgttgataatttctcattaaaaaatcatactcatgatactattgataatgatttaaatgttaatggtaatttatattgtgaaacaattaatggaaaaatacctgaagaattctcattaaaatatcataatcatgacgaaagatattctttaacaacacataatcatgatgataaatactcttcgttaaatcatactcataatgaatactcattaacaacacataatcatgatgataaatactcttcgttaaatcatacacatgaaattattaataatgatttagctattaatggtagtcttgtcgcaaattccattaacggatattatatttcaaacagtattggaggaggttctaattcaacagtaaatattccatcaatcgcgactattaaatcagatggtgtaatggaagttggtacaatatattgactttcatgataataatgatttaaatagtgattattcttggagaataagaactgccggcaatgttatgtatttcggtaaacttgataataatgatggtgttattagtttcaatggaattgatggtaatataaattgtatttctattaatgatatacctgttaataattttttttttttttttcatactcatagttataatgatattactgataaaccatcaacatttactccatcatctcatactcatcaacctgctgatattgttccttatcaaaattctgtattaaaaacaggaagattttttttttttttttttcataataattcaacagaagcaccaggtatttatacttggcgtatagcatcatatgaaaatgaattaggattttggcatatatcagatgatacatacagaaaagctattatatcaagtagtggtggaggtcagattaataaaactattgtgcataatgcgccgatagacgaaacattaacattaaatgattttgatattggctctcctgtatttataacaggtaacgtatataaattaaataataataattatacttcagttactgattctactaattgtattcctagtgttaaatcatcaggaacttataaagaatttatcggaatttgtacagcaaaacataactctggtgaaattttttttttttttttcacaattaaacaagacatatcgattaatcaagttttatgatgaaactatattagatgacgaaacaccattaacggcaaaaataaataatatgattattggaaaagtcaccgctattatatctgattctctgttagctgtatttcggcaataatatcgcgaattctttttaatgattcattcacataaattaacacttcatttattttttttatgttgttctgcaataatatttttattctttttacttcttttattcttcggttcgttaatttctaaatattgtttacaaatttctaatggtgatttttctattaaatcattttctacaataaatatagtcattaaatgaatatataattcatttaaatgaatttttgcagtttctatttcttcgttaatattttcatttattttctttatatcaaaaaatctttccattttatataaaataaaaaaataaaaaaaataaaaattaactttaaaaaaataatgctaatttataaaaaatttatttttttaatttctataaaaatgttaatgaaaaaattcttgttctgctcttgtttcggaaaatcaaacgtctgctttatgcttaactaaattaaataatataaagattgaaaataaaattaatgattcagtaaatgattattcaaatactattaaagaatataaaaataaaatcttaaatcatcaacttcccgttgaagttaaattagaaagaaatcaacaatatttagaacaaattttagaatttgcaaaatcaattcctgctgtaagtattcctgaattaacacttgatgtttcagtcaaaagttttccaaaaattgaaattgaaaaaagtgattcaacagaaataaaagcgttaattagaaaaattaacagaaaaacacaaaccttttcttgtaatcactcagcactcgaacgtaaagcattaacatataatgctgatgccttaaaattacgtaaaaggtctgaattaaagataattgatgatttttataaattattagctgagtattgctggcgaattaaaaaataaagatttaagaggaaaaggaatttaatgagtttaatattgaaatgtatgatgttgataaagttattgaagcttcaatgaatttttcggctgaagtttataatttcaacgctaagtatcattcactgaaatgtgataaatgtgaaaaattgatgaaagaatatgaatattcattagaagatatagaagatagaagaaaagaagcggaagaaagattacaagatgaaattaaaaggattcaagaagaagtcgatgaaatagaagataaagagaatattaatgattttgttaaagagtattttccaaataaagaaagaattcctgttatgtcaatcgttaaaatgtggaaagcagttaaaaagcgtatgattcggaaagatgagattaaaggaatgcttgaggaaacaggaaattggaaaataacaaacgttcataatacactttatgctacaaaaataaaagaataaagattcgggaacaaagtttaatgaaaaaaattaaacttagttttaaaaaaaattatttttttatttttgataaaatgccaaaaagattgagcaaaaaagaagttagaaatttatttgaaaaatacggatacactttaccgaaaaattttgtttatagaaatacttcaactccacttgaagtttatgacgaacaacatcaaagttatataagattaagtgttaatcagttaagatatagaatatcaagaggaagagcagaatacatcccagaggaaattaataatttaatgaatcttcctttaagtgataatgaatcgaaaaataaagattcatttgaacgttttagtgaaaagaaagatggatttttcaaaaatgaatcagaagattttaaacgtgaagtatttaatttaacaaataaattgacaaaaaatttaatgaaacaaaaagattttacgtttgaaaacaaatcaagtattgatacatttctttctgctttgatgtatgcgattgaaacagcaggacctaaaattaataaagatattaaaaatgactttaattgatgaagacggaagagaacaatatttgcatgcaaacaaaaatacagttgaatttttacgtgctggattaaataatgaaagagtgattggtgatacgaacgatgttgtgtttgaacatatgttatttattaaaaccattcatgccgaatttaaagatttcaaaaaaggaaagagaataaatccaggattctttccttatatcaacacgtcagatattgatttaagaaaatttggaatatttacagacgttaatgattctaatataaatgaatcatgtttaattcaagcatttattgcttcagaagtattgaaagaagatgaaataaaattactgaagagttttattcaaacgcgaactgttccaagaagtgagttaaaaagaatttctgacttattaaaaatcaaaattgaagtcaaaatattttattcagaaactaaaaatacatcaagaaaggtatttggcgaaaattacaacagagaaataaaactaataattattgaagatcactatatgctaaattctaaagttaatgtatcggaatgttatataaaaaattatgataaaataaatgctgattcaagatttaaaaatcataacagaaaaatgatgttattaaaatttgatgataaaagatattcattttctaaaaaatcacttggtataagaagtttaatatactcaatgattgaaaataaacttttaattccaatgaatcaacaaacaataaataagctttcatggagttatagaaaatcaaacgaaaaaacatttaattcttatagaaaaatatttgttactgataaaaaacctctatcgatttattctaaaaaagttaagtcgcagacaagtctgtatgttttgtatgttgatcctcgtttagtgaattatatttgcttctgggcatcgccaagatatgcaatttatgttggaaagataatggattccatcaacgacaaagttcacgaagtattaaatgaaaagcaattaacggatactgttgaaaatgctaaacctgtgtttattgaagttgcaaaatcaatagcaccaacaatcgacagagagttagagaataaaacatgttggggatatagagactcaggcaaaacgttggaccaatgggagcaagaagatttagcgagagatattagagaatacaaagaaattaaaaagagacttgaagaagtagagaaaaaagttgattcgtggagttcatttatcaaaaaatatcatcctgaatttgaaaaatgaatagctttctcgatttcttttgttaggttaggttaggtaggtttgttaggtagcatttatttataagttatttttcctgaacttttcacaaattttgtgcttatttttctttcgcttagaaactcacagacgtcagagtaattatattttaagttataagtattgccgtctttcttgacatatatttttgatacataatctaaagttgagcttttacaacaacccgcgtcggtgtctgccttcactaactcaacttcttgagtatcacacaataattgcacaagctttataagttcatcttcttcagcaattacatatttattaactattaaaggattattttctactatatctaaacataacactaacgcttggattaataaatctttgtcgtgaattatttgctcaagattagttaaagtttcattagctgtttcaatcgaacgttctttaatttccggttcttcagacgtttcttgatatttcattggcactcctttaactacaacattaacgttttgactttggctctgtttcggagaatttaaatttgttccgactcttgcaagaaatcctcgattgcaagataaaacactacttttataaactgacattttttaagtgataaaaaattatttttactgttattaaatggaagaatctctgattccattaaatattttcgattacatcaaacatctaaaacttacaaaaaagataacaacaaaacaattaccgtttatagaaaatatttatttctacattaataattgcgtaatatataaatatgtaattgctgtacgtcctgaaatgtttaaaagagcgaaacgtttcggtttggaatcattatataatgtctattgtggaattaatgttaagatttatgaaccaataccaaatacagcaaaaggaagatttattttgatgtggaatccaggcaattgtgaaattacagttgctgaaggagaggatttaccaaataattttggcgttaaatgttaaaaagtaccttttaattttcaaagatgtttttttaacccttaacgaaacggataaaatgagcatttttcgaatgatttgacatgaatattgcatgtttgctcgagttactgaaaggttaacttttttgtgattttttaaccttcaaaaataaatgatacattaaacaattcaaacattatttttatcttgctcctcctgcaattatctgctcgatactagcgttagtaacttcaatttgacttctaccgtcaggcttcattgctctaactttcaataatgcgtcttcaaagtatattcctgttggtgcaatgtaatcaacattcttcattgcagtattagctaatctatctccgaataattcaatctgaactgttccagtggttgatattccacccatgaagtcctcaccttcagcgaacggtaatcctatgaagaaattagaattatctttaccatgccaagctcttgtttgagtattaacgcctgaagcattatatgtgttcttgtaataatacggttgaacagatgttttaatatcttttgctaatgaactcaaaagacttccattaagattcacagcatcaagtaacatattaagatttcttgggtcatcaacggtttcatatgcttctcttggataaattttaccgtcaatattaaaactatatcttatttgtggattcaagaagcatgtacgtgaatattgactttgtctgaatacagtaaacatagtatcacaatgtttaagtcctattgttgcagcagtattaaatgatgttggagcacttgttgaattacttccgagtggttgtgtgaaatctcttacttgacaaacgtgaattggaaatagcatcggaacttgaatatattttgcagcaagagcattaaacacatccattttcaaaagatatgttgcaagcttaattttaacatcttttgttacttggctattgcaaatgaatttttgcggtgcatccatcgttgcgtaagttgttgaaccgcttcctgctgttgctttaatgttgctctttactgattcattaatatttctaaatccaaggtcacataaataatctccttcaactacagcttttgcagcaactaatgattcatgatcgcatacaggagcaataacaatattttgatatgaaggcatcagttcgattgaaagcttgccgctccagttaggataatatcgcatattaaataacattaagaaataacttaatggaattcttaatggaatcttaactataacttcttttgctgaattaatagcgctaaagtcacagtaaacgccaggaaccattgaatcatgagctctgattttatcaatagttgcgaaacaatcattaccggctttagcttcatcagataatgaattagaaagcatgaaccattcataccttgcgttatgaacgtcttgaattttatctgtgtttgaataaattctgtattgatctatagcatcgcatgaacatttataaccgacataatattctttaaacaaaagatttgattgtgacggaacggtaattggtacttcttgttctaaagtaatatatgaattatctaaaccaataatcttaaatctatccgtgaaaatgtcaacgtatgttgtgtctccctcgtttatgtctccaacattgccgtaagaagtagctgtcgtgtattcataatttcccggaatgatttcagaagctttaactgcttcatcaacttcattataccaatcttgaaggtttccagtcattgcatcaataacatttggttgttgattttgtggtgcaaacattttatagtgataaaaaaatcaaaacatcaattagaatctaagtcttcaacagttactgtatttgttaacggtaacaatcttctattagaaaaagttcttaaatcattataaaattgaagtagtaaatcaggtgctaattgactcttatttgttctagtaaatccagcatatttatgttgattttctgctaaaaattgattaaatctatcatctccaattgaattaatcaaagcatcaatattatattcaagttgtattctttgattattttgatttacaacttgttgtgcaatatctgcttgtaattgatttgttattgctaatttttcttgtcggtgatagattaccgctaaacatttgttgttgtatttcaatttgtgcttgacttttcattgctttttttgtatactcattcgctaactcaacatcttgagctcttctttgattttgtaacgttgctattttcaaatttgtatttttctgtatttgtgctttatgttcggcagaatttaaatattctaattcagcatcaagagctattttattttcttcggttgcttgtaattcctctcttcttttaatttctttttcacgttccttcgtttgaacttttttcttagcgttcttaacaatcgattctttgtgcgtcttgcttatttctggttttggtccaacggctgtttgatatgctcctaattcttgagctttaatttcttcatcaactgtttttcgttgttgctcaatttccgcttctttcaatctttcaaatcttgctcttgctcttaatccaggtcgttgttttttttttttcagcaagttgttgttgatataaaccattaatgctttccatgtattgattatctaacgcctgatattgctccggagttaatgctgttattcttttaattctttcttgttcaaattttattttagcttcatttttgagcttttaatagttcattttcataacgtgctctttctaattcatattgtgtctgtgctcgcatttcatttgcattcttataatcttctgattttaaaactttctgtaaagtttcattttcattctttactttttctaactcacgttgcaagctatttttaattcgcatttgttcattagcttctatttcatgttggcgttcaatagtaagcatttttgcttcagctaattgagcttgaattgttgcgttttgatcttttaataaatcaatgtcgcctttatactgagttttttaagttctgccaaagcttttgcgtaacgttcagtttcttgttgagctttgtttgctaattcatgctgacgttcaatctctctttctgccatttctcgtttttgcttttcttcgttatactttgcctcagcagcttttgttgcttttttcatatttctttcttgttcatccaaatttttctttcttgctaattcatcttgtttctctctccgcgtatcattaatttgttgttgacgaacatcgttttgatttctcatattatgtattgcgtcaagattaatattttgtggagtttgtgataaagcaacaggaagaaatggattttgtaaatttgccatcatctgtgacctagcagaattggaattttgattattcggtgaaggaagaatatttgctctgaccgatgcgttagggttagatattggagcttgagtaattaatcgatgccttaatccgcgtttgacatttttctttgttttttctaattcttcgtttgactgctttctttgccatttaattaaaaataaaaatattaatttataagtattgaactcttgctctccatccgcgttgtaccggcacattataaacttgttcttgacgttctgacgaaacttgagcttctgacgaaactatttcttccttttgctccgaaccttgtgagtttcgagcatctagcgagacttgctcgtcatttaatgtttgttcgaccgaaggaatttcctcagcatcaatataaatatcatccctcaaacgatgatacttcttcttaagctttttatgcttacctgttaatttatctaatcgtgaatttaattcaattatatgctccattaataattgatcgtttgatagataaactttaccgtcgttgttgtttttaattacttttttgactaaccgttggagtttttgatttctttgctgtaactctagcgttaccgttcttgaaaaatttgacgtcaaaaaattcattttcaattccttttttagcattagcaattataatttctttttcttcttgtgttaaatcttttactgctttctttgttatcttaacatcagatgttttttcttcattcacattttcgttttcatcatccaaaacaatttctgtttcgctccgaaggagctcaggctcgtagagccgttcagtctcgttctctgccatttattaaatataaaaaaatcaaaaaatcatttaatgaatcacattaatccaggaatcattactcttggttgaggtttcattaccgcaggttttatccgaaatcttttgacctgtatctaaaacacgttcggctacttctttgcctttatctacggctcgtttaattttgtctttaatcttaccgtcaggaactgcatcaactattttatctattttatctgttatatctcctttacgctttcttactgtatcaattattcctggaatctttttaccaaattcaattcctcgactgattattggcgagaccttactgtaaattctctttcctttatcaataacatttcttacaagtcgtcctgcattttgaataaattttcttattccaccgaatatacgacctaatcccatttaatataattaaaaaaacgttttaataactcttaaatgagtctaaacgttaacaaagaaattgacaaaacacattttaaaacttacagtcacgtcaaaaaacacgtgcaaaataaatttccaaatgttagtgaaaagaaaattaaaaaagtaatatcaaggagattgaaggataaatttattaaaacaaaagatataaaaccttatatgataaaaatattttcaactattccaaattgctggtttcatgatttatacgataacaccaaaggaaagactccaagatattggcacgtatttattggcacaaataatagatacgtttactgtttaccgttgatgtcaaaatcagcgtctgctgttaatgaaacattaaaacaattcattgaaaaattccatcctgtaaaattaacgtcagatgaagaaccagcatttattgaaaaaaataatttaaaacttctttctaaaaataaagttgccgttcatacaatatcagataaaaaccattcgtctttaggcattattgatagattcatgcgaacaataagagatatgaatactccaacggaaaaatctaaacatcaatcacatgatgaaaaatacacatttattactccagaaagaatgaaaaagtttctgaatacttacaacaatacttaccattcagccatcggttgttctccaaaagaaatgtttgataataaagatttagaaaaagaatatatatttaaatgtttagaatcttctgaaaaacaaaaatgtattaagaatttaattcttcctgttggctcttttgtacgctatatattaccgcgtcataatggcataactaagaaaagatttcaaatcagccgtgaatgttataaaattgatgaacggaaaggaaacatatacgttttaattgctcaagacggaacagtaattactaaaccaagatacaaacgaataccgattgataagaataaaccaaataatattaaatgggcgtcaactattcctggtaaatgggttggttctgttgagtcaattttgtcatttaatcctaaaacaaataagtataaagtactttttaccgttcctgggcaacgttcatatcaagatgaaattcctgcttcatttctccgcggtaatactcctcataaacagtcagaaattgaaagagaattttttgctaaacataaatgatattaatatttatttttatacatgacaaactaactaactaactaacctaacaaaaaaaattcgagaaagacttttcagaaacagtcatatctgaggcatcatcatttttgattgtgtcaaatcagctgaaaattacaagtttgaagcagtaaatgcaacattcaacatagaaataagccttttccgttagcttatagtcattaactcccgtaaacttgcaaaattcacgtcaaatcatcaagttagaattcaatttcaaaaatatatagacttttacgaaaaggctttctcgaattttttttgttaggttagttagttagtttgtcatgagctattcaaaaattaatatattcatatcttacaataaaatgtgattcggacatgaatttatttttatattcttattacgataattcattaaacacattacgaaattaattaatttttgtcattttccttttgtgttaaatcattcaaaaaatgctcattttctccgtttcgttgagggttaacttttaggttagaattaaccctcaaaattttaaacatacttttttgataaaaataaacatattcataaagcatcatcatcaacttcatcatcaactatttgttcttctaatttcttatgatatttttcaaacctatcatgaacttctggcaataaattatatactttagatacttttccatcaatcctttttgcagaagcatttccagtgaattttttcatatttgcaataaaagtccttgaactgcaactgttgaatttatttttttcaacaaaatcacaatataaattaaataaatcaggacctgttatgtttttttttttttcgtaattgtctctagcgaatatttcataacttgacattgaagcttcttttatattttcttttgcttcactgttcggaattcttcttaaatttactttcgacacatccattaacataaagaatgtaaataaattttcataaaattcaggcgtgaatattttcgctaaatttgcaaaatatttgaaatcttgtaaatgcttatcacttgtttttgttacaacatatcttctatcataactttcaatctttattggaacatcattatttgataccattataaaattagcaacattttctgtttctctcatcggttcatttttttgaattatatttattgttttatctgttataatagattttaatgcatcagaatttaaaaatttatttgtatcaatactttgtagttcatttaaaaccagtaattttttgttttttaatgttgcattaaatttaccgactactgattctatattcgtaacattttcatttgcgtatcttgccattaatttgcaaattacatctgtaaagaatgtattttttcctgttccttgatttcctaatataactaaagcaactccagttttgaaatttggtttttgaagaatgctcgcgacccaaattaaaatatatctataaatttcttcattaccatttgctattacttctctgacgtgatctaaaaatggttgtataatttctgtttttactttatcaagctttttataatcataacctctaaagtaagaaaaaatttgaggatcatttgaataaaattttaatgcttttaccgtaaatatttctgtattttctaaatataaatcccaagcggaaacgttttttgttttatttccttcggtccttcttccaataattattttctttagcttttgtttcgcaacgttttctgatgtataacttactttaacataatcattcactgcgtcataatctttaaacataaatacttcaggtgttgaatcacatactaaaaaacatttttttaaatcatttattgcttcatctccgtttaaattatagtttttattttttctaatgtccattaaacagaatttgtcgtttatgtcgattgtaacttctgacatctttttagttgcattaaaaaatcaaattactactttaaaactagacttaatttataacctgtaacgtaacgtaaccttgatttttgtatctcatgttctttattcttcttcttttttccaaaatgtcaaagttacaggtaacgttacgttacaagttatagttagatttttcgcacatgcttattttaaactcgaccgttaatcctaattttcaatcatcctctatcgttaatgctttcttttatgtagcgcggcttgaagcgagcgtatcacgcgaagcttcaatagcgctgtgtgtgtgtgtgttaagatttctattggattaaggtcgggcgagtttggaggccatcctggcgcaattagaacatcattgcataaccaattaattgtgtgagttgtattatggaatggagccccatcttgcataaaaaaccatttaaaacgtccgtatttcagatcacatgttggtatcagttgacttcttttcaagattttgatgtactcatatgaatcgacgttttatccttgcccagctgttatctggactcttttcagaacgagattcatcagaaaagatgatattctcgaactgggattttttgtcaaaataaaagctttgtctgcggacaacagttgagaacgatatctttgttgaaaacttttcgtttagagatgatgttatatctccatcagttagtctggcatttgcatatggttgagttacgatgtaatcaatcatttaccaagttaaagctgatggacgaccaatattatgattcatttggaatttttttttaactttagatattttttcggagcaaacatataagaaatcttgtatttcttcataagtaaaatgagaagcaagcattctagatataaattcatctttctgcttctgaaattaagtactgttcattctacaattttgacatttttcggatttaaatgagtttattgttcttctgagttctgatttccagtttatatggtggaaggggaattgaattaattttttttatcggtcaaaaattgagttactttcgatccattatatgaattttaaaattccgacatttttttttgtcgcataaatattcgattttgcgaaaatgccactttttaattggaaaaaatgacgtgttcaaaatggtaacgcttgtaaaacatacaaaatgccaataattcagaagtttattttttcatttttcttgttttgaattcaagccctcctactcccaccaaaatatctgaacttcttcaggcagctaaaaagaaacttaatatggaggatgccatgacaaagttagaacacgagttccgactaaatcaatttgataagcttacaaatgaaaatatgggaaaaattttaactcaaaaagtatactatgttttaatttattatttatatcaatctatttttactcaatccccatttccacatactgtcaaaacattaatcgaaaaagaaaccaaacttttccaaaacaatttaaacaaccaacaatacgactatacccaagaaagtcctaatatcaaagcacatgaaatttttggaaatgatgcagatgatttcaaacctggttctttagaattctttagcatattgcaacaacaagaagaccttaccatgatagacatatacacctttatgttctggccaacctatagtcattattttatggcaggttttgctcaaattgattttttaaatcaaattttctattcagggcgttttaacaatatccaacgaatgttatattcacgcgcagcctttttttcaccattatttatacgttatatatattcatcattttgtcctattctatctccaattttaccacaaatcaaataccaaaactttgataaccaaattggtgaaattcaagagaaaattctcgcaaattgtcgatcacattctaatctctttcctcaatatattcttgacattttagttgttgaagccactcaagaacaaggtagcaatgtcattttcctccgtaatgtatttattaactatgctttacacccttcgtatcacaacatatcctttttgcaaattttagggtttatcgaatcgcatcaaactcctaacgaacaattctatgaattccttcacaaattatttacaaacaaatttttgcgtgaattaatcaaaatattttcagagagttacaacgaatcagaaatcaaatatattgaagggaaaaaccgcgaaaatctgccgtcaatgttccaaccgtcaattttgactaactacgacatcatttcactgcaaaacaatcggaaaccgtttgaacccccaaatgaacttacttttcatacaatttcctggtggacaaaactacacacatgggtcgatagcgatactgatttaaggaagtcgcaatcagcagtgttcaaacaacggattcgagaatttttgatcgaaactgattttatccccagatgtaattatggaacgtcattagatgattatatgaatgaattggttgacaaaggaccaattaataaaatcgaaagtcgtaaagtagaagcaaacttcatcaaagaacaattacaacaaaaatcagaaaacgaaatcaagaaattattagatgatattatcattgatgacaaagaagacttaatgaaactgagtgcatttacacccatgatcttccaacttcaagatttagatgaacaagtcaaaccaataatccaacgaatgttttatatcgcaaaagatttcttattgcggtcaactatcgaaaagtatttcatgaacaaaaggaaattggaacttaaagatgtcataaataatcccaatttgttaaaacaagaattaactgatttaatgagttatgttaaacatgaaaatgacattgttaaagagaaagtcattactgaagaatcaattacagacacatgttattcttatcttacttcctcatttaattataacgaattcattgaatttaaaccagaattaaaagaagaggattcaatggtctacgaaaaactgtcaacatctgaaaatgaaattatggaaaaactcgaaaatttattaccagataaaaagtatctggaaagggcgaagaagttacttaaagaaaagaatatattcagcggaatgaaagacgcttttggaataaatgatatatatagtttcggaaaacaattaaatgtcgcaataggaatggcaaggttccaattcacaaagggattctcggctatggatgttggacctgatcaacttatgccgttctttgttacgttctattcattgtttcatccaaaagattttgcatcaagattcgaattcttgaaaatgttttacattggcttcttccctaatgagacaacaacgttcacatgctaccaatcagcgttgaagaatgggggactggatattcaaatttgaataaatctataaaccgttatatgaacgtttatttggctgcttaacacaacataatcaattcaattattcaatagctatgttatgttaccaattttttctgtgcataccgatgaaaacgacacttttgggaaatgattctcttttggataatattagtttgattatcatcatgcccgctaaaccgcccgaccaattattaaaagtttttcgaattctatgatgttattatgtgtaatatgatccatgttttcataaccatcgttcttacccacaacggaaccgcccacgaaatttgaattgaaaaaagatatcacttttttgatggagaaagtataccatcaaaatgcatacaaatttgattgaagtaaaatgacatttgattaatcaaaaagtaaaagttgatttgtgaatttgtgtttcgggctggatgaattgctgtattctgtgtttacatgttaaaaaaaaattaaaaaaaaaacatagtcttggcattgaaaaaaattaaaacaaagaatatatatattttagataaagatgaatccaattcattataagacaaaaatacgattcatattcttaactcaaataacttagaatacttatcactcgtttcaatttttttcaatttgattttgagtgtttcattttgacttggaatttcttgaatagggaaaatacgctttggttgtgttgatgccatttctaaaagagtgaccggatttggtcgatgaaacgttgttgcagctcttactctagtcattgtgctttcttgttcttgtaatttctttttaagttttcttgttttattttcttgagttacactttcaggtgacggtagccttctttttaattgggatcttttttggtttcttggtgaatctctgattttcttattcacagaatttacattgttaatataatcggaattaacattattaatattttcaccagcatgatcaacgaattttgttagatgcctagtttctgttttaaagatattatttctcatcatttttaaaaaaaatgatctttaacgtacaaaaatttatttaaatagtttacatctcacgaaaaagttttcagttttgatttttgttttcccacaaagtctttaatcctttatcatgcacaaacaatatttccgctattttcgatatctgttctttaatttcagttatttcttcttttaaattttgtatttctgattcaattgaatcatctttaattaattgtactcttggttgtataacaggcaaacgcgactctattgattgtattcttttagtcaatgccattattggcgttgattgcggttcttcttcgaatggaataaattgcgctttttcccattttatttggttatctccgcacgaatgaagaagtagttttcgtaagtcgctttcggaaacatcaataagaacatttacaagttcatcgttatcgatttctatgtcatctacatcatcacatctgattccatcaaatacttcaagagatggacaaagatgttttgcaaactcggcaactttgatgtcttcgtttttctcttgcaaactcgtgttcaagactcgtaattgttggaaaactgtaatgaatctaagattaaccaacgtgtcaaataaattggaacttacatcaatttcttcaatatcctttgggattttgtcttcaaaaaaatcgagattcgagatctcgttttgcgatatgttaagttcaataagactttgtggtaaaggaactgtaatatcagatattttgttgtgagaagcatttagtgtttcaagattaatgagagattcaacaaagtctaaattagtaattttattgtggctacaatcaagtttacaaagtgtttcaactttgcgaagtggagtgagatcactaatacgattatttgacagattgagatagcgaaggtatgtaaaaggagtcatatcatgaagtgttttaataagattgtttgaggcttcaatttgaattaaaagatttggtttggaaattggtggaagctcggaaatttttctatttgagcagtcaaatgtgtcttgacgtatgctgtttccagaacttcgtattgatgaatttgagtgcttgtgattgcttagctccatccagcaatcgatatgtaaagcattcaaaattcaaagatttgtcagataattggcggtttaatatcaatcaggatgaaacattttaaatgattgtttttattgcaggaaattattctaagagtctaattagaccacaatcgaaacatagattttgtttttgatgtgatcctatataaatataagaaacaaaaaataattccaagtttaaatgaatcattttgtccatattttttattgtgattgatactaaataagttattaataaacctatgtaaaagaattgaataattatgaaagatttcatgaggtttcacatgattcaattagtcatattttttatcgttcaaaactgtaagtgaccaaaaaaaaaaaacgttatccttcagaaaaccgtctggtggtatttgaacgataggaaagtggcagtaaattgtgataattatattcaaaaatttaccggtaaatttctcaaccttgtttacattctaaatgtcttctgtgacacctcacccaagcatatatcgcgtttcttgctatggctgcggtcaaatgtatgttaggcgttcagagaatgataaatgcccattttgcggccgttcgaccatcaagtattatgaatgcaaatgcgctaactgtggtcacactgtaactgtcaactcatttgatgacgcctgcaaatattgtgctgcaaaaggaaagtggactcaaggatcttacgatggaaaagtcttcagatatgtaatcgtaaagcaagcgccacagccaagaactgaaacaacatatgttacaaagtatgtaacagaggaaccaaaacctgttcgtacaacaacaacaaaaacaacatatgttacaacatctcgtcctacaacaacaactaccacaacatatgttaccactaaaccaactacaacaactaagacaactactaccacaacatatgtcaccactaaacctggatcaacaactactaccacaaccacaacttcaaagaactcaggctcaaaggtttcagtcaagttcgacatggggcaaaggaaagaaggaccagaaccggattgtcttatcgcgtaaaaacacagcaaacccatttttttaacgttttgaggcgaaccttttgagggaattgaattgaaattttcaaatttcaaaggtttggatttgtttcgattgaaatataatcaattatttggtaaagaataatattatatcatttcgaatagaatttaggtgtttgaatatggaaggagtatacagatgcccccgacacgggttccttggatactcgggatcagttccaaccgcattatatactgtaaatttagcaaacatattcaagaaaatatttttgaatgtgtattaactatgtcaaacgttaaaatgcttctgaaataaagagatagcaggtttgaatttcatgttatttataaaatatgtatcattgaaggatatgtaaataaaattattataatgatttggaaaaattttattattttgataaaaactttttctttgtatctacctgtttttgtcaaaattattttattattttattaatttcaaaagtatgctaataatttttactatcttcgttccaagtgtatgcacgattatcatcagatttcatatgagaaattttaatcccaaaaagttacttgttcttcaaattctttaaatgttttataattataattgctcatatgcaaagacaaaacaagagatgcatgaaatgattccaataaataagaaatatcattttaaaacatcaaattataataatatattttaaataaagcaaactatcatttctgttaggtgcaacattaacgccttttgcttttagaattaattttactatttctttataattttttgattttgctttattcaacgctgattggaatgattataaaaatttttcaggacttattttgaaatattaaatcatgaaaacaaattatatataaaacaaatcaatatcattccttcttgttcaagaagtattttaacaatttccacattgcctttgatagctgcaataaaaagtgctgtatcaaatattttaagagttttccaaatattatttttaaatatcggatattaaaaaaaatttcgaataaaaataaatatttttagctttaaaatcaataccttctactcaagaagcaatttaacaatattgatatgatttttttttcaattcaatcataagtgatgttctaaatattttgaataatctctaaatggaatttagaaatactaaatgatgaaaacaaactctaaaaatgttaaataaatgtttttagcattaacatcaattccttcttgttcgaaaagtaatttagctatttctaggttacctttttgcagattcgtttaatataaaagtattaaatttatttccttccttttctaagaatgataaaatctcataaccacatttaatacttaaagttatcaaagaattaaagtttcttctaatttcactttctatttgattttcataaatatatttcaagacatcattttgatgaaattcgattgctatttcatatgtatcttcgaatttcgaatgattttgttcacataaatgaatgatttcttcatttccacctgcaattgcatatttgcttctattatctacgtttgcaccattcataagtaaatatttaaaacatttaactgatccaaaaaatgctgaataatcaattaatgaaacattttcttcaataataaatgaatgtctttcataaagtgatggttcaattgtttgattcaaatcatatttgtattgtgatgatatttcttgaagcttatctatttcatcatttcgaataattatttttgatctttcgtttggataaacttaatctttaattaattgcttatgaagttcccaatcattctttaaaggttgatcataattttatgaaatatttataaaacataattttacttccttttaattgttcaattgtttctgtatcaaaataatgagaaaaataaaatgattttttatttttaattaaatttggtgatattaagtttgattcaatcattttatcgaaaaaaaaaaaaaattagattctttaggttttatttgaatgtttgctaagaattttataaaaatttcaattgtattctttgggatgataaaaatgaatagtaaacaaaattactaatgaataaattaaacgagtatgagaaaaaaggattaaataatttcattacacgattaactgcatcattaccaaaattttcaccagttaaattaaaaaaatattcttcaagttcaaaaactgatttcatacaagattacagagaccacatcacatatcgacaaaagtttattaacaaaaaaagccaccgacggtaatcgaacctgcaacactaaatatgggctgccccattttttgtacgtttgtaataagcgagatttataaaatgagcgaattaattcttaaagcatggtccatggctcaatttgatgacatagaaggactaaaagaattagtgccaagtcaggttaacccaaatgcgtcaactcattctgaagaaaatcatgttcattctttattgatgtgtgctgcagcacatggttccatagaatgtacaaaatttctaataaaaagtggtgctaatgttgaacaaaaaaactttatgggttttactgcattacattggacggcttttacaggacgaattgaatgcgtcgatattttattgaacagtggagcagacatcaatgccaaaacagaagacgggaaaacggtaatgcatattgctgcatctcgtggtcatatttcttatattgaatacattcttgaaagaggtgctgatttagatgctgttaatagtgctggatggaccgcaattttccttgcagttgttgccaatcagaaagctactgccaaatatcttcttgaaaaaggcattgaatatgattattttgatgcaaatctcaaaaaattgaccaacattgccacaaaatacaacagaaactggttattcggcctccttgataacaagtccgaacataaattcgaaacagatcaaattgactcaaaaatcttgatttcgaatcaagaatctaattcagaacaactcaatcctatgccctcacctaagcaacctaaagtaaggaagacgattaaaataattaaagatgctaatgaagatattgtaaatgattcatcatcagaaacgtcagaatcagaagagaaccttgaatacacatcaccaaagaaaccaatcaggaaaccatccaagaaacccaagcaataaagcaacagtaatttgatttatttactcgtatttaccaaaaagattctgtgcgctttcctttatgacctccaagtattgtcttgcacacgacgacttaacagttatcctaacgttggcctgagtttcgacgatttcaccaacgaagatgatgtcagacgatagcgcgaacgatacatacaaagaattaccatttttacccttgacgtaaacctttctttcgaataacgtttcttttgatgcaatttgtaaaccgttcaaatcgaaagtaattgagttgtaaaattgactgaagtaattattgaaatcatccacgccgatatcaccgtcatttgtcaaagcaatttcaattggtaaccgacaaatggcgaatatgttttcgatgttagttcttaatgctaattcaaactttgtcttgtcgaaattaccggctttggatttgtctacctctatttcagtttcaatttcgacactttcgccaaattcgagtttttcaggtaatgagatttgatctttgaggacaatgccaagtaagttattattaattgcaatcgcaaagttcgataatgtattgtgtgacttgttaacaatctttaggttcatttgatccacatagaaatcaataaacatcgagatgagagtatcatcagaaacttttaagggcgtccaattctttaacctttctttagacttgtcatattcatctatgtccggaatgtatttagcgcgatggacaaattcagttggtaaaatgtgtaatacgcctgcaacatttccagtgttttcgataagttccgtaagaacttcctcttcaaacttcggtttgatgtcttggttcatatttttctcaaatattataatttgttttgcaacttcattatctgatgacaataaccgccaatataataaagcgcgattacggacatcagggatagacgtctctttggtggcttcgtttaggacaaattgaagttgatctttggtttcttcaggtttaatgagatatatcttcgcaagtgatgtaagcatctgaagttggacaagtggttccgagtcatgaaagctatcaaggaatgggtcaataagaagatcaacgttttcgattatatttgaatattcaccaagcaaccaaattgctgaagcttttgcttctggaagacttatcttatcaagtgaagaacaaatagttgacagaactgactcaaaactaccaggatgtctacgaagaatatcgcagaaaactatgatcgattcttcgattgcataactagccttactagtgatacaagagcacaaaatatcaacacaacgtgatgtagcaacaggtagtttgatagctatttggcctatgcatcgaattgttttgcgaacgaacgatacatcaacggagttaacgtactcagtgaattcatccaaaaccgcctgagcggttatcggttggacggttgtgacgatgatgtcaagtttttgcatcttaataaaagacggatcattatacttgcagaagaaaaagcgaatgtgacgtgagagtgcctttggatacttaagaacaaagagagacatcgctcgaagaactacatattgaatctctgggtctgctgacgaaattaaagataaaaatgatggtaaaatttgttcaaatattgaaacgggatcgcgtttgtcatgatccatatagaggaaaatacagcgaaatgctccaatgataacagatggattactacttttgagatatggtataagacgctcgattaaagaattggcaatttcgctgctttcagggatataacgagatagacaatcgaatagaacagtttgacaccattcattggaactggaaattgagtgtattaaaggttcaattgatttggaatcaaatgtaaaaattggtgttgtgcgcctttcgttgatttcatatatagctgcagctgtgttagaaacaactaatggattgtcatcgttaagatgtgaaattaaagctttaaataattcagaattttcaactgtctctggaatgatgtcatataacttaacaacgccaagaacagctgtcttcctgacgtatgggtctggatcttcgagtgattgctttaatggagaaaccatatattctgcaacactttcaactcgtattcggcacatactacggacagcaagtgccctaacaagtgggttgggatcctgagcgtcaagaataaaggtgttaacagtcaaaattgattgttcaggttcgaagagtgaataatgaacaaggtataaataaattaatcttttgagttccatgtcagatgttttgacacattgaagaattgatgaaaagaaaacttgtacattttctcctgctcgcataagattaattacttttttgatggcaatttttctttcttctggcgacccagaatcaatgtagtttctgagtgttcttacgtcgtttggcatatcgcgtacaaagaattggttaattttggaaagcgcttcgtgcattttgttccttttgggcgacgatcaaatgacactttttgataataatgtgttataattttcatcgacattacatcattaagcatatttctgaaaataaatatgaatatttgcattaggatataaaatatgagatagtaccatttgaatatagataatccaatattttaaatagaaacattttcttcaaaatggatatcaatagggagtgaacacaatgaaatatatttttgctagcgtgtaatttcattcttctatcataatttattttaacaacacatttttatttttccggaaaagaaacatttcagatgcatgaaattatcttataaaatttacataatactcatacacatagaacttattcttcattgctgtttttccaaatttttttttaatgttattgattatatatttttatcaaaagaattacacaaaaagcattatttttaacttatttttgtgcattcaaatcaaaatgatacattacatatttttttatattcgtatcaattgacgtaataaagtttgtatctccataagttattacatgaacattgagcaaattgattcttaccaagttgagaccgtttaaaacccggtgtaccccaattttttcgaacatataacgtattctggcggttttgtgctttattggagaaatgtgaataaaccattgagttggaacagttaacaaatgaaaaacaagagaagcacctacaaaatctagtattaattcaaaaaatttggtttaacatttgcatttgactagtaagcaatatttttttcaaatatatacttcatacaaatttttgttcattaacaagatttaaaaactaacatatttaaatttttattatcaaattaaatcataacgattaaatcgcttaaaaaaattaaatgactctttattaaggaatgggacgaaccagatataaatccactttttaaactaaaatatcataggaacgaataatttatatgctttctttgcttataaggtgtgtaatggttttttgtttttaactttcattttcttttataatttgaatatattaatgcaattcttctaatctaacacttagaataagaactaatatcataaaatcatattatataaaattttatttaacaaagataaataattgttatagtataatatctcctaaaagtgtgtaaattttggaggtaattctttaattgtaataatagttattattaaaagcatttgaaaatttttccttatctccatctttgttttcgttttaataatttaaagaacatctttaagatatttttggtaaacactttctgattttgctgattcaattttgtgtcaacaagagataaaagctatttataattggtataaagttcttttgatgatctaagattccgtatttcagtatatatcatagaactctttatcttcttttgatgaaattttgatatcttctttctataaattcgattttattaatgaaatattataatgaatacagttatgtataaaaagtggtaacggcaaaaaaatatggtaacgacggttattccgttaaatgtgaaaattaaatgaaaaaacaaaaatttctcaaaatatatgtaataatttctttgttaaccaacttaaaaatattttatattatattttttatattaatttagatttttgaatcatttttttttatcacattatttgttaaattaaaaataaaaaaattaattaattgatgatttatttttcaccatcgattgttttccgaaatttttcagaaaaaaattgtttgtttatccatccccatctttgtgcaatttatctacaagacatggattcttctgagtagttataattacagatttctttaaattcatcataattttcaactttttgacgatttaattttaaataatccacaccatttttcatatgatattcaaatccagtatgcttaaatgaagcatggatatatgttgaacatgtgcttaattcataagttctaaacatcatatatatatgctgaagttttggatgaatatcatcattatttggaatatattttttgtaattttttaaaataccaaaaagtaaacgatctaaaacttgaaataaatgagaagtatgagggggataagtaataactaaaatcataagtttcgctaatttttctaataatttttcatcaagatgacataatcaattatcaaaaaagagaatcgccggtttttctgaacaatcaggtccatttcgatcagatttaatatgcggaacatatttttgtagaaataaagccagtaaatatttcttttgtaacataagatgatgcttcaacccttatacttagatcaacatcccttcttattggtatattaaatatttcttcttaatttggatcagatgtatttattagatagaaataagcatcgccaccaccatttattgtgacaacaagggttaaatgtcttattctcctatttactggataatgaagacttctattttcatattcctttgggactacaaccattttcggttttctatcttcccaatctgataaacccacctcatcgatattatagattaattctgcgagggtaatttctataactttttcgatgaggtcaaggtactctatcaagtacttacgcggaacttttaaccttgtgtcttcttgtggttgaataatggttaaactaatttcagtagaatgacgatcaaaaaaactatctaaccagcccctcgttagacgtacattatatttttcttctacaaatcaaagtacctccgaaagggtcatgtattcataagaatttcttcttgataaaatttcttgaataacaattttctcctcttcttcggataaacttaacggtctcccaatttcttttctttttttgttcgctttgcatagaattttccgaacattcccttcggtaatattaaagatctttgccattagtttagcattcgctgtaataaaacaatttgtttttaagaattgacgaataaaaagtaattgttcatttcgagaagaactagttataaaaccatcatttcttgtaattgcccgaacatcaattgggcgaatgattgtcccaatgcatctctcacaaaattcttcttttgataaaggaggagctttcggcggcatgaaaaaaattaaaaataaataaaaaaaaaatttaaacgtacacctatcggcgttaccatgttttataccgttaccactttttatacatgactgtaagagaatctaattattcatcttaacccatcttttgaaacaatagttttacaatattttcaatctttatattactgctttcaattgttttcattttatgattaacaaaaagcaatatttatatctaaaccatgaaatttctttttctttggatataaactagttccctcaatatcttaacaatatccaaaatgcaattgaaaacatatgtcccaaattataaacgatgtatagacatccaattgtgctcttctttcctctaatgtggtgtttaaacacttcgtttcttgtggttatttcagcgaagtttttgtgcatttgcatttgaactaaaatttttgatctcaccgaaagtaccaattctttaaaatataaaaatatttttaaatgatcaaactacaaacaatttttatttatatcatccaatagttcgcggattgccttgaaacgggttatgtctgcgttctgttgttgcatttctttgtggcccagggttgtattggaatctttggaaattattttctgcataatttacgccgggcggagttatgtcttcgtcttctccatcattgtcagacataaatggaatcaatttcttcagggaaaaactttggaaacctcttcgatttccattctttttgatgaagcgaatgtatatatatgatagaatcgttccaaataatgtcgaaacaaattcatcaaaagtggtaaaaatggaaaaaattaaagaaatgattagtattgtaaatggaaacattcgaatatagattgggccacacatggaaggtattcgcactgggaaaagttggtgagcaagagtcattgatattgcagattgacacgctgatcctgtaagaattggtcgatttaataattcagaatttttggtaatcaaatagataattaaaacaaaaattacaattaaaatatttgtataaaatccggtcataataaatactcgtaaaaattcttttgagcctgtgattggctcaattatttttccaagcattaatatcaaaattccatctataactccttttaaaagcgtatcataataaaacattccagtgaataatatccaaagcttcggaaaaggaaaactaaaagattgaataactaaacaaaaatatggtctaaaatttggaagataacctagaaaagatatgattcccattgctatgcaaatgccaattgataaatttgtaactttcggaggaaggagggtgtttggctgcataaattttttgaataaaattctcttttaattttttgaggcacaaaatgccacttaaagttcttctattaaaaacgcacaacaaaattaataaaacatattctaaataattaaaatgaatagctttagcattaacatcaattccttttttctcaaaattttctaactgctatataaagtgctgtttaaaattaaaacatatttcaaattgttctgggggcaaatgttgaaccatcctatgctaatggggggaggttgtgtggtctggattagacagatatcaaagatctagaaatatattataggctttataaacaagattattgttttgatgaatctgattggaaacaaatttctacatataaaaaaggtgaaaaagtaatagtattaaatatttatccaagtcatataacgggcagactgttataaacagaggtatttttcatataaagtatatttaaagtttgctaatgtcacctacacttaaagtttggatggaaggaggaacaattatagaagacggaagagaaaataattttactgcatatggagtggatcacgaaactggtggtcaacaaacatatttagatataatgtcaaacaatgactttgggcaaaatgtagcaatagatccaaattttatatataattatgatgttatattctttggaatatgggaatgatgttctgaatattcactcaaaacaagaacagcctccaaaaatattcgtgagtatattgaaagaggttatggatttatagctggacatgatattatatatattttttcatctcgaaatcatagtgaagcaacaagtttacttgctatcagagatctatttggaataaattctcgttatgttgatgatgatatacaaattaatgggataacagttcatcctaattattcatctatctcttctgataagatatccatgcagccaaaaggtttattaacgagatatccatttgagattggcgatactggaacagagtcaaatatttaagaaacgcatacgttttattattcttattcaaatgaaataactccttaagataataatactaaattgataattattataactgtttgtattgtagttttaattattataataattttgtttgctttgttgttaaaaagaattcaaaaatataaaactaatgataaagaaacaaaaagcagtgaagaaagtgatcaagaaaacaaatatatctgcaacaggattttatatttctcatattgatgaagatccatttgcagaagattttaaagaaaaagaattcatatacaaatataatataatgaatttatataagcacataaagaaaaagttgtctcgtaatagaaacattttagcatgttagtaaattcaatttgtaaatattcctaatatgttaaacaaaacttaattttgattttcattttaatatctccgagcacagaagtataaaaactattttttttatttattgttgcttaattaatttttgttttcatttcatggcaaaaaatatatacttactaaagtggttgcgaaaaggtttcccaacgatagaatcaaatgaatgaaaaatcatcggattcatattcaaaaactgaagtgtttgggaaaccttcccattttaattgcttggaaatgatttacttctaaagattattatttaatctatgaccttaaactattcactgttttcagatggaatatcataaaaacattcataaaattttatgaatatcggagaaaaaaaaaaccaaaaaataaaaatgtttgcgcataatttttagttatcatgttttgtaagaattatcatcactgtttctgtgatgaagggaatcaaaactttcatcatctgttaaattgcttttggtggctttatacaatttgtacatcaaaaaaagtaatgcaaaatcgccaacaacacaatcaaattcaattccgttgtcatcagactgaccataaggttcttcttctgtttgcaacatggactcgactgggtctgagatcgaaggcatttactttgtgaactgagttcaactgataatttcaaaaagtagaatgaatttatctgaaacaaaaacttgtttcaaactatcaaaataatgtcacacactctaaattataattttattttctaagtatgaaaaaccaataaattagtcgcatttattttaaaaatacattttgttaattcaactatttcactatatattttagttttattaatgaaggcctgttcggttgttcaattttcaacattcaaatttgagataatatttcaccaagaataaaaagtgaactcacctttctatcaacattcactcaaatttaaattgaaggagaataaagtattgatcaatgtcaaatgataactgtttctttgatatttgaatgtttttataaatctaaaatataacggttagtttagtacgatgattttttttgtttggaaatttcataacaaacggtttatttacgatgactctcaaatatcttttttctttttatggcatcatgatgcagtatctaaaattattgtttataattttatatttttatgaaattttatattgatcaatactattttttctttatttaagatattttttggttagcttatatttcgtttatatgattaaaaaacactcaaatcattaacctctgatactcgagtttgatatgtatttcactcgtatcattaatacccaaaacaaaccttataattttagtataattaatgcttcgataggaataattcaatacgaaacttcagaagaaggaattttttaattacaaccaattggttttgattacaaatgcattttaagaagattaattaaataacatattagaatttactttaatcaatttttagtttctgttatttaaagtcaatacgatatctaaataacgattacaaataatattacttttaagctgacaatttcagtgacatcattataaatcatataaaacatgcaccaaacccaacttttacccatttcattgtactaaatgcgttttagcaaaggatagaaatctatttcaagtttcatttaacaaatttttttgacaatgctgcaatgatacagattctttttttattgtgaaatttaaaaaaaaaaaaattaagataagaaattttgttttatcgagatctgaaaaaagatatcaaaaagtgtgtgtgcgacaaagcttcaaaggtatcacaagcgaagcataaccgccattttcaaagtgaactctcactttcaaaccggttttcattgaaaaagtgttcgtttctatgtcgggcaaaacaaaaacgcgaacccactcgaggacaaaaggtatctcaactccatacggagggtcacattcaatgatttgcatcctgcaaacttcatttgaaaatgtttgtggatttgatcgatcgagagaaattatttcatctcgtgcataagaaacagtacaacttgttacaggactctctgattcaacaaaaactatgcttccacgaggaggatgtgttgatgaagcaactggagtcggaagatgaattttcgctgtaaattttacttttggtgtattgtgacggatatttgtttcgttcataacaatatctactggctctccttttggtatattttccgttttgtagacaataaagaagggtttttgaacaattaaatcttgtgaaaaaacacctcttttgataacaatttcaacaaagtaatcaacactaatatattcaccacggatgctttcggtaaggcctttacctttaggtattgtaaattgaaaagaaaaattatatccattttctattgcttttggaaaatcatgtttaattggtattgtcaaaatagtgttatcattattgtgttggatttgcgtgtcgaaagaatagttatgtttgttaatatcaacagttcgaacacaataaacattaaataaaatttcttttggttttataacttcatttgttcgaaatgttcctgtacaattgataggctcgtctgggagataagtcaatgcaagtcgatcgaatttgaaggagacaactgatggcatatgcaactacttaaaaccgttgcacgatggttatggcggtttaattgaatataaaacgatagctataaggcaaaaacagaagaattaagtcaagaaatgactttaacttgtatgcatgttttacatactaaaaaagtcaattcaaacacagtgtcttaaaaatacaaaggtagttagtataatttttattttagcaatgctgaattcagtccactgttgtgaaaggaatgtaaaatcattcaattctttctttatcaaataaaacaaccaatgccatgtttagtttagagttatataagttggtgttttcatgttcaaatacagtcttaataaataaattaataaacaagttttgtctgacgctctttttcttgattaccatatcaaaaataaacggtcaaacaaaagtgctaatcaaaatttgacacttttatataataaatgagccttgatacagcaacaattaactcaatcgtagaagcacaacttgcagcatccaaaggtcaagaaaaaattacccttgtgattactggccatcaagatgatgctgctgaaaaagcaacatttttcaatatccaagcaaagaaatacgatacatcaggtgctgttgttaaaacagctgaagggaggttcagatactcacaacttttcgattttaatgaacgacttatttttttctatggaaacattcgaatgctccgtgtattccctccaaagaaatgggttggtaacaaagcgttagattttgttactcaaaggcaagaagctcttcagaaatggttaaatgaattagttgaagatgaagaaacatgtgcagatccaattattttgaagtttttcaatttaattgaataaacaagaataactgcatttaaaagcaatgttataattcataaaataataacattatttgtatttattgtcattttaaatccttaattcaacaacattcaaattgcggcggttaattgattatgtcttcagaaaatttcgcggttattattcaaaaccaaaaaatcgaaatgcacaaaaacgtaaaaaactttatacttgcacaaattctaacttaatcatagtttttcttgctgtcacttgttttgcaggggtggtgtggtctattgttaattgtgctatttggtatagtgattcagaaggattagttttccatgattatgaagataatgatgatgatgatgatgatcacgatgatgatacaagtttggattcatatttattccctttactgactttttcatcacttgaatttttatttggaatttcaacattatttattcgttttaaatgtaagtcaaagtgcgcaactaaagtattcttttggcttaccgtcattgctgctatggtgtcatttattttacaaattgtatccattggtaatgttcctataaagattgcatcaaacattacatcaaacgaaaagacaagaatacgatcacactatcaatggctgtcttaaaccacgttcaagggctgggcttttggtgccattcttcttcataacacatttgttatttatcatttcatttgcaatggttttactcaagaaaagaaccattcgcctctaaatcaaacgccactaaaccaagaacaaaccgcatatatgaatgaagaaaagaatcaatacattaggtatactgctggtgcaatgccacaaaactattacaacccatattactaaatatatgtataaaaaaatatttcatctttttcatcaaacattattttaaacctattcattgatttcaattaaaggtaatgattaattaattaatatcatatttagtgattaaactttaattttctaggaaactgtttctatcaacattaagcacaaatttattttctagtattcattaaagataagttttaaatgataaaaataaacaaaaatctcatttacaatttattgtataactccacaataggcaggggatagtgtcaatttaatacaactaatgaaatatcaaaaattaaagaaataaaaattaattacaatttattctgtatcatccttaggacgtttttttggggattttggagctgaaataagagatatagtggaaaggaaatcagcatcggtgaaaatggatgctcttgctgatgcaatagaagaaggcggatggcgtgaaagctcgagcatctttttggaagctttacggagagttttcatccactcttcatctctgtcctgagggaggttctgatattttttgcggaaccaaagctccatatcttgagccattacgtatatcaaagtgccttcgttattatatatcatggcattttcccatacttggttaacatcttctgcccagttttcatatgatttgtattcgttattatttaatttcttacgaattgttgtgagatccattggtctttgaacaatagtaagataatctggagcaccatcacgaatagggtcaactttgtctttgaatggccgacataggtccattctcagcattttgtttgtgagttctatgcatttctgtttcttgaaatcattcatatatatggggcatcccaaaaacgtttaaactgaaatgaatttgtcacttttagtttatttcttctttaatgaacttgttaaagaaataataaaaacaagaagatacttttgtgtggtatgcaaaagaattttttgcttcaaaatatattttttttgaaattcaagttcattgttttcatttctttcatataaggcataaattatagatcaatcatttattttaagcaaataatgtttaatcatattgttaacaattatataatacatttcataggatttaattttagaaaataatattaaagattttttgtaaacagacttcaaatacgaaatccgcatgagaatttaaatcttgaatgaggaccaacgaagtttccaacattattcataagatcaatgcgcaatacattttgataataattatattttaaaaacataaatttaaacaaattaaaaaatagaaacattttataactacaatttcaattccgatatttcctcctttatacaatacattttccctattacattattagggatttctgcgatcacgtccgccagtgtcatattcaatctttctttaatttcatttacgaccaaaaatttttcattttcgttgtttaaatatttcgatattttctgtgatatttccgtctgatacaatttcctaaagcagaaaattgtaccttcgaccgccgattcgatttgttttgttccataactaccacgagcctttagatttagaatcgggttcaacaaaaactgtgtcacacatgttgataaagattgaagtttaattgaaattttactttttatatcatttaaaacattaatttttatattcgacgagaaaatgtttttccattttgaagtaattttatatccaataatttcataatcgaattcctttaataagttatataaatttatataataattcagtaaatatgaatcatgttcaatttcgttttcgatttcatttgacgtgttttcgatctctgtaagttcattacttataagttgaaatgaacaatcgttaaatagttcattcggtaatgatatataaagtaatggaagataatatataacttttcgttgttgtgaaatttgtttagattgaatgttaactataaatgttaagcgctcttgaataaatagtaataatgtttggacttttttatggactttatcagaacaaaatggaattcgataaatgttttgttcaattcgattacttttaagctcaagtgacaattgacataattgatcaatgtcattaatctgatacaattgcgaagataatgtcgaagaatatatcgaaaatatctctaaaataagtgactcaaaacatttctcatattctttaattgtcccataattaaaaaaatctttcgataatttatactcatcttcaattaaattaaaaatgattaaaatagaaataatgttttcatttttcataatagtcttcgttataattgtaacccgtgcttctttataagttaataacaaattattaaaatttggaaatttctcaaataaaagaaaaagacgtttaattgagggtgcgatagatgtaaacttttgaaatgagtctttgccgttttcactggtgaatatgacacgtttaaatgtgtttgaaatataaattttggctttttcggcagctttagataaaagagcttcatattttaagcgatgtaactgtgcttctttcaataatgtgttttgtttaaaaaactcaattccatctgatatctttgaaataacttgtgggaaatctggaagaaggactgagaactgactacttttcaggtccaaagatattttatcaagttcgtcataataaattaaaattttgtcaattgcattaacaaatgttgcgagtctttgttcttcagtaatttgtgactggcaagcaccattcattagctcagcgtttgaagctatttcaattctctttttttcagctgaatgaattaattcctcacaattttttatgctatcgataagaagatgcgactcatcgagcattagttccgctgcagttttagggataattttcgtattctgattctccttctgaagaatatcataaaaatttgaattatctgtcggtttattacgcggagccgcttccgatcgcgttggaactgtcaaaaattcggccatcgcgcgccacttcggaggaatgtcggaaactacaaatttcccattttcccccattcctatggcgtcacttttgttacaatattcgaccacaaacctcaaaatatgaaatatttcgctctttcacaaataacaaatacaaagtgttcgttagcgtaaatttcttttttcttattgtcatttaccaaatatgatataaacaatagcaaattcatcctcaaaatggttgcttcaaatagaatcgtgttacccagttgatcgattctggtgatacccaagtggtggcaatcggtagaaagtaatgaatatcccaattcataatccatgaaaaaacatgtctaacaaatggcttcacgttcagaaacgcttctttcttcccatcgtcaggtagtgcatcatctggcacgtgtggtaattcgtccaaatttgtaccttccataaataaaagtgacgctttggagcacccccaaaatttccaattcataaatttcattgaaatccaaatttaatatcaattatattactataatattattaacatcgttctctgtaatgtatatgtctgtaaattataaatttttaaaaaatcaaataatttgaatttttgtaatttttttttttcaaaattatttttctttttttctgaattaataaatacgtaaacatattctaaaatatgaaaatgtgaattgcgtgttccaatatttgatttttttgattttttcacttttcaattgaaatagaatccataaaaaacgttatctggatggggtgctcatcctccagagacacacgtgtcactccccaaaagacgatcagactgtctgaggcaccaagcacttccagcagaggtgagaagaagtacaacccgaagaaaatcatcaaagaatttcataagcattttgtcaagatcacctccgagatccaagcaatcaaatgcccagaggagatgcaccctccgctgtgcattggggaggatgcatatccgatattactgtcgccaatatatttagaaagtaatgagcccgtcaatattctgatgccgattgtttccatatcatatattaacaatgttcgcattatgtgtatttcgcagatacaatttttatcacttttatatttcgatagttgtgatacatttaagttcatatcaagttgtttggtatggctttcaagaggaaatcgaatcattggatcgccaattctcttttatcgatttccagagaagtattcccaagatgcaaagaaatcattttatcgatctggtatcaaaatattaatagtcaatactccagaaatcgatttctcgccgtaccaaataattttcataccgagtaacatcgaattagattcagaagaaagaatcaaattaaaatcattcattaattctggcggtggactcttttgtttttattgtccagtcgaattatttccaacagttgacgtatcgccgacagctattaatgactttttaattgattatggattatcattttcatgttgtaaattggcaccaaatccaactcggaaaacagcggaatttatatatggaccagaccgacttattcgacatcatcttttatatcatgttaaatacttttgtgacatgatggaaagtcttcaacttgatgaaggttgtttagatgatacaattacagcattaaggtattatatcattgtatgtgataatcgacatttggatttgttcattcagattcttgataaaagttggtcatttttaaacgctacgaatttcgttaatgagaatggtattggtgaacatataacacaaagtcttgtaatagttttaatgtgtgaagtattacgtttaataccaccacaatttctaactaagaatccactttcgaagacatttccaggtgaaacacttagagcttattgtaccaattataaattggacattaaaattagagatgaaagttggatttcaacaggactttggttaccagcaggtcaaacggcaattataaaatgtttaaatcctccattaggtttacatgttcaaattggttctcataatatgtcattattatcgaaacaaggtccttggaatcgttggcctgaaatagtaaatgtatatattatagacaaagaacaaattactgtcggatcttcttttggaggaattgtttatgtttatttctcgtttagtgaaacagaatgtcgatcaggacttatggatgaaactgatcaaaggattttaattgaattcgaaggattttcacaatatcctcgttatgtatatgataaaccagaagtatttatgaaaactaaagaattcgaaattccttgggctgaaattactaccaaaacatttatcattactttacctacgaaaatgcttatgttaagttcccaaaaagtattaaatgaactttgtaataaacttgacgaatatgtaataactgttactaattatatggaatataaaattggtagaaaatttcgattagtttttgattgcgaagattcaaataattattcttatggttatccaataatattacatttaacaaatatcgatgatataattctaaagatttctcaaccttcacttggaatttttaacttaattagagctgttgctgttttgtctttacgtgaaggttactttgatcctgaaacagaagtaggaattggtacattaattgctgcaatgttcttcaagaagatgtggccggactttgatatgttttcaattcctggaataaaaattccccaaatgtttgaaccattatcaataatacaaacaaaagttagtcaatcattaattacttctataattagaagctcacaaaaagctttatttccttattatgaactaccagaggatatgtgggtaagatttgtaagggaactttgtaataatgctaaaatgaatttgaccccaatgttaaggagatatagaccaattcctataagcgtagtaaattctttgtcgaacttaccacagatgcaaccaattttgtttgcgtaaatgttatttgaagtttatattttcatttttaaaaatgtcgtttttcattagcttcttccattttggttgcgcgatcaatttttcttcttcgttttgtgatgagtttcctaagttttgataaacttttctctaatttatcaattcgattgatgttttcttgtgacatttcatcaattttattaatggaatcttcaaatgtttcggtttgactacttaagagatcattgaaatgttgaacaactctttcttgtgattctttaaagatatcttcttctgttttaattgcaccaataaaacctggtggttctgccatgattctaggatttcgattacagattcgagttggatatgttgtaagatcttttggaaatcttatgtcattatccataaaaacactggtaatatccatcccagaatcatttcctttttcattgtttggaaatgttgttgcatcatttgaagttgacatatgaaaattatttaaaacatcaaaaatttgatgcgatgcacttttttaagttttaaaattaaaaaaatataaaaataagtaaaaatgatagaatttatattttagataatatttatttctatttaatttagatcaaaatcaccataaagataggaattgtcgatgtcccaaattgtattttctgtttctgcaaaattaaacaaatagtccgaattatctgaagatgtattagcaacaagttcgttctgaacctgtggtacatttcccatttctggaaattcaaatgtttctggaatttttgtggatacagttttaattgctcgttctttggttttgtatactttctttggatctaattctcgtacactccattttttgagttcgatcggataattttttatagcaggatatttttcaattaatgtattaacgaaatttgtatttcctaaactactgttatatcccattttttggaatgaaccattgatagagcttttgcacttaagtattaaaatgcttagttgacgtgtattaagtaatatagcattgtcaagccaaaatataccacagttcatacatctcttccaatcatttccatcacctcttattgcataacttttaatcttttcaagagattgttggaatgtactgattctctgatttctttgattcttagcttgcatagaaaaggaagacttcaacatgtaatactgatatttgctttcattgtccaaaagttggaaataatttgggatcgcattaagttgactattcatcttcaaagtttgattgctgacctgttcatttagcggtttttaactttttatattgcattgtaatcaacctgtttcctctcaaataagtggtttatactcagaaaactgtaggaccactcgtcatttcaaaaagctgatttttgaaatgctgtcaaagccgttttacaaaataatcatcaaggcttaaaatatgaatatcttttttttgaatcaatgaaaaatgaaaataaattatagataaataaacaaggaaataaagtatttaatactatattcaaaaatttatattatacgtaaaaatgatgataatttttaataataatataaactaaacatacttcaacatttttgttggcttgcactaagcaaaaagaaagtttttgtggttgaaagaaaaaaaatttgttctggaacggtttgtttgaattttgcatgcaattttcggttatcatcagattgcaattagatgtaaaaaacttgcaaaagcaaaaccaaaacaagttttattcgaacagcggcgtatttacgtaaacaaaaaaatcaaaacatataaagattattatttatttatttttagtttgatctattcaacgataaaaaacattttctaatatcattttttgtatacatttttaaaacgatttatttttgttcttgagaaatcttttgttaattctctttctaatttcggatcttttactaattcatttctaacaacttctttaatctgtgcaatctgttcttcgtttatattataatttgccaattcttgtttatccattacataaacataagcataagccttcagtaatggttcgtaagcatctccgaaattatctttagataacttaagtttcaacaacgacgaaataatatttgatgtaacattggtttccttagggaaaggaattgattcgataatactaatcaaagcattcacattaaatttattggatattgttacagcagaacaataaagattcattgctgatactaatgaatcagtaaccattggttcttcttcatctgaatcacttttaatgattattggttcaataagttcaatgatttttatggaatttatatgttcgcttttacgattacaaatttttgtaagtaaattaaaaactgaaattggttcttctgttatttcactatacatatcaaatgatggaattaactcaattaatgagtccgataattcttgtacttcattatcattaagtaaattaagttcaaatgcttttgttaatggttctattattgatgttatcatccatgaagggacaatcgatgaatatttgataagtggcaaaattataaattgtgaattagttaaattccgtttgatatatgatttaataaaatgaaaaataattgatttactatcagccattgaataaattggtaaattatatgtaatcgagagttgaccgtttatgatcttctgaacaaagtctgtcaaatccgttaacggattttgtttcgaaagtttattcaaaacgtcaagtaaagcattcaatatgtcgttatttgtttcttttaatgctaaaatttctatttctttttgtaagtcaataatttgttgttcattaagtttgttcattatagcataaattatagtacagaaacaaaatattatatttttttcagcatttttaatattatcaaaaacgaaattaattaattttggaacaatgttttgaccgaaattaaatgaagttaatgaagaaagtgattgtgcaattgcagctttttcttttggactcgaagtagtttcatttgatattatataatcagcaacaatttcaacatctttcgaaaatatcgaaatcttattttcgccgaatttatcagcaataacataaagaagttcaattgcatttgcataaaaatttgttttttgcttaagaacgatttgatgtatagttaaaagacaatcttttaatatgtcactaataaatcgttcattaattgaacagaaaaacgcaaaaataggaagtaaaaatccgtcaatttcaatatccgatttaagtttcgttattgcaaactcaaaaatgggtttgaatgtgttaatgtcagctgattcagtatcatcaagaaactttaaaataagtttaaagaaaagatttcgttcttctgtcggatatttaggaaattgctcaattaaacgtgaaatatattcaggtgtatcaaaaactccgcattctataagtcttcgtaatgatttatgcgctctatattggatagatttatcatcatgaagtaaaagattataaatgttatcaaacaaatctgttggaataatttgtggattttgaccgaattgataactgatacgttcagataagaaacatgcggaaatgatttgaggtttatcacctttaaatagtttggagagcagatttaaaaagaaatacgaagacccatcaatatggtcgataaaagctgatgctaatggtgcaaaaaatattgtggaagaaacaattttatctgtttcggatttggtttttagtatggaaaatgcttcttcgtaaactttttgattgatagaagcagcttcaatggtatcaatgtaagaaacatattgatcaaaattatttatatcaataaaatcaattgaggaattaataagagatttggcattggattcactaatgaaagggaaaagggccatgagaacttcaaatgtatgaatatcatttttatctgttgttaatttagcaattaattctgaaatcttctgtggattagattctgaaaatgttggaacaattgaaactaagcattctaaatattgaataaaaagaaagaaagattttgtatttgtttctgcaatttgaattatactgttccatatttctgtaatttggtttgagtcgagttctactttctctgtttgacgacatgttttagataaatattctaaaagattcttttgttccatctgacctcgaccaaaatctgtcatttttgttttaattcaaaattaaatgtcatatttgattttttggcatttattttttcattcaataaaaaacgtcataattgttttattgctggttaatgttaaatctgttgtttatactaagttcatcattatcacaacttactgaccgagaattcaaagaaaatattataaatggaaaagctaaagagccatggtttgttatgtttactaatgagaattgtccaaattgtattattgcacttcctgaatttgaaaaggctgctgaattagcacgtggatttgttacattttctactgcacaagttaaagacacaccagaaatggcacgtcgcttgggtgtttatgcagttccatctttctttttattcacagaaaacggtgtcaggccttattcaggtaggcgcgtttctattagttttcttaattttattgccgatgttattggcgagaatattgatgaggcagatgaatcatggaatgatcaaacagataacagagtcatattattcacaaaaaggttcaagccgccattttcatttgttgccacatatagcgtcctcaagaacaaaggaatcacatttggaatttcccgcgattcagatgtaatcgaagcatttggcaatcctccaacgccatcaatttggttcctcaaggatggaaaaaaggaacaatataaaggcaagcaagatttcactaaactcatagatgctatatcgcagttctatgatgttgaaaaacaaacagacgacggattataggtgtaattctgagaatgaaatacgtattgactttcccataactatttttttttaaataaatattatattatattagttaaattactttatttgtttcttttgctctgtaactttgtttatgaattaattttgcaaattcttgagctcattaaattaaattttaagagagaaatcataaaagtcatagagaaaatatcacatgtttgatttagaagttatgttgactttagattataaaaaaaattagtttcctttactgcaaattgtttgttaatttacattccttttacaatacaaaagtaaaaatagttggtttcaaattatccctacacatataatatcattataatgcatttttatcacaaaaacaagtatttgaaatttacataagttttttaaacacacttcaaaagaaagaagaagaaattaatcaaaatatcgttaaactaatatcaatttttatcaaacgtatatctacaaagaacacacaagaatcatattatttaagcgagaaaatgattaaacaaaatttaattgaaaaaaatatcactaaaaatattttgcacattataaaacagaaaaagaaaacaaaaaacaaaatcattcagcgtatgggcctagaaatgatccaatagaaaaatacttcttggatcattatgaagaactttcaaagaatgattgggagcttcataagaagtatgaaatggaaatgaagcgagtattgctaataatcaaaatgaagatcaaatgtacgcaaaaaacattctaaaaaaagtaccaaaacaaaagttgatacaaacatatgaaaatcatcaaaatcgcaatatacattatacattaaacataaaaacagatttattgatatttctgaatttcaatttgtagcatctgctcaatttctttcgttttttgtttattttttcttattttactttttatttcgacaattttttcattttttatttgctccaaattttgcactctttggtttataattttaagtgcttcttcttgtttaattctttgtttctctatgaaatgtttttgctgctttgtagaatgttttattgatgcgcacaaagattttaatttttcttcaatttcattcatttcgtcatcatcttctttttgaggaatttctttattttcttcttcaattcttttatttatttccaaaagtttttgctctaaaattaaattcgtttcttgaagtttattaattatttctttgttttcgtatttcgtttggttcatatccatccataatgttttagataaattaatttcattttttaattctttgatttcttgttttatgtttttgatattgtttttacagtcagaaatttctttagtgtttttattaaagttttgttcgatttttgtttttgtatcaatttctattttgattttcatttcttcttcattttgcgctatttccattactttttgttgtaataattcattaaagttattatctaattcttgtttaactttatttattatttgttgctcatattcagatttcattttatctttatcaatatgttcaattgaagatttataattatctaaatgatttctaagttgattaagtttttcattaaaaatattttcttctcgaataatagtggcttcaacttcatctgtaatcatttgaattccattttctagatcttgattaatttcattaatctcagattgaatctttcctttcctttgctggaaattaatattttctttttcaatcattttattaaagagttcataatactttgcatcgcctgatggaacaaaaatttgtttggaaaattttgaaaggtttacattacattctctttcaattttctgaaggttcacttcatgttcatttttcagttgttcgatttgctttaaatgttcatgctgcatttttttaatcaaaaaatcaatcttttgtgaatacttttccttcatttttgcatatctttttttaagaatgtcatctgtttgtttggaaagatcaatttcttcttgttcttcaattttaatttcgtttggcgttaaaagcaattgcatttcttttgataatttgtttagattggttgttaatttttcattttcaacaagttgaattgttattttagattgaatttctgatatttctttttgatatttattagccatctctctctttttacgatcaagtttcatttgaaacccaatttttcttttttgtgatttattttgtagatttgcaattttattaatattattctgtatgtttttttctgtttctgctatttttgtgcatatcaaagacaatgctttttgtgctgattccattatatccggcgacttattcatttccttttaaggaaacgaacgaaaattacagcgaccgtttaatgattggagttgcgaccaaacaatatgagcgacgcggagaatctcgacagaatcatcaaaagaattatacgctcaacagattattattcgatacttttcttaaaagatacatgcactcaagaagaaattgaaagacaataccaagcaattcaaaagcttttagattccaatcattgcaagcatgaacaagcacctgaagcactcgaaaaagctaccaaagcatatttaacattacatgatccagaatcacgtcaaacttataaccaaaatcgtccaccaaagcaagaaccaagacaaaacaacattggtatctttgatttactttttggtgatccagttagaaatgtaagaagatacaatcgtaacaataataatcaaagtaattcattttgtggcaagttttcgaaatttttaatcatcgtagttattattgttgctccccttcttactaatgaattagttttttcaggtgtcagggaaatattttcgaatcccatatctcgcaaaaacctcaaaggcattatttcatttgactcaatacctgattccagaaagaggaagacacacagttaccgtgcaccttactacattccaaattggtgggtgtcgcaatatatcgaacagaataatatgagaaaacgcgtcaaagatatggacaaacttgcggataaactctatgctgaagagttggaaatcagatgtgagcttgaaaagaacaggattgggcatgaagggtcacaatgctctgagaaaaagagaatacttaaagaagaataattttcttattttatttttttgtgtcacattaaatcgttttaatgttttggtataacattcgatttcaattacgttaatgttttctttacaagttttatctcagtaaatcactggaatatgaaaacaggtttacttagttatttcattttggtaaaacgaattaaaacatgtaacaaaacttttgcagcctttctcgaatacatttatatgttcgcacactttcgttttaatttgcacttcataaatatgttccgctttgattgacatttgggtaaaaacgaatttgaatctattcaaaatatttacaaaaattattttatcttcggaaacgtaatgtgcactcttgctgctgcgctcctcagctcgcggaatatttcttccattagctccttcgcgctttgctttgcctttgggttcattgctgtccacaactttccgatattcttcacgtcgctaatcagctccggcaaagttcgatagtattcgttttccattctcgcggacaaaatgtttaagtccattggctttaaagcctttgcaattaacttgctttccttgaaccgtttattaaccgccgtaaacatagaaaattctttggcctttgaaatcttctgaattatcccggcggtttgcgcacaaaatttctgagcttgtgtcaggcagttcctcttttgcggcagaacaatgtcccacgggctgatgaccaatggcatcgggtcatgatcaattgttagcgattcatatgggtcttcttcccaatcatctctaatgcctgtgatacaactattgaaaatttcttcatctgatttaatgtgttcaatgtctcgtccaatagttaacgttcgacaacatcgaatagatgtgtcaaacgtggtctttaatatgatgaatggtggcgaaagtggtaaaggataatagacattacatttgatggtttgtcgtgaattcaatttgatcgatagtgtaagcaaaagtgaagtgaccataaactctgtatcggagacgatacagtgaataaactctggtaagtttttgattcgtttatacggtggctcaaaagtgtcgactttacactcttcagcaaactttttgtgcgctttacgtatgtaaatcacttcatcgcctttttgtggtataaacgttttctgtttttgtttgtctatataaacccaatcgtcgaatttcaatggaatttcatcgtcttcgtcttcaattggctcatcgtcttcttctttaggctttgttttacgtgttaacttcggcggaggcgatattcgtcgtgatagaagtgacgtccgtttggtgctttgtttccttttgtttcgtttgactttctcaggtgaatacttccgagagacaattgatttccttgttgagtactttgcaatttgttcgatttccttatcacttttcgtgtcacgctttgaattcggcggacttgttcgagatttacgtacataattccgcttctttcggggagaagtctctgcgtcttttgaagtgtcttcgattttagtccttttatgtcgaccatgtttacgctttttgcgtggaggaggcgaaaatgaacgtggctgaacagtacgtcttccagttaatattaatctttgttgttgatcttgttcttcattttcgtttttgtctatttgttcaaggtcaaatatactaatggaatgtcgagttgacattcgactgttaagtattgagaaattactatcttcattttcatttgtaatgttttcgttttggttggtctgtgactcattatcttcatcgttcgtttgctcagtactaaatttttctttatcaacttttttccattttcttaataattccttttcttgaataatcatataacttgagatctgtggtgggttaatatctattctaatgtcttgaagattcacacgctctggttgtggtactaaagcttcgccttgtgcatcatatataattcgattgctgtgatcgttaacatgcgtatcgttcaattcaaaatcaaaaaattctgttaacgatacaaatttgctgtgagtgaaaccgtaaaatgtaaaaccgcccaaagagtcagcggctataacgtactgtccatcgttcgaccaaatactttctgtgagttttgcggtttcattgaattgtagtgcaacgataatgttgcccaacttggtgtcccatatcgaagagcgcccattagaacaacctatgaatgctacgtttggcatatatgggtgcattgacaatactgtgcaatgttctgtaaatattgggtgtgatacagatgtaattaatttttttgtatgaagatcccaacaaaaaatagtatttgatgaaattgctactaaatttgtttcatcacaattcatgtaacatttgaccacacgcattttttgaccagttggacatcgtaatgaaaatgattgttctaattcccataaattattcttagctgtccatagcttgactgacttttctttagtggaataactgattatgttattacatgaaagttttgagaagaataaataatccggtaaattttgatgaccacttaatgtaatagtttcatgttttgtcatcgaaaagatacatacatctgagggctcactagaaaatgacaaaaattcaccgccgggtgaaaaacttacccatgcgctagcttgtcctgatggcgtaataattcgatgatacaaagaataatccgatgtgttaaagatgtctacagctccttcttcaagggccgcagctaaaaattcgccattcggcgaaaagcgtatcgagtgaacttcactttggaattcaattttctttatgagactgccgtcgtggagcgagttaattgtgatggtaaagtcatgagagcttgctgcaaagacttggtttgatggactgatttggatatctgttatgacgttgagatgggtattgattgtatcaattaacgtcatcgaagggattttccagattttaataagagaatcatcagcgccagtaattagaagttgtgatgtcgcatcaacagctaaacaaaatacaaaatcaaaatgtccagtaacccttattattggtgacatttgggtgatttgtgtttgataaaatgggagattggatgataatgcttgtgggatcgttaatggctcttttaaggttgatgtattgacaaataatgaaggctgatgggatttgggacatgtcattcgaacaattcgtaatagttgatcatctggaattccgggaagtgctgttttctcgagttgttcaaaagaaggtttcgaacaaaaaactgatgatggaaatttattttgaatttcgcattgatgaatgaaatcttctgctatttctggaaagttagagcgaagaagtttagccattaggaaatataattccctttttagcgaatcatcattcattaatactgacatgtgatatgaaatttggcttgatgcgttttattttgatgcaaagacaacaaaaaaaaatgttttatttataaaatcaatataatttgcataaagaatttgttagattttcatggctattgttttgttttgggaataattccaataactcaatctcatggagaagaataaaatatttaaacggtctctagaaggagtgaactggagctatttcacatattttttttcgttaatcatttttttcttgttttttcccatactcattgatataataaggtattattacagacaataaaggctcttttttggccaaactaactcatttttaacgtacaattttttcaagaccttgaaaggtgatcacctatttcgaccgttacctatagtgttttgtgatagacactttttgtaaataactcaaaaaagcgcggtattaataaataatgtcaatttatcaccataaatattaaatgtaaatttttacttttttgttacatttatttcgtaaaatggcggggtggttttaagctcattttatttaatggcacgcacaaaacagacagcacgtaaatctactggtggtaagacaccacgtaaatcactcggtgctaaggcagctcgtaagtcaacaccagttgttgattcacaaggtgctaagaagcaacatcgtttcagaccaggtacagttgctcttcgtgaaattcgtaaataccaaaagagcacagatcttttaatcagaaagcttccattccaacgtcttgttcgtgaaatcgcatctggtttccgtggtgatcttcgtttccaatcatcagcaattgcagctcttcaagaagcatctgaagcttatcttgttggtctctttgaagatacaaacctttgcgccattcatgcaaaccgtgttacaatcatggaacgtgatgttcaacttgcacaaagaattcgtggcgaacgtaattaaacataaaatatttttaattcttgcaggttattataattatgatttttggcaatgaaacagatttatcttattgcttaatttttcaggaactttttagctgtgaatcattatcagatgacttatttttggcacatattaaggaacctccaatggagaaagttaagtttttcgttaaagctttgaaagacaacgcagacagtgatttgaaatcacttattgaaaataaaagaagtcgggagtttaacccttcgccactagtaattttcgactacaacgaaagccccatcaattttcgttctaagactttattcaaaacaaatcaagttgttattacaaatttaaatcatactcaataatttttttcataaacctttccaaaacagccacaataaaaccacatacagtggtaccacaaacaatattatggatgtaatgtggatattttgcatgaatctacgtagatattatatgtttaactcttgataataaaataactatcatcaaaaataaaataaatacgtgagcctacatcttttttccttttctgaagcatattacaaatttcaattaaataaatttatttaatattctaaataaaagactatctttacaagtaataattttaaagtatatcaaacaactttaaagaatacttgttggatttcttgtttgcatcgagaattaatatgactacaaaacagagaataaacggtcgaacgatgtggatttattagacggttatgaacggtttggccgttccttttcctcatgccacaaaagagaagaaattgcggacgctcaaaaatgaacgctggacgcaagaagattgttaactgcatgaactgcggccgtatggtaccacgtgataaggccataaagcgtttcatgacaaagaacatggttgacagttcatcagctaaggatgttatggatgcatccatttacaaggaatacgaattcccaaagacctaccaaaagtgtttctattgtgtttcatgtgcatgccatcgtcgtattgttcgtgttcgcaatgccaaccttcgtcacgttcgtgtaccatttttcttaaagcaacaacgtgaacgtgctgaaggtcgccaacaaaaacaagaataaatcattatttcgaatcactttcttattttatcttgtaatattccctcaattaaaatatgaaaaacttttaaatataaggtcaaatttcagggaagaatatgtaagtaatcaactttttttgaatttgaaatttcaaatgaatttcagaaatttggattttacatttttacttatatgaaaattgattgtctttatacaatagtgtaatgttgtaagaagatactgttcgttttttaattatactttcaaaatattaaaatcagaaaaacttggataaaacacaactcgattttacactgcttctaattgtcattttcatttggatactaaatttgaaaaaatttgatcatgctgcatttcgaaattttatgatactttcaaaaactttatggcttatataatttttcaaaaaaaattaatcattttgtttatatttaggaatctcatatcagattttatcaatttgtttccaaaaaatcaatttatcctagaaaacgtttaaacatctgaaacgaactttttgaatgaaaattttgtgatgtgatgcatggatgataatttgttcacattcatgaaattccttaaaaattttttactcagcagctacacccggatttgtttgtgtttgaagtatattgagtaggtggaggtaatgggtttttgactccacgtctgaaaatttgtgtagcaactctaacaaatgcttcacgaacatttgttccatcagcagcagatgtttccaaatatgtaatttgctgttgttgtgcaagctgttctgcctcagcaagagttataactcttttacttgctaaatcagctttatttccaactaaaagaataacagctgttggatcgcatagcgacctaacgtcggtaagccacatgttaacttcgttaaatgattttctttcggtaatatcaaaagcaagaataacgccaattgcatttctgaaatatgccttagcaatggacctaaagcgttcctggccggcagtatcccaaatttgtaatttaacttgttggttatcaatatcaattatagttgaatcaaattcaacaccaattgttgattgcgattgttgcttaaatgtgttttcagtgagtctttttagaagggctgttttcccaacgccactcgaaccaatgataatgaatttatagctgagcaaagttgacatttacaaaattggatatactgaccaagtaaactcagaaattgtttgtgaatgacctaacgatagagaaaaaccgccaaaaatttttatacataaaaaatgagtattttcataaaaaacataataatagcagtttaaaaatcttggcaagactaccaatgattgaatgcatttgtaataaacgaaaaaaaattgatgaatttttacttagagcaatctaaactcaagcatcttggtgacaaggaaattgactgataattgaatagaaacgtttgttttctactcaatttttatgttgtatgaatgaaactgtacacaccaataaaaatataatcaaacacatttaaatacatataatcattatcacacaactcatacaaagtttagtagtgtgataaatacagaattattatgagaaatgatcgatattttcagctgtgtgttttatcagcttttgaggggcatattttataagcaaaaatagaaaacaataatttatatttattattaatatcttatttgtattcatagggtaatgcttcgatattcacatttatgagtaaagaaaagtgtcaacagatggtgtcacttttgtctcttcgatagcaaatttccaattaaaaaattttaataatttttgaggtgcatcttcattccatcatgcaaaaaaaaaaaaaaaaaaaatcaggaaaatttgaaaaaactcattaattaaagttaaaaaaccattaatatgtatgagaaagaaaaaataaaacaccaaaatagcatagataattgtttctttttctttggcattcataactcggtggattcttgccggttatgctccagaacttgcattctctgtaataaaaattgtcagcaaaattgtgaccaaatataatttgaaaaacttcattgattatatttgactttaaatgtcggtttgtcatccaaagcctcataaaaattctgcaggcaaaagaaaaattgccgcacataaaaaggggttagaaaaattatgcaaaaataatcgtatcgtcattgacagaaacaaattcatttaaaaagtgaacaatatctgtacttctcaatgcattaatacccatttatattaatgaaatcttgtgcaaaaatcatccaaatcaatttcttttttaaaaattttaatcttttgcactctcattaatacaaaataacaaaaatttgatttctgtcatcaatgtcaaaaatgtttccacacaatttttcgaacattgaattccaatattgacgtttttaacccccgatctctattcaagatcaatggcaagtaaaatcagtgctttcttcatcatttccttgattatagctattgcaacctatgcatttttgaatagcaatagcatctatattcctaaagaaatcctgactttccaaattagaaataaaagaatccattccactaaaactattagtggcgactttaaaccatttgcagatgtagcgattccacaagatggggaaccaccttcgccaacatttaaatattatcaatatttaccaaataattcatataagtgcatagataggaaaccatttcgtcatctttttgcccgtatttttagaaaggacattacaaaggaagaactctctaatccacaaattcttttggtaggtcgtaacacagctttaggtacagctataagagaaatattcgaccaaaaaggaatttcatatttgggtttaaaaggaatcaatcatttagacttttcttctgaagattcgtataaaattttagatttaattaacataacatctgttattattgcatatcaaccaccacttattcgtcatacatattctgatggttctctttatatgaaacatatgatcaataattatactaaaggcttaatatcatatttaaatcaaaaaaatataagttatgtgttttgtcctacacaaccaatatttaaagaaactattgatattgttaaaagttataaaggaaatataatcgaaatgccgtttttgattgattctaaaggttttaaagacttagagaatccaataatgagagcaattagagaatgtaatgaagttggatatagtaacattgattattcgccgtatactaaatatcaaagtattacatctaatgaagcagccgaatatatacttcgatatcttcatgagaatcatactaatgaacatatattaataaaagggaattcgcaattaaatatcgaagaatcagtaaatttagcgttaaaatcatttggactcgataattgtaaagttaactttaggaaatattcacatgacttaagcacaacaattaataatgaatatgataaaatccaaatcattggaaatgaaaatgcaaatattgaaacaatgatcaaaaatgaatatacaaacaataaagatattataatggatcaaatagagaaacataaaaataatacttatatatcattcacgttcgcaggtcgtaatgatggatattctaaagatttcacatttagaatacaaacatttcttgatactataagttattgtatccaaatggtaccacttgtccaaatcgaaattgtattaattgattatgcaactccacgtggtaataagttattacatgaaatattaaatataacgccatatcttcataacaaaatccgatttgttatagtgccaccagaaacgcatgaaatgttagagaagaaatataatcggaaatatgcgttcttcgaggtaatctccaagaatatgggcatacgaagatgtaaaggtaaatttgtgttagcaacaaactctgatatcttatattcgactgaattatttgaagaatttgctgcgcaccaatttaatccatatataatatatcgagctaatcgatggaatatgttggaagatacgttttcgaaaagttttaagtctgttgatgaattaatacatagtatatcagatacttggcaaatattaaaattagatatggagtttgcgagtcaaatatatacaaatagatttgctatagtcgattcgtttgacgcattcgcagctaaacatggcccacgttcacctggagacttccagttaatatcaaggcgttattgggatgcattaaaaggcttcaatgagatcccttgtaacccggaagtcgatagtgtattcctagcaaagcctatgaaaatgatacaaggctttatgaggatgtataccttcccaggactcgtgcacttgtatcatgaacgaataaacttaaggagagtcccatactatggaagaatttccgctcagagaagctattcctgtataggaagatgtccaacttgtagaccgtacttggacactgagaattgggggtatccaaatgaaacttttcaagtagtattaaaatgaattcaaaagtcgggaagtgtggagaacactgttcgtccttagtaaatatattataaatttcataatttagaaatacttttgataattcaaaaagtaattcaatgaaaatacaaaatttcactcaaaaagtagagaaatgttttgaaaaagttcaccggctaagtaaacactttgtcgattgatataagattatcaaaaagttttgggtttttgtacgaaatgggggttatcggatattgaaaaaatatatacactctcaattatgttcaatatgacttcatcatttttaatgtgttgagcaaatgctacaaacggttaaggaagactgttgaaagacatagcgcattagagttgtccctgttgtaaaatgcacgttaaagtactatgaaacttgcagaacaaaaattcttcaaatatatgacataatcgagaagcgtacgtcttcatgatttcggaaacaaatcgacccagctagtgtactatgcatgtttgattaaaatttcatttcatttcgtcaaatacatgaacatgattcacttaatgataagagtaaacactattaattgctaagtaaaaactcatactacagcataaaatgttgaaaatagatcagattttgcgaaaattctcataaaaatttcagatatcgaacttttatttggattaatgaatttgtagaatgggaaacaattacatgatatagagattatctattgataatacaaaatcaatacaattcacactatttctattgacaaacgtggttcacattatgtaaatataaaaaatacaagtgtttgaattgaagataatgatttgcaatatatatttttcatatagtgaattatgacctcactgtaagttcgaatcacagatttaatttggatgtcaaatcttgcaatattaaaataagaaaatggtgaattcattcattattgattcactgcaatattaaatgcaatttgtcacactagtttattaatatgattaaaaataacatgattttaaaatcagattcattatgtattaaatttttgccactctcattttttcttgaaaaaacgatcactaggtgatgaataaagttatgaaaatatcgcattaaatgatataaaacgaaatgaacttctggtggaaattactcgtaacaatcattttttattatgtcaaaatcacaaaggatacaaaatacattcaacatgacagaggcaattcgtgatcgtcttgtgaatcttgcagcataccatcgaacttgtaaactttgttcagaatccatctctttccggtgtacgctttgttgaaggttagaacaacacctcaaaaatttcgaaatcggagcatgcttgacatttatggctaaaaaaaatcgtttcaataattgctgtgtttgttttcgaaaaatgccagccattttattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttttatttttattttttgaaacatagcataagcaaaaattactataaaggtaaaaatcaaaaatatgttaacatgtattactatccaattcaaaatcaaattaataagtattcgtttatttattcatctgaaaataatcatttaaaggaatggagagaacgtttattctgttttacaactttacatatttttcaatcagtttttggtcggaactttgttgtattaaggaccccctcttaaggggtagcaaacctagtcaatcattttatcatgggatcggcctcggccgcatgacttaggcatacaattctaagatgagtgatctcatagaatattttgaatgaacaaaatgggaagttaccatcaattttccctttttatgaatcactacatttggttttaccccagcagcatctactgctagaacgattttgacattcttaaaatcattgtgaataaaatattcgaataacttttaaatactttgtaaagaaccattaaatagatccatagataaacctatacgacaaaaattcttcttttgtccatcttttaactgttttgtaacttggaaatcccattttttcgacaaaaaatccccacattgatttgccgatcattgacatttatatgtagtagctttacattgatttgtcatatcttttcgaagacaataacaaaacatgttggttcataaaacgataattttccaacgatttaattacattattattattgtcctctttgttatttgaatttgatttttgctgaagttcatctttataacttttttcaattgctcatttttcttttgcagaatcgaaatctttgcttttagattggcctcaattgaattacagactggtgaattcctgttttggaatcctcttgtacacggaggcgaaaaattactcataaatgaaataacgggttaagattttgacgacgaaatttacctcaaaatgcaacaaagtaacgtgttttcaacaatctttcaaatataaatacctcaaaacgttatgtggaaaatccttagatattatgaattttttatagataaatatcatattataaagtattattctaaatttataaatagattttcaagaccattttttttgtcccatgttctgatgttacaaattggccatatatataaatttacaaactccgatttatatagttagctataaatgaatttacagggcgccccttataacaatttatggcaaattattgtcaaaataagtcaaatcgttttgcatcttgatcggttttgactgaaaaaataaacatttcacttatgatttcataatttttgcttgttggtactcaccatctgatttcagaagttttttaaaaaacaaaaaacacaaaactaaaaatgatttactttagaacacactatattttattatatatttatcttaatcacatttgcacaatgaatttgtcttctttgaagtcatctgcaaatgggtcttcttcaatatttgatatagatattcctgttgtgaatgtgtttgttgtttggttattatcattttgttgttctgaaatttcattttcaacaatttcttcttttttatttttaattcggatcaataatataattagtaatgaaattataataataacaacaacaataacacaaacaattattatgataattgcaattttgttgtcatttgtttgaaattcgttgttataaataaatgtaaagaagttcgaataataaatataatatgtcgaataaataataactgtgtaatcataataaataaattctgtttcgatgtaaatatacgacgaattaattgtaaatagtgaaagtgatttcgtttgcatttcataataagtaaacgaatgtgtaatagataatgtgaccgttaataaatatgaaaaagatttcgttaaatcattttgaaatgattcagtaaatgtattcgattttgaatatgtattattactactgaatgaatgcggcgctgaaaatgcatttgaatcagaatatgtattacttcgactgaatgtgtgtgatgaagaaaatgaaattgttgcaatcgggctgcagtttccttctgcgttgtctttgtcaacatcgaaatttccaaatttacttcctacatatgttggatatgtgataacacttgttgtaacattataaaatgcattatctccaatttctggttctgtatctccataataataaatgcattcaagattataacaattcccaaatgctgattctccaatttctcttattccaaacccaagtgttaatattcttaaattagaacataatgaaaatgctgaaccaccaattgaagtgactgaatttggaattgtaatgcttttgatggatgaacacaatgaaaatgatccaccaccaattgttgtaacatttccgccaaatataatcgtttctaaattagaacatgacgaaaacacagaaccaccaatatctgatatagaattaccaaaattaactgaaataactaatggccatcctgaaaatgaaccactcggaatgtaataaattccttcactaatgtttataaatttcgtgatgtctttatattgaccaatttgttcaaaatcatttaaatttgttattattaatgttgagttattatcatataatatttgaaaggaatttatgaaaaatataacaaaaattaaaatatttttttgttttttcttttcgcatgttttcaattcgtaattggtcaacaaaaatttctgaagaaaaagtggttttttctgaaaaatattgacataaaccactaataacattgaaaaaacggcggttaaacgagtaaaagcattgaatttaagtggtcggtcttttttatcgttttgcatcaatgaaaaacaaagaaatttactctgggtcaaagatagattctcataacatcttttcatggtttgcattgatgtattaccttcagtcagcatactggctataaaggatttattttgggtaattgtaaaatatgattctgataattttaatttgtcattaaatatttgaagcacaactaatgtattctctgtaacagtcaagaaatctggaaataaactggttttaaagaaaatagaattcttgttaaatatatcaaaattctggtgatgaatttcaacgaatggatcttctgcactgcgcccatgcgcaagtccttctttgcaaaggatctttttcatatttgatatttttatagtcctaaggaatgggctttctggtataatactgttactaaattgctttgtaatggacgaaacgagcagcaaatgaagaattctcatgattcaagacctgatatagtcgaaggccttaaccaaatacacatcggctaatataaaaagttaaaaaccataccgttaacatataagaaatttgttgttgtttttttttgaggtttttcaatttaacctgaaattttatttcaatatttaaaggcgcctacaaaaggtggcgctttaaatgattataaagtcacttttaaataatataatgaatgcacgcgataaaactgagtctggtggtcgtaatgatacatctttgttggtggtaaacatgttataagttattaaatttcattaatttcaagaaatatgaatttttaatgacatattaaacatttccttcaagatttatcatatttttaaatgaaatatatgaatgtatgtgtgtaagtactaaggtccatatctaaatacttctaaattaattggaattatatttcattgactttgtaaagttattctcgtttacttttgatggaatttcataaatttcgaaatatatttttgaataaccaaaaattcgtctaattctttaataatgcttttaatataataatgtgaagaatgtcaattaatattatagaaaacaaagagaagaaaaaatacttcagctcataaaaagtattaaattttgtgactgtgtgtggttgtgtaaatgaattagaaattgaaaatgtattcgattttgtaaatgaatgtgttgaaattggtgaacacgcaccacagcatattcattattcactggaaatgtccaaatattgttgaatatgtaataactgatgacaatatacggttctgaattgccaaaataataaaaggttacgtcattcggtgtcgctggcttcttttagttatgttccaagtgttaatatcgttaaattataacaattagaaaacgctgaatctcaatgttttgaacagaattcggaagtgtagcatttattagtgatggacaaaatgaaaatgctgaattacgaattgttgtaacatttcctccaaaatatgagcatgataaaaatactgaatttccgatatgatttacagtgttacaaaaatgaatatatgtaactgattttgcaaatgaattcatatgaattacctattaaaagtgtaaaattacaatcatcgaaaaaatatttgaaaagaattcatgaaaaatagagcaacagcaaaagcatttttggctttgtttcctttgattttcaacctaagccctgaactaaaatcgatttttttccgaagaaactatttgatataaaccgctgttagataattgtaaacaattgaatttggaagattcaaaaatatttttgcaccaatgaagaaaataaaaactcccaatgtaattataatatttatccaaggtttgtagaggaaggttacgttcatcaaatgtaatgatttttaaatgattttttttgttttatgttagatctgattctaaaaagtttttgtttaaatactaaaacatggttcgatggaatcgtacatatattgtcggagatgggttttagatttaaattgtaattagtgacatctgtagaaataatgcataaaaatgaataaaaattattgttaattatatcaaaaaatggaacctgatcattgcgtagatggtaaatgcctctttatttctgtcctttatatataaaaattttgtgtatttgaaaaatgaatctcgaagcttcatttgagttctgaataatttcaagatgtacaaaatgagcaggaattgagtagctttcatgtttcaatttgaaatatagctgaagaccttagtcacattggttaatacaaaacttgaaaatctcacatttaaatgataaaaagtttgttactttcttgaaatttttctatttgcctataaatctttcgcttaatgtttgaaaacaacaatgataacaagggaacaacaaggtgataaccgcacttttatataatattatgaatatactttgtgttcgcatgcaaacattgcaatgaagaaacttttttgtttatgaatttatttagaaactggatgagttttgcgcgttgttctatatcgcttcgaaatataattcttcatcttgattatatcaaataaatgaggaatctacttgcttgtatattaaactcaaaaatgtaaacatttatgcaaaaagaaaacattaaatatttgtgcaaaattaatcatatgtgtttcaagttgaaatttcaacaagcatctaaaaatattatcagcaaatcataatattaatatttataattattgttatatttaaaaaattgataattaaataataaccaatgatacaaaaagagtaccaaaatttgaatttctattacaaactataaatcatttagtcaatgaaaagtgtctgctttaatataatcacattttttacctcaaaacaatattattatatataaacaaattgttaatcgattaacatttcaaatattatcatttctcattacgaatcatttcatagtttttaaatatattaattatcaaataaaaaatatattttattttacatcaaattatagccaattgtcttcatcttcttgaacaatatcttcaactaaagtattcacttcctccatttgttttgtacttgatgtagttgtatccttaaattgtaatttcgatgtcgattttacttttttgttattactttttattaagaatataacaattccaacaattattaacacaaatgcaattgatccgcaaacaattccaatcaattcattagttgtaagtccatttgtttgtaaaatgttcgtgtgaaacattgtaatgaaatttgaataataattataatatgtcgaatacataataactgtgtaatcataataaataaattctgtttcaacataagaaaatgttgaattaattatggataatgaaagtgatcttgtttgcgtttcagaataagtaaatgaatttgtaattgtcaatgtatatgttaatgtatatgaaaatgaaaatgttaaatcactttgatatgatccagtgaatgtatcacttcgactgaatgtatgtgatgaagaaaatgaaattgttgcaatcgggctgcagtttccttctgcgttgtctttgtcaacatcgaaatttccaaatttacttcctacatatgttggatatgtgataacacttgttgtaacattataaaatgcattatctccaatttctggttctgaatatccataataataaatgcattcaagattataacaattcccaaatgctgattctccaatttctcttattccaaacccaagtgttaatattcttaaattagaacataatgaaaatgctccaccaccaattgaagtgactgaatttggaattgtaatgcttttgatggatgaacacaatgaaaatgatccaccaccaattgttgtaacatttccgccaaatataatcgtttctaaattagaacatgacgaaaacacagaaccaccaatatctgatatagaattaccaaaattaactgaaataactaatggccatcctgaaaatgaaccactcggaatgtaataaattccttcactaatgtttataaatttcgtgatgtctttatattgaccaatttgttcaaaatcatttaaatttgttattattaatgttgagttattatcatataatatttgaaaggaatttatgaaaaatataacaaaaattaaaatatttttatgttttttcttttcgcatgttttcagtttgttcattaaaagtttaatttcaaaaaataataaaaatcccaaaataaaaatgttatacatcagaacttgaataactttaatgaatttgaacattttctttatgaaaatattattcattgaaaatgctaagtgttcttttaatgtaaaatgattaagtactaaagaaaagaatttgaaataatgtttaacatatgaaattggtaattctaataaagggaaatgccaatgatatttttctgcactgatgttaaatgtataggtttcattatcttttagaataataaaatttgttactttaatggatacattcgctttttcatgggatgaggatgtaaagtatatgtcctctttggatttcgaagtaaggcaagtgtaatgtttgaaagtttgagaaatagataattgatcatcaaaaatctttaaacctgaattttgtggagagatttgtaacgagcaaaagaaatgcatggggaaagccaagaagaaataacacattcgtaagaaaacttgagaaacttattgataaatcagtcaaaaacgatacagagagcttcaaccgcttcgctttttagttatttcattggttaaacttttgctgatgcatgttttatagtttttgcgatcggaagatgttcacaaagctgaaactcaatattttcttataaaaagtgacagaaggttccataattaaattgtatgaaaatactgttaaaaaaagaagacatcgtccgcaaccaagaaaacacgatgaataaaaacatacaaaaagtttatttcaatacaattaacagatcacagtgaattttgaatgcagcatttctccaaacaacggtttgattttaaacctgttgaaaaatcgatcttaaccaatattgatcgttcgaaaccatagcacttttgaaaaagtgtaaaatgatttcaaaaaatttggcatttcttatttcctttgaattattcgtcaatgattcgcctcaggcgagaaattgagagaaaccatcaaaaaacatgattgtacagttattgaataattggacttcgaactgaaattttttctgtaaagtaaagaaaattgggttttattcaccaaaaaaaccaaataagaaatttcagtttaaactcacacgctacggtcaacttcctaaaattccaatgccccttgaaaatccagaagaaaattgtgtcagcacaagaatatgcacagaaaacaaaaaaacattaaatattttgtgttatgtagcagttgcaaccattttgataataccctttagggataaatttcattttgaattagttcgttcttaacacagcaaatttacattgtgtttttttatataaaaatatattaaacatattaaacattgaagaacaaataattttattttgaaatagaattgtaaccttgttattattttggcatttttacgaagtcactcgaaatcttcaactgtaggtaactatcatattcaaaattacttacattttttactcagacattgatataaaatgaaatttaaaatcatgattccatggaacattaattatgtaattgtgttcgaacaaatgctgttctaaacttcttatagatggataaagttttagaacaacgaataattttgaaaatttaatattaggaataaacgctatctatactttattcaaacattacatccattgatcatcatcttcttttgccatttctcctattgtttgtatcatttcatattgctgttctttttctaaattggaacttaacgaatcactaaactttccattaagttccgaatctgatttatcttttttactaattctaaataaccaaaccataacaccaatgatgattaacaccaaagctatagatccgcatataatcccaataagagatacactgtttaaaacaggttcatcactaatacgatataaagattgaaatacaaatgtataataatctgaataaaaactaatgattgcagtcatgtgaataattgaatattcataaaatattaatgtcgaatcggataaatactgagtgcggaaaatttgggtgaatgaacttatgtcagatgaatatattgtgagaataaacgaaaaactgagtgacgcaccaaatggaaatgaagaagtgaaagaattggactctgaaaacgaattagaatttgtaaatgaattcgacttcgtaaatgtatttgattgcgaaaatgtgttggactgtgtaaacgtgtttgactctgaaaatgaatttgattgagtaaatgtattcgactgtgaatatgtattcgattgggaaaatgtattcgtagagaaatttagtcgaactgtagtgatatttcctgtgatatttttattatctgttggagcaacatgaatatacatttgatccacaacatcattagttgtaaatttaatagtattatcgtgagttatatttgttaaatcatgtaactcacaattagcattagcgctaaatgtataattataataagcgattcctttagtaacattaacaacaacttctgactcattgatgctttggcctgtactattatatgcaacaactttaaatgcatattgtgtaccaacatttgcttcaattgttattaaataatttgcttgatctattactatgtcattaatttctggttgcgatgtgtcaggcaaatttagataatgatcttcaaactcagtttcattagttctttgcttaagataaaatatagtgttggcaaggatttttcgttcaaaagatgttgccgaaccagtgtgacctgtttgaaccattgctgtgtttccaaatgtgttaagatagaaattatctgattcattgcagttggttgtattatattcgggggtactagcaaatgaaaaccaaatatccatgagctttatgatgcgaagtgtgagaaaaattaattgactcatcttcttctcccctattaatgaggttccatgtatacattaatagtaatccttgcttgtgaactcctattttgtcagactgtatgtaattgaaataatctttatcatgttctttaactgtaacattaaataactttcgaatagcaactataccttcgacattacctttatcatcttcaaaaccagaggtgatcgaatcatgtccagtaataaagccatatccttttttgatgtaatcactgataactccttctgctgtttctgttttgattgactagcagtcactataatcccaaaatccaaaagcaatgacatcaaaatggtacaaccatggtttgattgtacttttccaactcttttccgaaatcatctatagatttgagtgttacattaataatttgttcaccattagaatcagcaccacaagcatcgtaattatcgttttcaataaagccaccttccatccaaacttttaaagaagctgatttgggataatttgatatagaaccagacgtaaagctcatatatacttcatcatttgttaaaaaaggttcgcattcatcaatgttaatcaaagctgtaccattgatactatttgatggataaatatttaaaacatttatagtagttcttcatttgtgcgtgctaacagattcccagccgctttttgtttccaaaaatattttataataatcagtttgatttttttcttgatcattaattgtccaattgagataaactccaccagccccatttgcatatgttgcattgtattttgcattaagtattagttcttcaaaaaatatgaagaaatagaagaaaataaacatttaatttttttcaagtcccggaaaacgatagaccattcaattttgtgatgtttttgaattgtttatttatgattgaaagatccatttatgccgaaaatatttcgaaagatatcattacacatttaacaaatcaaacagcaaatcatgggagatcaatgaaagaacgattcagttatctcaagaatgaatatatttttacaagatgtcatcaaactgataaagaatgtgattgtggctggaataaatattatacaaaaatatatggtacaagattttcttgtatacatgaaattgaaatgtttaaaaaatgtccagaatatccaaaactagttctttccaggtacaatcaaatgaacataataaaaatatgttaatctgaagaaagcattaaattggtaataacaccaaaaaataaagaaataaaaattcgtccaaatgaattatatagctttactgataaacatgttgtcgaattgtctaaaggaccaaacacaagatatgctaaaattcaaatgtggaaagttgtaaatgaaatatatttcattaatcagaatgtatagaatagaagatgaaaaacagtaatagatatagtagtagataattttgcagattttaatctaaacaaagaggagtgcgcaaatgaagagaatattgcaatggagaaaaaaattgcgctaaatttaaataataactttttcaatgtataaactattcattccaaaattgtatacctggatccaggtatccttccatcggccttacaagcataataaagtctttcttagacttaaaagagttttagaaatcggttggacgggaaatggtcccatttcgttgtaaaaatacgatacagtgatttctaaacatcgatggttattttcttaagacgacgatcacgaaggttttacgtattcaatattccctatcgtaaatataaccgttgctagtggacgatagatttttttctgtagattaacgatcatttgctctttctgacaaacacaatatatatattcgaaatccggggaccatttcccgtccaaccaagaaatctccctggtgattttcctgtttgaaatttattaactctatactttcgggtgtaagggcaactcataattgaatagtttacaaaattctgcagctaaatttattggtattgactttcattcagcatcttgaatgaaaagtacacatattttcttttcttatgcagaatattatggaaagatatttcacaaaaaatccagtaatgttcaaggaataccttcaagtctgaaatttgagccggtttgttagattttaaagtatgttttttctgactttgggtatgcacaaacagtttatcttttaaatattttaacttgggcggagattgactccattcttgggcagaataaataacctcataataaaaattaaagacttttatttgttgattgccgaaattttatacggcatgtttttacaaccatggacccatgaactttttgaacgcttacgggtaaggaattaatataaaaagccgataagtgagggatttgagttggttgaacgttgatagaattgagtgggggtttgtacgttttttagaggtgggaatgggctgcgttttttccgaaccagatttccctcaacgaaataatcgtgtctcaccatcagcatttagaagcaaaagacaaaaagtgttaagttcaaatgaaggagatattcttcaaaaaggtgttgattttattttacaaggaatcacctcattgcaaaatattgaaaacatagtacccgttgtttctctttccccaacgtcaattccaataatgttaaataatttcccaatcaacgaagatcaatttattgaattacctgttgcagccatttcaattgttggtgctgggaaagtatttgcaataggtactccttattttctttcgcatgaagcacttatggatcctgaaacatccacatttttagagaatgcttttctttggggatcaggaaaaaggatgccacacatattaatatccggatttccgaactcagtttcttctcgtatttctgcagatttaacatcttttgggtattttgtcgaatcacaaaatccaatatcagatgcatcaaattctaacattattattcttcaaagtgacgtcaacgtcagtcgtattgcagatttgatcctcgatttccttcaaagaggatgcgccatttttatatttccggcgcattttaaagtgcatgaaaacatttacgcgtttagtaattatatttctgttctcggtcttgaatttcttgacaatggacttcattcagagaatgctacaattgaagtatcggattttaaagaacttaaaagttataatttttattcaatttcaaatcgatatatcgaattaattcatgggtcaccaacacttgaagaacttgacaatgtcgtttgtaagcttcgtttttatgtttccaaactcacttgttgtttttttgagacttctttaaatctattaaatgaatcatgggattatctcatgaaaactggtgctaagacagttaatgggtattgtcctaaagaagttcatgagattgttttcattttaatccttgaacttcttgcgaaaatccctgttgaatataccccagtatttgatggagttgatgaatttcctggattagtaggcgaagatactaaaacaacgagcaggaccttaaagctgtttttgcgcaaaggtaaatgggcttcgagcgggctctacttgccgccaggtcaagttgcacaaattgaatgctcgtcgcccgttaagataaaaatcggttgccacactaacgttctcttcaccaagccgggcccatggaagcgttggccagttatttcgtttgattatgaatatgacgatgaaccgttgtacttagcaaccccatttggtggtattatgtacttttgttcagatgtctcatgtgatgttacaatgatttgctcgggattcgctagatttccttattataataagcaagtgaagtcgatttgggaatctacaaagtcagtcaatgcaccgtggtcagaaattgatatgattaacttggtattaacaatacctacaaaatatgcaaagaagattcgcaatcttgataaatatgtttcaaatatgcattcactcgtggactatgttcattcattccttaactcaaaggtcaaagaagcacaccgagttgtttttgatattgatttggcatatgattttcaatcagatttcgatgcaatttttgcgaaattgacggcactcgaaggaatcctttgcgaaaccggaccaacaaaggatctcttaaacctattccaagtaattgcagaagcatcaattgaacaagacttattcgatgaagagtttaaggtcattatttcattggtagctgcatgtgcagctttcaaatcgttgtggaatgactttgagccaaaagatttcaaatctccaaatccgccagaacttttctttgacctatggcaagtgtttcttgagttcggatggaacatatttaatgagtccataaaggctttcgctgcttcaaaggaggaacataaagattcactcgatactgaagcttgggaagcttttgtgaatgagcttgaaaagagggctggaaagaggctagaaaggcttcgggataggttcactcaattagacaaacttgaaatgaatttttcagaagatttgtcagaatacagaattgttaattatatatgaataaatagaactttcggaatatatttgatgatatttttcttgattttaaagtttccagtaaatacttgaatttttttgttttgcaaaaagttatgcaaaattcgcataaaaattatacaatagttggattacttcttgaacaaaaaggaattgatgttaatgctaaagatatttaaatgttttatttaaaaattatttgaataattttatatttcatcataatattcggaaattatttaaaatattttggtaacataaaattttaaaataatatttgggaattatattaattattttatactgcacttgattattgcaaatcttgatgctgaaatagttggtttatttaataaattaaattaaattagggggtaaataatgatccctcccgttttcactcaataaaacgaattcgattttcattttgatttatttggtaaagtattccgtattgtactcaatgaccctgttaaatcgtatatatttgattttgtgttactttagcttaaactctaaatgtttttaattatatagatttagtaattttataaataaatgacttattgaagaaacttttaaattcaataaggatgataaaaacaatatttaagtaaagagttgataagtttaaaactatttctatggaaaagcattttgcattagacaacatttttttctaaacggctctttttaacggtctctttaaaattgtctttttgtcataattgtttccagagaaaatttctggcatagaaatttaacgcaacaaaaatgggaacaatttgaattttcaatatggctaaccgcaaatgtctagtgcgaacacatccataatcgaatcggaagatatacattctcataaaaaatctacatgcttggaattacttactgaacttgagaaagttatatttagtttaacaaaagaaaatttaaatcttacagttcaaaaaataataaaactatttgatacaaattttccttatacatttaatactattatatgtaatttagtatacagtgcattttcatcacaaaggaattcatttgatatttacataaatcttttatcaatgattcaaacaaaagaagaagaaattaatcagaacataatcaaaataatttcaattttcatcaagtgcatatctaaaactaaaactcacgaagcatataatataatatcacgacttattgaacaaaatctaattgatgcaaatatcaccaaaaacattaaatcgaaatattttgcacattataaagaagaatacaaaaaacaaactaatggatatgaatttcatagaatttatccatttaaaaaaccctttggagatccaatagaaagatactttatggatcattatgaagaactatcaaagaatgattgggaacttcataagaaatatattaaagagggacataatccaaatgaaattgcaaaaataattcgaaatgatgaaatcgaaaaacttcaagaaatatcatcacaaacaaaatttaatattaatcaaacaattgatccatcactttatgaaatatgttcatttattaacaaaccaaatgttacattaattgattatgcagcattttttggagcaattcaatgttttaaatatttacttatgaatggtgcaaaattagaaaacacagctaaatatgcagttgcaggtggaaatcttgaaattattcatttgtgtgaacaaaatcattcatcatttgaagatgcttatgaaacagcaatagaatttcatcgaaatgatatctttcattatatttatgaaaataaattagaaaaaattaatcatggagaaccacatccaatgccaaataatttgatctttggaaatggaatgcaatttaataataataataacaattatgataatgatataaatattttagtaagattttgtattcagaaagaaaattatgaaattcttacatttttagaaggaaaaaaaatgaaaattgataataatgttataaatgaatcagcaaaatctggaaatttatatcttgttaaatattttcaacaaaattatcaacttccaaataatgttttagtttttgctacctattcagaaaatattgaacttattaaatatatcttagaacataaaggatttaatatcaatgcaaatactattcattttattaatatttggtttattttttccatttataattaattttaatattttaatatttgttttattaatatgggatttaaattaattatttgaaattggttttattgatttggagttttttccaataattttttacatcacttctattagcaataagagataataatttagaaatagtaaaattacttttagaacaaagtggaattgatgtaaatgcaaaaactatttgttttgattatatagaaattgctttaattatttggcgtttatttaataaatttagaaattgattctttaatttagaaatcgttttgaaattttggaaatcatttttataatttggaatttaaattacaaatttgaattttatttcaatcattttttacatcgcttcaattagcagtccaaaacaataatatagaaatcgtgaaattacttttggcacataaagatatcgatgtaaatgcaaaaactgtttgttttaataattaagtaattgctttaattttttgggacttatttatatgatttagaaattgattttttaatttagcaatcgttttgaaattttggaaattatctttataatttggaatttaaattacaaatttgaattttattttaatgattttataaatcaattcatttagcagtccaaaacaataatatagaaatcgtgaaattacttttggcacataaagatatcgatgtaaatgcaacaactatttgttttaataatattttatttgttttaatattttggtatttctttttatgatttagaaattgttttaatattttgttatttgttttattaaattaaagtttactataaaaacttggagtttgtttgcgtaattcgaaatatgttttaataattgtatacagcacttcatatggcagttgagaataacaatgtggaaattgtgagattacttatagaacatcaaggtcttgatattaatgcaacgactatatgttttaaaaatttataatttattttaggaatttggcttttattttgataattagaaatttatttaaatgttttaatgttaaattataatcatttcgtatttattttaataacatttcacagcacttcaaatagctcaacaaaaaggttataacgatataataaatttacttcgcgaaaaaggtgcgaacaagaattctaaggaaggaccttcttccaatgaactcaactctttattttcaagaagaattgaaaaaaatattacaaataatcgaaatcaaactgttcttcaagtgaataaaaaggaaaacattaaaaaaaaagttgaaatgagcactcaaactcaaacatgtaaaaatcaaattcacaaatcttcaatttttcaaataaatttatattgaacgcattggagatgtaaatgttgtctcaaacctaaattgcatcactcaaaggtttatcattaaatcttatataataaatcacagttgtagaacatttttgttcaatcatatcaatattttttggataattataatcatcaaatagattatgtgttgcgattttgttgtattaaatattaaattcattaaacatcttccaatcatttgatgatggtattggagttgcagaaatgtgttgaacattgagctaataagctttactctttgaaaataaccaatgaaatttcatcatttatacattttatggtttgctattgtttcgaaaagtgaaaaatctccataagaaagaagcaacccaaaattttaataattttttgtctgttcagagggggtgacaatcacatcagacgatcaaaatttattcatttatgcacgataaaacgtcaaatataacacaaaaagtaaaggattggaatcttacaccgaatatttacgactcaaaaatctcgattatcgcacaataattgaatggtaccaaaataaactattcattttttccgaatgaagttttattttacaacaacgagttctcaaaaattgtcaatgtgttgctgaatatgagttaaacacacaacgatcaaaactgattcgaaaagtggacgtcatacaaaaagtgaaattcacgatcaaaaacaagtgtaaaagtcgctcgtttgaatactttacattgcaaaatcaaaaattaatttttctcgaaattagtacctacgatttttatttaactttagtatattcatataaatatataatatattaagatattataattaaaaaaattctaccgactaaaattgataatatagtaatttgataattcaatatatatatggtcaaaacttttgctcgaatgaagtgccttcttcgaaaaaaaaattccgacttcatccgaaagaaaattttttcaatgagctcatcaaaaaattgaatagtttatcgaatagggtttctttcatcgttttcctctcaaatccgattgtcatcccctctgtctgttcgaaataatttgaatggctcgtctactaaaaaaacgttatattctgaaatttaaatgtcactttttaagccatggctacgtacaggtcctgtattcgatttatgaacaaagactcacaatttattccgatttcatattatgcacgttgagttttattttgaggcttggtatcaagcaggtttgtaggttatagctagccgtttattaacggtcatcaaagaaaacacgtaaaagtgccaggagatgggctttcaaattattaacgttcaaagatctctacggttttcacttcacctggggcgttttttgttgtgcgcggcgcttttgtgctgagtggtagcttaactcatgaaacaataaaggatcataaatttcagaatgaatgggaagtgttactagtgatcaagaagctcgtttttgatttgaatgaagaaaatattactcaatcagcaaaatcgataattgacaaatttgaaaaaaatcatactatttcattatatttaattattatccatatgatatatactttatttgttctaaggaaaaaagattatgatatatatttgaaatttttaaaagaaattataattttagaagatgaccaaacaaaattacctcatgcattaatacgtttcatttctcttaaaaatactcaagaaaaaaattatcttatttataaattacttgaatatggatttatccatccaaaaatcacaaaagacaaattttcactgaatccatattatattcaatatgcatcaaaagaagaaattgaaaacccaattatttggtatttcatgaaccaaacagaaagagaaaaatttgaagagaattatgaagaactttcaaagaatgattgggaacttcataagaaattaattgaagaaggagttaatcagaatgaaattgcaaaaataattcgaaattatgaaatagaaaaacttcaagaaatttcatcacaagaaaactttgattttaatcaaacaattgaaccatcactttatgaaagatgttctgttattaataaagaaaatgttacattaattgattatgcagcatttttttcttcagttaaatgttttaaatatttacttatgaatggtgcagaagtagataacacagccaaatatgcagttgcaggtggaaatttagagataattcatttgtgccaacaaaataattcatctttttataaagcatatgaagctgcaattaaattccatcgaaatgatatctttaaatatatttatgaaaataaactcgaaataattaatgattttgaagaattgggtattgaatgtattgtaaatcttaattatgaaatattttcttttttagaaaaagaaggaatgaaaattagtgattcgattattgatgaatctgcaaatattggaaacattttacttgtaaaatattttctaaaagaaaattcattaccaaatgatatttgagtttgtgcatcggtttcaggaaattctgaacttgttacatatattttaaagcaagaggggattgagattaatcaaaaaatttatttgtttttgttaaaatttattatgatattttgatatttcaaaataatttttggaaattatttaaattatttaaaacagcacttatgtttgcatctttaaatggtcatatagaaatcgttaaattacttcttgagcaaaaaggaattgatattaatgctaaagatatttatttgttttatttgaaatttattttgatattataatatttcaaaataatatttggaaattatttaaattatttaaaacagcacttattttagcatcttcaaatggtaatacagaaatagttaaattacttattgaacaagaaggaattgatattaatgctaaagatatttatttgttttatttgaaatttattttgataatttcatatttcaaaataatatttggaaattatttaaattatttgaaacagcacttacgaaagcacatgaaaatggtcatattgaaaacgtttaattactttctgaataaaatcatatttaattttttttttaacaatttcaaaatgaggtcaaatggcacaaacgatcacgatttgcggctacactttaaattccatataagattatgaatatcgaaaaagctttggaagaaaatttctgagcaactataacaactgctgagctcactcctcagagaacttactattgatgatattcacggcatttaatgatttgagtttcaaccatttgatcaattttcaaattacttttgaaacttcaggatctttttatgctctgatgaattatttacaagaatatcattaaatattaatctatttctttttatcgaataatattttgattcattaatgtttttttctcataaatttatgttgaattcaacatgattcagatctagatacaggctttattctgtatagaagttccattgcttcttttggataagaagaaaaattatttttaatatttattcgaagagatttgtgacatttttttgatttaaatttttacatgtgcaaatattacaataataaaaaataatatttgagtgaaaattggttgtatttataaaagcttaaatataaaaattcaatatttttatttgagtgatatattaatcattagaaaaaaaaatattttatgtgattttgttctaaggatatattagtgaagcaaatataggaatcttctttaagtaatagagcacgagttttgcttttaatttaagcatattgttattacacataaattcacaataaaaatataaataatacaaacaaaatatttatttcggatatgccgtttgtgaaagaacttttctcaatccttcatatttacttcgaatagattcatattgttgtttataatatgttgcaagatttttgtcattcggtggttgtgctttccctttgcgaacggtgatggttggacttcgaatttgaactggtttaagttcaggattattattattattactcgaaatagcattattactattatgtcctcgtttgttttgtgtatcattgttcatagtaaatgaaagttgttgttctaactcttgaatttgtttctcaagaagttgaatttgaacggttaagtcaatgctttgatgttctaaatctaaaacatgtgaacgtagatatcgcgtatcttcatcttccgcaagcgatggtaatggtttcaatccattcgtatgaaaccgtcgttctttagttcgtggtgaacttgaaagtccagtaagtttaattggttttggaagtgaaactgggtcaaataagatagaatcattatcttcaatcgtttttaatttcttttctaaatgaattttattttgttgtgtcaaatcaagcttgtaaaaaaaaggaaaaaaaaaatgatctatcggcaaacactctttgtcaatatttcattataaacgtttttttatatattttgaaaattaaaatcatcttcttttgctatttatttgaaatttctctctaaattttttttttttggttattattaataacctgatagcataaggtgtaacttggttaccaaaatataatttagaacttcaaattaatttaaaaaaaaaaaaaaaacttcattaacattccttaaaaaaacaaatggatatgttcagttctattcaaagaaaaatcaaaataaaaacataaaattaaatcaaattcgcaaagtatttagtaatattgattatagtagttttgtgggatttcatttgatgaattttcatctctttgatatttaccttcactcaaatttgtggtttgttcttgtgttgtttgctttaattcttgagaatcaccatagtcgttcattacaaacgcaacgataaagaacaaatgcgttatgaaaaagaatgggatcaataatgcagtccttgagcgtggtttaatacattcatcaataagtgaagtataatttttggaattttgtaagcattctttaacaggaacaatactgactgtcatatcttgtaagataaatattacaaatgcaataatgacggtaaaccaaaataagacttttgttgcacactttgaacgacacttatttcgaacaacaagtgttataattcctaatacgacttcaactgatgatacaattattattgcaatagagaatgcaccaaaatctacttcaacaccactaccatcttcatgtctaaaaaaaaacggttctggagaataagtataccaaaagccataattaacataagtcaatactatcccgacaaagcaaatgaagccaagaaatattgtgattattttggattttgtgcatgtgaatattttctcgtttaaaatcattttaaattaattagtcacttttgaatacagaacagaatttttctgaggtttaattgatcgttaaaatcttgaaattatattttaaaaaaagaaaaaaaaacatacaaatattttttattaatttattctttttattctatatcaaaattaaaattttgaatctttttgttgctttgttcaaggaattctttcatttcttttcgatcatatttaatttgttcttcaatagttttatctaaatattcttcaactggaatattttctttaataaatggatttaatattgtactaatttcaagaataatccctgtgactgttttatttcgatttaatcgttcaatccattgattaaatgatttagatttaataatccctttattaaataaaaaagaatatgtaaaaattgtaataccttttggctcgtaattatgacgacgaaaatatttatgaaatcgttttaatgtatgaatttggatattatcattgttatctcgaataaatttttgaaatattggtaaatatccttcataataatatttaatttcttcaaatcgttttttatcaagttcaagattcgtaatatcttcaaattgttgtgttaatattttatcataaagatattcgatgaaaggatcaattaaacttttttaagattcgtttagataaaaaaaatactttttaatccaatgttttcaatataaataatcgtggtgtgaatatctttaataccttttaaatattgataaataaatccataaataattaaatatggaacgaaattactaatatcagtactaattaaaagtcctggaatttcttctggataacgaaaaacatgaaataaccatttagtttgaaataatttgtgtagaagataaaatatttcattcgatttaacaacactatgaatacttgcaataagataaataattaaatattctgaaaaaactgatggacgaaatattgatatcgatttacgaactgatttatatgatatcttttcttgaataattaatgtagtaagtaattctaaaaattgtaaactcgtgggaactaaataaaataatttactttctgaataaatacattcttcaaatatattactaataacattaataagtgtattactaactatattaggaaaatttaaatttgaagaataatttggatttaaataacttaatattgatttatgaaaaacactgttctctaattgaataacttctaatattgcttgcgttaaaaaatattcaatagttcgttgaaataatgtggtggataatatatttttattaaaaacataacttaaaaatgatgttggtgtaagatcttctggaataggtaatcctttgtttttaagtttttgatattgttcttcaatattaaaggaatgttcacttaaaaaaagatgatattctccacttggaatatttcgtgcaaatgacaattcaattgaaatacttcgttctggtgatttaagtaaaatattatgattcggtgaaacttgaagaactgtttgacaaacagaattaacttcataataattatctttttgatctaatgtaattataaatggttcgttacattctgatgatttaattttaagaaatgttggcattgatttttctgtatatggatcattcctttctttcattattattgtggatgttaaataaacggtctcaaaacagaatttgcaaattcagatcgagaaaatcgaaggattgatcatgtatgcattttcattgaaatgccacacaaaattcaaaaaatatggtaatataacacaaaaaaaaatttacactgcttttaataatcatttaaatgttttggcatttcaaaacccttttctctttcaaaaacttcaacaaatgacctcacctacatttttcgaaaattaataataataagtaaaaaaaatttaatggataatatgcgaacgaagaatgaattcaaagaaatgaatttctactaaaaaagtatttgaaaaagtatgtttgcattttgatataaaaccgtaaatttccaacaacagataacagaaggaaaggaaaattttctttacattcaatattgtacatcagattttcctcgagacatggggcttaccattcgaaatttcactgatgtatctttttcagcaaaaagaagtttttattttgatatagaataaaggaataaatgaataaaaatatttgtatgtttttttttttttgaattaatataaaacagagttacttcaactcccaaaaaacagatttttttttccattccatatgtaagcattccatgattgatacaataattaatattttaaattaaaaaattttataaactcatgaaatatattttttaatcgatttttttaaaatttattttttccagtcacccatgattaatttatgatggattttatatcgtattgatttgacaacctgatacccaccagggaaaaaatattcattcaaatttttcatcagttcccattttttaaaaaaaaaaattgatgtaaaaaattatataaagtggtgacctggtttattttagatatttattttcagcacaacttagaatcgttgttttagaaattatataaataaattttattgaaaaataagaatgaaaatattttataatcgaaaaagtgtcgtaattttcaaaatatgaaatttttgcaataaataatgaaaattaaaatataataaccaacacaatcgaattctattatgtcatcgtattataatatatatatatcagaaaataataaatttttattttcattcataaaaatgaaatgatcatatatatttatatgttttttttttttttttttttttaatattttttcactttgatgataacataatatgttgaaaattaaatataaataattttgttttataacataatgttgtagatatattttcattttttaatttttgatgaaaaaattatgagtaatagtaatcgacacgaagtgacgtcacttttgtattcgacacgtaagttttatcccaattaaaagtgccaatatgaaaggagtttaaaaaaattttaatatcaaatttttaaaaactatcaaaaattccgaaaattattacaatctttcttaaaatattcaaaaagtacatttggtcatcaaatatgatagaatcttataagttcagatgaatggaaaacacaacattagatgaatgggataacacgactgatacttcagaaattataggtcctgttctacctaaaaattgggaaatgtcgattaacttacaagagacttccccttctgatatacaagaaatgttcaagcaaaatgttggtcattattcactcacaataacgaaggtctttggccaatttgaatattgcgatttttggtgtcgttttggaggacgttgcaaaacaaaaaaaaaaccgtacgctaaaacaatatgatcgcaagagcttcataagattgaaagttgatcataatttatcaaaagttatgtttgttgaaggcaattttcgacaaaaacatccaatatcacaagatttctataatagttggttgggtccatcaaattctacgcgaaattaatgtataacttacactaaacaacgagaaaatgctgcataaatcagaaggaaaataacataatctgtcagtgtccggaaattttatgatatcagaagttcttatttaaaatcaagaaatgttgatacaatcaaatcaatccaatctattattcaacagttatcaaataattatgaaacgagattacatttgaacagagcagataatcaaattctcacagcaacatttgtttcaaggaggtttaaaaataaaataatatctatagatatattgcaaatagatgacataatgatgactaatgattttgatatgcctattctaaatttcttattcattgatgagaataataatccacagatactagcattttcaataatgtccagtaaagaaaaggaaatatttaaacttgtatttgatgatataaaaatatagttggcataccaagagttgtaatcattgatagactaaaagcacaaaaagcagtaattgaagaggtaatgttaaatactatgattgttttttgcaaagttcatatgatgagatcagttgaacaaacatttggtcctcaatctataatatataagtcatttcataaattcattgaaaatcgaatatatcgtaatgaatatattaattctttaaatcaaactattcggagtactgtcaaaaatacaagagctattcaagcattaattgatgatgccgattgttatgatcctagtttcttattttctggaaattcgagagaacaaagaacgactaatgcgattgaaggtttaatggtaatatacgggaaagattagatgtgaaaagagatattgagattattataaatatattggattatttatctacagaatttgcttggcgaagtgagagaatgctcacagaaattgacaataatatttataaagataatattataggttcagtagcagtaaataaattgaaaaatgtagtcgaaattgctaagaaaactaaaaaacaaataatggatggaagagctaatatcgaattattgtaatgtattaatgagaagaattgcaaatgtattacaaagattgaatatggtctcccttgtgttcatgaaatcattaatcgtttaaataagcaaatcccattaatatcacaaaatgaaatatatgagatttattttaaaaaattgtaccaaatacaggagaacaatttatttataaataaaatcataaaacatgtaattcaagaaatacctcattatgatctgagttactactctttatttacaagagcattcgaagaaattgcttcagttgtataaataaatgatagagttaaagtactagttcttaaattatatgattaatctaaagatataaattcaaatttattctctggaagaaaaaagacaagaccagcatattcaataagaaggtcaggaagatatagtcagaaaagacattattcatgcagtatatgtggaagatcaggtcacaataaagcaacatgtccaaatctacatgaagagaatataaacgaaaagttaacatttaaagaagaaaaaataaatgaaaacaatattttagaaattgaaaaaaaataatagaagacaactattcagaaatggaagaggaaagcacaagaattgatattaatattgaaaatggagaaatgttggtcaatttaacacctaaaaaacttgaaatattagaatcactgtcatcaaatcaattaaagctatttcaaagataatttgtttttcatgtgtttttgtttgctataggacgaaaagaaaatccacgagacatagaaacactgtatggaatttatcatattcaatggaaaacaataaaagagattatacaaaatcagtttatggatgtctcagatgaaataggaattatacaactaatatatataataaattatggtaaaaaattagaagacaattttatgttaaatcataatatatcttaattgatattatatttagaaacaatacctgattcactataataaaaattatattaatttcacatttgtttaataattcataaaaacatatattctaaatgagatatgattaaaagggataaaagaaaatagttattatccatcaattccacgaaattgtcgaagtataatcaaaatttcattttatttatgatcttgcaactaagaataattgacattttattatttattgtgaaattcttgataaatgacattgaattatcataattaactttcttcaatcttcctaaaacatgtcgattttttttaatttcctcatgttagcacttttaattgaaaaaaatttcgtgttgaacgcaaaagtgacgccacttcgtgtcatttaagattccccatattatgagtcttctatttatatttagatttttattcgggatcaattacacaaccgcagaccaaatctccaaatcctctcaatcgattttttaagggtaaatttcgaacgataggaaacgatcccgctttttcaaagaaattatcattctttcaatttgattttcaataaaaatataattgacacgtgttttaaatgaaaatagaaaatgaaaaacggtttgacaaaatataatccgattaaaaaacattaaaaaagtgatatatgtcataataattcattgaatactttatgataacaactttttgaatgagttgttttacacatgtgtgcttgtttgtgatgtatggctaccatactaacttttaagatacatatgcataaatcaagctatattttgaatacttaaaagatcaagaaaaatatgattgacaatattgaaaaacaaatcatgaataaaaattggaatatgaataaaaaatgtaatatgaataaaaacaaatcatgaaaaaaaatgaaatatggataaaaaatgaaatatgaataaaaaatgaaatatgaataaaaacaaagcataaataaacaataaagcacaattaaaacgaaatataaataaaagtaaagcatgatcaaaaaataagactcattaaaacaataaaaattataaataagaatcaagataaaaattgattttttattcatattgaatatctctaagtgctattagaaaagcattttacaaattttctttgttttgttttagccaaataaatctaaataaataccctccaatatatttttgatttttataaactgaacacagtccacacttgataccattccatgtttcctcaatggtattggtatgtattccttcatcggatttaaatccttcggaatggttcacttgtttggatgtgtaattacaatttagatttttgtttaaatattcgattgctggcatgtatgcactccaacaatctgtatatattattgatcctttttctacattaaaaaaaattatattagataaggtttcaatgtttctactgtttaccttttgtgcgaatagtttcttctctggagttctctcaactcctcccactacccatgatccttctactggatgtcctctatggtgcttatttttccgaatttactttcatctatctcgacgataatgttttcaccaccaattttctgtaaattatcctttatttgaaatgaaattaatcgatcaaactcatgataataattacaaattgttgtaaaagaatgtcctatttgattctgtacagaagttacattgattttatttatccaattatataaaagacgcattatttcgttaattggcaaatgacaattgtaaagaaaagtattttttgtaatagaatatgtttttcgacatctaggatttgtacatctaaaaattatgaaatgcctggtgcaagtgcctttgcaaaaatcgcatgtatatgtatcaggtaaaacattgtaaaattggagatatctgattgcaatttcttcattaacaaaaattttactaatttcatcataaaaggaaatggatttttgccttgattgatgttgttgtaattgttcttgtgtataatcatgccgtccttccattgttttttaagttttatccaaaaatatacgcattctcatatggtattcaatggattattgtgacatatatcacttttttaatgttttttaatcggattatattttgtcaaaccgtttttcattttctattttcatttaaaacacgtgtcaattatatttttattgaaaatcaaattgaaagaatgataatttctttgaaaaagcgggatcgtttcctatcgttcgaaatttacccttaaaaaatcgattgagaggatttggaggtttggtctgcggttgtgtaatcgaccctttatttgaatccgactgctagttttttttaatttgtgattttattttaagtgcttcttgatgaaacctatcaaaaagcttttatcatttatctcaatttccattttttgaattgccgatcatgtaaaaacgttttcattcaaaatattccgaaattgtgtaaacaaattattttttattagagatagtaatcattatttgcaatgttgaattcaacatatatactaagaaagggagttccaagggttcgaaagtggtagtttccgtagatttaatatgaaaaaaattattatcaattattgataaaatttcacgaatggtattcaaaaagggaaaaataagtttgaaaataagtaagtgttactttgtatatttgaacttatcgccactaaattttattttaaaaatcaaacaattcttcaataagttcattccctgcaaataaatcgtgcagcacgaatagatcttgtggattaatatctattgtttcatttgggaaagaatccatctccaatttctttttcaaatgattgttaaatctatttttaatcccgttgttagtccttttatttttaaaatgttctgcaataagtgaccagttaggtccgtatcttctgtatagatagagaataagttgatcttcttcctcagaccatggatcttttgatagtcccggtgctaaataatgctgatatctatctctacattggcgacatgttttgcctggtatagattttgcaatttcttgccaatttggaaatttttcatttccaactaattcaatgagttgtttatcttcttcttttgtgaacttatgcttaattatttttgctctcttgtaaggcgcttcttgggagatatatggttgaaaatggacacagttttggaacgtcatcgcaatttgttatgtgataaaaaatgtctaaaaacattgaatgcattcaaccacagaacatgtcacaactggaaaacaagcactcaaaaatcgtactcaaattcataaacaacaggttaatcaactgttgttgttttgactctttcaaaatttcaattcattgaataaatgaattcattcaatttgggtcataaaacatgtcacatttgtaatcattttaaaattaaaaacatgaatatttaatcgaatattcaaatctacataataaaacataaatttaattatcacatatattacattatctatgtttatcaaaatataaaagttatcgcataataaatgacaagatatttatatttgataaaatgcattttattgcatttatttaaatatcggtttgactctaacctcctaaatattcgattgaatttacaattatttgtgcgaattatgaggtacacatactttcaatcttccctcagacatatgatttttcattcgcttgaatataaatgtggaaaaaagcattattttcaatcgaaatcataagatataatcgatatagatatagaacattttttgtattactttcgatttacttagtttactaactctattttccctaatttcgaatgagccattatgaaaaaatgctttttttattctgtaaactttcacaaagtgaatagcataagttatagtaaaaatgagataataatttttccccatacaagttggtgataaactcgcacacgtgcatttgcagtctagaaacattggtgtcacaaatttggtgacatgataagcacaaaattcggaacgtcacccttaaaccctaccagtttaatcatcatagctttttccatacgatattatcgtgtgtagccgttttttgaattaaccgttataccaatccaaccgtagagtgtttttaaagaaacatttatataaactattcaaaatatttattgacacttttaagaagatatcttttaacggtccccaatagctgttcggagatgaaattcgttgttacttccaaaaaccaaatgaaaatagatgccgtcaaatcagtcattcaaaaaatccttggaagcaatgatgaatttgttgttgaaggaatttcttcttcatcagatgtttctgaacaaccactttctcttgaagaaacaaaacgaggctcagttaatcgcatttataatgccaacgtagatgatgccgatttttatgttagcattgaatcaggtgttgagcgggagtttgattcattttatggatttacatttgcaacagtttgcgataagacaaaaaacaaatttggatttggaatgtctactaaattcccaattcctgatgatgtttcattcggtcttgaacaaggaaaatctctctcatcaatttctcactccgaaaatggccttatttccattttaacggacagttttattaagcgttctgatcttgttgaagaagccacatgcactgcacttattccatttcattttttcccaatttcatttccaacaaactctccaccagaactcacgcgctttatagacagcatcactcaagtcgagaagaacaatctagcatctcaattacgtcaacttgatttccgagatcaaaagatagttgattcctctaccacagcttcttctctttctgttgtggaaccaccagctgactacagcgaagtttccgacgacatatttgataatggagtcgaagccatcaaagcgggtgaagtggcggttgtcatcatgtcgggcggtcagggaagccgtttatcagctccagttcctaagggaatgatgcaacttgacattccctccaactcgagcttacttgagcttcaactccaacgtgttcgtaatctggaacgtaagtactgttcagggaacacgtgtattcctgtttatatccttacatccgatgctacacattcgccattagctgcatatcttataaagaatcaaaacttcggagtgaaacatttaatgcttgtcaaacaaaagacgcttccagctcgttcagctgatggacattttgttctcagcgaacgatccaaagttctcgctgcgccaaatgggaacggcgcagtctttgcatgtcttaaagactccggtgcactttcagagatgaaaagcctcggagtaaagtacgtcgatatccatccgatcgataatgcgcttgcgaagcctgcagatccatcgtttgttggcgcaatgatatatgaggatggcgatgcagcgcttaaagtcgtgcggaaagttggcggcggggaaagaatgggaacagtctgtacccgaaatggtaaaacagctgttgtcgaatactcagagctaccgcaaggacaagcagagcaatacatgtacggaaacacagcaatgcatttgttcgcaacagagataatagagaaagcggcagaagccgagttgccatatcatgtcgcgataaagaaggaaaaggtggtcaatgaaaaaggtgatatagtagtgggtgaagtgaggaagttcgaaagattcattttcgatgcattggaactctgcgaaagagtcgttctatatgaagtgaaaagagatgatgagtttgcgcccgttaagaacgcgcagggtgccccggtcgatagcccagaaaccgctaaggaacttttgcttaaacttcataaaaagtgggcaattgataacggggtggtactaaaggagaacggtgtaatagagttcagcccattaacaacttacgcgggtgaagggttggaatacttcggccttgatggaaaagtggtggataagccaatggtcatttgaataataaaaattgaatggcaaattcgccgattttgattttatggaatattccaataattggtgagtttggtctcatttgaaacaatgtaaattggtattcattaaatattggaatataattttcgtatggataaaaattggtaaaattagctagaaacaagctttttctagatataaaacttcatgttgtatagcaaatatttaacttcatataaatccatcgatcgattatcatcttcattaattgcataattttttttaataattacaagaattaaaacaagaattgcaattgaacaacatttaatacaaataaaaatttttgttgtgatcttattactattgcttttatttttattactattatcaaatttgataataagttgaataaataatattaatatattcataataaataattttagtgaaaccacaataaaatgatgatttaatcataaaataattaaggaattccatgtgtgaatataaggtgttgatttgtattcatcaatcacatcttaatttgcaaattttccgaatatattggttatataattgcaaatgttattaaaacattcactttcaattgttggcgaaatgtctccatataaacaaatgcattcaaagagagaagaactatataaaaatcgccacttccaaaatttttcactatttctccaatgataatcgtttcgaattgtttgcgtgagtataaccatcaataatattatcatagaaatggataataaaagacttttaattatatatttccattttttccatacaaattcaataactgcatttgtacatttcgttatcaaataaatactttatgaacaagtgcatattttctctatcgtaatttgcaaattctgtttttgagaccgtttatttaacatccacaataataatgaaagaaaggaatgatccatatacagaaaaatcaatgccaacatttcttaaaattaaatcatcagaatgtaacgaaccatttataattacattagatcaaaaagataattattatgaagttaattctgtttgtcaaacagttcttcaagtttcaccgaatcataatattttacttaaatcaccagaacgaagtatttcaattgaattgtcatttgcacgaaatattccaagtggagaatatcatctttttttaagtgaacattcctttaatattgaagaacaatatcaaaaaacttaaaaacaaaggattacctattccagaagatcttacaccaacatcatttttaagttatgtttttaataaaaatatattatccaccacattatttcaacgaactattgaatattttttaacgcaagcaatattagaagttattcaattagagaacagtgtttttcataaatcaatattaagttatttaaatccaaattattcttcaaatttaaattttcctaatatagttagtaatacacttattaatgttattagtaatatatttgaagaatgtatttattcagaaagtaaataatttttatttagttcccacgagtttacaatttttagaattacttactacattaattattcaagaaaagatatcatataaatcagttcgtaaatcgatatcaatatttcgtccatcagttttttcagaatatttaattatttatcttattgcaagtattcatagtgttgttaaatcgaatgaaatattttatcttctacacaaattatttcaaactaaatggttatttcatgtttttcgttatccagaagaaattccaggacttttaattagtactgatattagtaatttcgttccatatttaattatttatggatttatttatcaatatttaaaaggtattaaagatattcacaccacgattatttatattgaaaacattggattaaaaagtatttttttatctaaacgaatcttaaaaagtttaattgatcctttcatcgaatatctttatgataaaatattaacacaacaatttgaagatattacgaatcttgaacttgataaaaaacgatttgaagaaattaaatattattatgaaggatatttaccaatatttcaaaaatttattcgagataacaatgataatatccaaattcatacattaaaacgatttcataaatattttcgtcgtcataattacgagccaaaaggtattacaatttttacatattcttttttatttaataaagggattattaaatctaaatcatttaatcaatggattgaacgattaaatcgaaataaaacagtcacagggattattcttgaaattagtacaatattaaatccatttattaaagaaaatattccagttgaagaatatttagataaaactattgaagaacaaattaaatatgatcgaaaagaaatgaaagaattccttgaacaaagcaacaaaaagattcaaaattttaattttgatatagaataaaagaataaattaataaaaatatttgtatgttttttttttttcttttttaaaatataatttcaagattttaacgatcaattaaacctcagaaaaattctgttctgtattcaaaagtgactaattaatttaaaatgattttaaacgagaaaatattcacatgcacaaaatccaaaataatcacaatatttcttggcttcatttgctttgtcgggatagtattgacttatgttaattatggcttttggtatacttattctccagaaccgttttttttttttttttaagatggtagtggtgttgaagtagattttggtgcattctctattgcaataataattgtatcatcagttgaagtcgtattaggaattataacacttgttgttcgaaataagtgtcgttcaaagtgtgcaacaaaagtcttattttggtttaccgtcattattgcatttgtaatatttatcttacaagatatgacagtcagtattgttcctgttaaagaatgctttacaaaattccaaaaaattatacttcacttattgatgaatgtattaaaccacgctcaaggactgcattattgatcccattctttttcataacgcatttgttctttatcgttgcgtttgtaatgaacgactatggtgattctcaagaattaaagcaaacaacacaagaacaaaccacaaatttgagtgaaggtaaatatcaaagagatgaaaattcatcaaatgaaatcccacaaaactactataatcaatattactaaatactttgcgaatttgatttaattttatgtttttattttgatttttctttgaatagaactgaacatatccatttgtttttttaaggaatgttaatgaagtttttttttttgaaaattaatttgaagttctaaattatattttggtaaccaagttacaccttatgctatcaggttattaataataaccaaaaaaaaaaaaaaagaaaaaatttagagagaaatttcaaataaatagcaaaagaagatgattttaattttcaaaatatataaaaaaacgtttataatgaaatattgacaaagagtgtttgccgatagatcattttttttttccttttttttacaagcttgatttgacacaacaaaataaaattcatttagaaaagaaattaaaaacgattgaagataatgattctatcttatttgacccagtttcacttccaaaaccaattaaacttactggactttcaagttcaccacgaactaaagaacgacggtttcatacgaatggattgaaaccattaccatcgcttgcggaagatgaagatacgcgatatctacgttcacatgttttagatttagaacatcaaagcattgacttaaccgttcaaattcaacttcttgagaaacaaattcaagagttagaacaacaactttcatttactatgaacaatgatacacaaaacaaacgaggacataatagtaataatgttatttcgagtaataataataataataataatcctgaacttaaaccagttcaaattcgaagtccaaccatcaccgttcgcaaagggaaagcacaaccaccgaatgacaaaaatcttgcaacatattataaacaacaatatgaatctattcgaagtaaatatgaaggattgagaaaagttctttcacaaacggcatatccgaaataaatattttgtttgtattatttatattttttattgtgaatttatgtgtaataacaatatgcttaaattaaaagcaaaactcgtgctctattacttaaagaagattcctatatttgcttcactaatatatccttagaacaaaatcacataaaatattttttttctaatgattaatatatcactcaaataaaaatattgaatttttatatttaagcttttataaatacaaccaattttcactcaaatattttttttttattattgtaatatttgcacatgtaaaaatttaaatcaaaaaaatgttacaaatctcttcgaataaatattaaaaataatttttcttcttatccaaaagaagcaatggaacttctatacagaataaagcctgtatctagatctgtatcatgttgaattcaacataaatattagaaaaatcttgtatataatttctcaaaagtattttattcataagaatttattcttttaatgctgcaataaacgatttaatatttaaaataaaaacgaaacactcgagaacacattaaaatttcccattaaataaatgtaaatcatgaaataaaaacattttatcatttgttaatttattgagtactttcatttttgtctttttctgtcttttcatcttctaaaacatcttctgaatgattttctttattttgtgctgcatcttctgcttctttctgttcattttcattatttgtttctttgttttctgtcatttcttctttcgatttattttcgatttgaacattttctggaggaggttgagttttttgttgagatatctgtctagtctttaaaattgcttcaattttgttcagcctattcccgatggctattattcgctttttggaattttggattcgatcaacacaaatttggagatgtttcatcccagatggatacattggaagtgctgttaattgctttatcatgttaatgtcttcttgtaatttatccgctgctgctgccaacctttcttgactttgaaatgcatctttccaaattccttgtgctgcattgaaaaaatgaagaagtttctgatctaaagctttagccttttcgttctcttgtgaatttatatgttcatcttgttttactactgtttcactcatttttttatcagataaaattcacaactactgtgaattttttcactgcttaggacccaacaaatggaatttgttgatgaatctcaaaatttcatacaatcaagcgaaaagacagaaatagaaacagattcatcaaatatagagatgaaaaagcaaaatattattaaactaagagaagaattaaaatggttaaaattggaaaacttcgaaagtaaaaagcaagtaaaggaacttgaaaatatgataatgcaatacgataatcaagcaagtcaacttaaacagctttcttcaattttcgaagatatgatatcaaaaagtcaatttgatgataaaaatctcaaacagttaccgaaggatatgaaccgagcaattcaagctaaggtcaattccatttttgatattgttttacatgagtattcgtcatatgacataaataaattagaagcagaatggaaatctcttaatgatcttaaactctccctagaaaaagaaatctctattttatcagaaatttcaagtaacgaaagtttttttgatgatgatcaattatcaatttacattgacgaatttgaaaccaaaatgtcctcaaacgacaactgttctcctatttcttacatactatttagtgagcatatcaaatctccaaagatatatcatcattactttgaacaagataacacatcatcttcaccaacatacaccaacattccaatttctgatgctgtttcagcacatgaaagcgtcgaaaagtcaatttattcatcacaaattcgatttttctctcagctcaaaaatgcacttttacgtaatgacaaaacaattgaagaaattcctcaaattgacatcaatcaatccatgaatgaaatgatgtcatttgaaataccacaacaagagctctttaatgcatgtgatccttgcgaagtacttctttctcagttccaaaatttctacgaaacacttcaaaatcaaaacccgccaaacgaaaggttcaacctcatcaaaggaaatttcgaaaaggagcttgaatttcccgagtttgttccaccaccaaaacctcagtgtacaatagagcaaatcactacaaataacgaatcaaacaaatttttgcattcgcaactcaatcaaatgaaaattaacgcatcccaattgaatgaaaccgcatgtaatgtacagaaaaacgaaattgaaccaaattcgacgaccgtttatgaaaaagaagaaaattctttttcatatccaattccaattggcgataatgaacaaaatgatgatgaagtaatcaagaatttccatgatgtcataaaagaaaaaggtgttgaaattagtgaggactttcaatttgacataatagaaaaaaatgaagaaattgatatatcagaaaatacttcaaatgaacaaactaatacaggcattgaagcacgaatgaataagcttcatgagattctaactcaacaatcaaacatttcaaatccaaaatttgaaacagttccactgattccaacaactttaattaaaacagaaaagtacaaaacagatccgattttacagaccataaatcaaattctcattccaaatcagtatgatactgaaattctttccaatgagattgataacctttctcaaagaattgtggatatccagaacgcccttgcagcagcatcatcagaagaaacattcgacgactctgaacttgtcagatgcgaattcgaagcgaatgagcttatgcaaaaagtggcagccgaaaaggaaaaatttttcctcgaatcagctcagagccaaataacagagctttctgaaaagaagaaacaactacaaaccgaactctcacatctcgaaaaagaactaagtgctattgatgaatatacagaagaatcaattactgatcttgagaaaaaatatcaaaatgctaaaatagaatataacacaaagaaacaagaatgggaggaagagcaaaaactaagggcacaacttcatatgggatttgtataaagtaattagagatacatcggataaaatgttataatattatataaacttgatcttctattttgtttgtaaaattaaacgtttttcctgttattcttttctatcattgcatatttctttttttttgacgaactgtacaactgtaaaatcccccaaaaataaagttttcaaattatcatttgaaatatcaaaaagttatcacattcaataattctgtgcttaaacagagttcacaacaaatgtttttgtttattcttgggtttgcagtcaagtttaaagaataacattggtgtcagactccttgcacagcaagtgtagaaacagttaatgacgttttcattggaacacataaaggatcaggtagttattctttcaacacagaaacatacgaaattaattctggcgctttgttaactcttgatcttgatgctaagttttcaacggagcttggtttgtatgttattcatctgatgagaatgatactcacctcacatcaatatctcctggtacatctttgtttatatcaaaagaatctcattactcgcatacatttttaactccaaaaggaacaaaatatgttcgtttcaattttgatggaacaggtcaagaatcatttgagattcgtaattttgagtgcaacattcgtagttactataatttgccagattctcctaattttagtattgaaacagaaaaaatcaaaacaacaattaatatcgatactgcaataatgcaaatttatgataaagtatcaaacaaaacatggcaaatcctagctaaatccatagcaggaaatcctttttttccttgttaacccagttaaaacaggtaatacgaaattagaatttgatatgggaaatttgaatatgacgattattactcatatcacacttgagctttcagatgatgaaatgaaactaactttctcacgtgatccacaagcaaactttgatgataatttaccatattggcctctttttcaagcagacaaaaatgacaaacattttattccatatggagaaggaattcttatatatgctgacattaatttaaacaaagttaaatgggtaggagcaggtgttaatggtttatcaatgccatttattggaactacaaatggtgaatatgcgatgctcacgtatattgaaacacaagcagatgcaggacgtgtcggacttcttaccaatgatgatacatatacaacgattttatggagttgggaatcagaaaaacataaatggggatatgatcgaataattcgatattcttttttcccaggtaatcatgtaacaatagcgaaacgatatcgaaattatgcaaaagaaaaaggattagttgtaccctttactgaaaaaaggaaaacgcgtccattaattgataaatttatagggtcaggcctaatttattatgaaagttttcaacctatttgggaagaaacaaaattattaaacttaacaaaagaaatgcaaagtttaggaatggaaaaacttgtaccaaatcttatacttgataattcatggcatgatgaagaacgaaatgtactttatgaaatgcaaggagtacttacaagttcatatgaactattttcatcagtaaacgatcctgaatggattgaaaaaggatggactggatcaatttataattgtccagaaacatttccagatgccgtacaaataaatgaaacaggacaatttgttcaagatacatggccattatataatcgttctgaagaatgtcaacatgttcaatgtcctttagtttatgcatatgacgtctgtcaaaaatcattaccgagttatgtacgaaataaaattgaaaacgaaatgaaaacaacaaaaatcggcgctaaatatcttgatactcggaaggacctacagaatgttattcaagtagtcatccaatgacaagaagagaatcatctaaagccaaacaagaacttggaaagataatgaacgattatggatttgttgtatcgactgaaggtggtcgagatgaagctgtaccttattatgattatttacaaggtttaatgacttatggccaacatagaataattaataatgatccagttggttcaattccttcgaatattcgaaacgtattattcatttcaatataatgaaacaattcgtgttcctcttttcgaattagtgtatcatgattgcgcagcagctgcttggtattctgaagcttatatgatggttccttattttaataggaaaagagatttgttccaaatattaactggaacacctccaacttatttgtattatgaagataaatgggaaaatgaaaaatatgaatttgctgaacattttaaaaatggtacaaaagtgtttaatttaactggttatgcacaaatgattgatcataaatatttaactaatgatttaagggttcaacaaacattgttctcgaatggagtaagagtaacagtgaatttcggtgatgaaccatttaatggtattcttgctaatgatttcaaaattgaagaaaatgtagatgtatgtggttacgatattgatgaccaattaaatcaggctgatgattcaaaatggtggatagcattaatcgtaataggaattttagtaattgtcgcaattgtagctttctttgtatatagaaatatgaaaaagaaagaaaagaatgacagtggctcagtggatgtataataaataaaaataatatcatgacaaaagcattattcaatgtaaatgatggatgacaaaattagttttaattattatgtttatataaataaataaaattaaattaagatataacactgtcaaccaactttccctctcatagattacttttaaattttaaaattatttgtaatgtatctaatacatatcagattttaacatataaaaacagtagacatatttttatgaagatataataattctttcaaaatttcctttgaatttagtcactttccattcaaattcgtgtacgatacaatacacaaacggtcattaaagactggatgtaccaatgaaccacatctcaaccagtataaacaagtattgttaaaggaatgtttaaaatatttttatcttctgtttaattttgtgattgttgaccattaataccatgcggacagaaatttccggccgatggacagattttcgtgtccggtactgtatattctgggtttttataaagtttacaacgatgagatttaaaatattaaatcatatgtttttattcaaaaataaatacagacgagcgccacttcgtataaaagttgcatttgcataaatcttggagaagttgtttttttcatatattttcactttttctcaaaaatttcaataaaattgatcaagataatagtttagaaaataaacatatttaacatacaacattactatattggaaaacttccaaaattcccaaaaaagaatggtcgaaatcatatcgaatttggaaagatttcatgaaacgaccgtttacttttgaaataaatgagatctaattatcttttgaattgtaatatttttcaaaaaaatcataccattttaataataacaataataaataataagaacaaaaaaaagatttagttaatatcatttcctttgtattcacgtagtaatttaactatttctgtataaccatttgaagatgcccacataagtgctgtttgaaataatttaaataattttcaaatattatttcaaaatataaaattattaaaataaattttaaataaaacaaataaatatctttagcattaatatcaattcctttttgttcaagaagtaatttaactatttctgtatgacctttttcagatgctaaaataagtgctgtatcaaatattttaaataatttccaaatattattttgaaatatgaaattattaaaataaattttaaataaaacaaataaatatctttagcattaatatcaattccttcttgttcaagaagtaatttaactatttctgtatgacctttttcagatgcccatataagtgctgtatcaaatattttaaataatttccaaatattattttgaaatatgaaattattaaaataaattttaaataaaacaaataaatatctttagcattaatatcaattccttcttgttcaagaagtaatttaactatttctgtatgaccatttgaagatgcacacataagtgctgtttgaaataatttaaataatttccaattattattttgtaatatcaaattattaatataaattttaaataaaacaaataaatatttttagcattaatatcaattccttcttgttcaagaagtaatttaactatttctgtatgaccatattgagatgctaaaataagtgctgttctaaataatttaaataatttccaaattattaaaataaattttaaataaaacaaataaatatttttagcattaatatcaattcctttttgttcaagaagtaatttaactatttctgtataaccattataagatgcaatcataagtgctgtccaaaataatttaaataatttccaattattatttggaaatataaaattattaaaatagacgcaatttaaagcaaataaatatctttagcattaacatcaattccttcttgttcaagaagtaatttaactatttctatatgaccatctctagatgcccaaataagtgctgtattaaatattttaaataatttctaattattattttgaaatattatattattaaaacaaattttaaataaaacaaataaatatctttagcattaatatcaattccttcttgttcaagaagtaatttaactatttctgtataacaatttctagatgcattaataagtgctgtacataataatttaaataatttccaaataatatttggaaatattaaattattaaaataaattttaaacaaaacaatttaatatctttaggatttacatcaattccttgttttaaaaagtatttaattaattgtttatgattagactttgatgcccataaaaatgctttttcaaaaaaattaatgaaattttaaataaatatttatcacatagaattatgtaatttaacatcatcattctcaatcttaattcctttttgtttgatgagccatttcactactataggatttccatatccaagaaattgggaaaaaaagttcttttttaatcatttttccttcataaaatatatgtataaaatttccgcctgcaatcgcatattttaatgtatttttaacatttgatccattaattaataaaaacttaaaacatttaattgacttataaaatgcacaaaaatcaattaatgaaacatttttatgattaacaaatgaatgtttttcataagatgatggttcaattgtttgattgaagtcaaatttattttgagttgacatttcttgtaattcttctaaattatcatttcgaagaatctccaatatatgattttctttctgattttctttgtctgctttatttataattttttttagataataaaaaagatttgaaggtatcattttatggtcgttcatttcgttaagaagacattctgattcacttgtattttttaggtaaagataaatggttaataccttaagtagttttgaaaaacttaaattttttgtatttgataacaagtttaaaaatgaaatgtataattttgcatctttattttgggtaaaataagccatataaatacactgagtaatataaaattcatagagtaaaggacaacttggctgaacttctaatacttttgaaactttctgagaaattaattcgagattattttcatttaattctaaaaacaacttttcaattgcaagagcttcatcaggaacgagttgcaaaactgatggacttggtggaggaggaatgtccataaaaattatagaaacgatcataagtcactcaatttatcaaaaagtgaattcaaagtgttgctggaatgaggaagaaattcatcccagtaaatatactgatcttaatgaatataaaccaaatatgattcgctatactgttgtgtatgttgcgaagttcacaaagcctatgagcaattggcattttccggacagactggaatatcataatatataaatatattatatttatttgatcttcgaaatcgctgatagtgtaatggttatcatgtaggattgtcgttcctgtgatccgggttcgattcccggtcagcgagtttttttgctctttaaattaatattaacacttgaataattcataaaataaattatttttatcctaaaaaagacatcgataataagtataaaaaacaacaatagttcatgaatctaaaaaaatatgtgaattttagtaatttaattttattgattttcctaaaacatatattaaacggatagtatattcataaaaaaggtatttctgtaaatgttcattgtgattttaatctttttggtgttgaagtaattaatggagaaagaatagcaaatgaaataaatccgcttaatattggaacaaaagtaaaagctccattaaaaatcaccgtagaaatcaataaaacaagaagaagaactttttcatttgttggaaacatattggatttaattgttggaaatgttattgagtacaaaaataccaagcatgttagaacagagataggaccattcacattaaggttaatatttagaagaattaatattgatctgattacgacatcaattaaataagtagcaaatataattattattgtttttattgagccggatactaattctaatggctttattgataataaaattattaaagttataataaatgttggaatatttgtgagaaatattggagataaaagtggattatttataaaaatattatctgacttattgatttcgctttgaatggtaattccaattggtgtactaactaaatataaaacaaataatatggtaagaattggagagccaaaagccatttctggtataaaaccgttaagccaaataaactaaccgtttttgtacgtttaaaaaatcaaaatgaattttatagataaaatatggtcgacattaaaaaattttgcgaatggaggatttaaagatatctacaaagttgtatatgggtcaccacagtttccatattggtttacgtttcaagcaatttggtcatgctatgtcgtttgcagatcaacattacataagaaaaaaacagtacttttatggataattcaactaattattacttcacttatgatatttgcaccgcgtgaaatatttgcatttctttttcataaattatcaccaatcattcataatcctgtgattcttggaatatatattgttgtttttctttttatgactttagcaccaaataatatattctataaaatagtagatatttgttattattttattggaataatccaaggtgctaatcaagcaaggttatttaacttaatccttagaacagttaaagggccaagcaatatacaaaacctttcaattgcaattggattcattataatggatcaggtaattgaaattgttacaagaaagatatcaaagggagaaaaaacaaaaatgtcaaactaccttactgtcataaggacaggtcttctttcgattctattctggttaacgacacatcaaaatccccttacaaagtatattggaatatatcaaatttatattccggctttaatatatgcatttgtattggggttatttaatgcttctgccgtacttgattttggagaacgcgaaagaatcccaactccacctccaacgccaagaccaaaaagatcagcaacaccaactccatactctgaaaggtatccaaatgaaaggtattaaatattatttcttttttcgtaatttttttttcctccttctgaaatgaacgatactatcggtggaactgaatatcgactttttgttagaataacttcttttggaatgtcaacagaagaaacatcgaatgaaccagccaaaccaaaaacattaacagtggaaatggtacgaaaaagagcagaacataatgatggaatgctatcaacacttgaagaagttgctttgcatcaagatgaaattggcgttataaccaatgtattcgaaagatacacaccacacttaaagatcctctatctccagaataactacatcgaaaaaattgaacacatcacccttttacatgaactcgaatatttaaatttagctttaaacaatattcaagtaatagaaggcctagaaggttgtgagaaactcaacaaattagatttgacatgtaattttattgttgatttagtatctgttcaagtccttgaacaaaatatttttctccgcgaactttatttaattggtaatccatgtgataaatttcaaggctaccgtgaatttgtcattgcttctctccctcaactcacgacatttgacggcaccgaaatcactccatcagaacgcatagccgcgaaacgtaaatattcacaacttcttaaccaaatcattgaacaagtttccaaatgcgatactgggcattacactccagaagaacgcatgaaagcatggcaagaaatagaggaaacgaaaaagaagaacaaaccgccggagcctaacggtccatcgttccaaccgccaaaaccgcctgcgcctccaaacggtcccgatgaaaacggtcacatcacccaatgcaacacaggaaaatggaacttcaagtggtatcaagaaggaactaggctttgtcttgatacttctgtaccacggtatctttctacatcattgatagatatagatgttaatccaacatggattagaatagaggcaaaaggaaaagttttacaattagttcttcctgctgaagttaaaagcgagcaagtagaagctctaagatcacaagcatcaggtcatttggttgttaaaatggaattagaacatcctaatcaatcgcctgttgtacaaaaaaagaattaaattatattattataaatgaacttagtaaaaattgtgagtaatattttataaattgtttttttaattcgttctttcatgaaagtaatttaattcaacaaaacctttttaagaaatggactctctagagcaatagaaatgaaaaattttatataagttttttgggtatcttcaaaactggtaaaaataagagaggctttataaggaaaaaatataattcttgttgtgcaaaatgagaacgtttattcttttggtcgttgggctaaaccaggggggccccatatgttggaatgtctgcattcctcgaaaaattgttccattgggcttcttcaaagacatcaaaggatgaatacaccaaatacatgcctgagcccattgggtttggaaaaccgaagcctgtaaataatccaattttagtaacagttgatcgtgtcgatgttgctgttcaagcatacccaaaatatttaggaattgatgaagcaaataacgagcaatttttaagagttgaaaaatgtgttgaaactgatgaccaaacttcagatccttatgttccaattagcagagcatcattctgggatattcccgaaagtaaggaagaaagtgaagacgaagatcaaaacacaagtaatcttagcacttccaataaatccgatttgtccgacaaagaaacaaaaacagacgaaaaatcaaactcctttactggtcttatctctttaggtagcactacaagtacagattcgtcgttagataaaaaatcaacattcagcttcggtataaccaaatcagaaaatacagaaaagaaagatctaaccacaacagaaacttctacgtcagcaacgtcagaggaaaataaaggaaattcaatttttaatttcccaatttcagatacatcatcaacaaaaacggacgaaaagaaagaaacactaggatttagctttctaccaacattaaatacttcatttacaacaacaactgaggaaaagaaagacactccgacaattaatctcacaaccacagatacaacatcggcaacaaaacctgaagaaaagaaagaaacgacaggatttagctttctgccaacattaaatacttcatccacaacaaaaactgaggaaaagaaagaaacgacaggatttagttttctaccaacattaaatacttcatccacaacaacaactgaggaaaagaaagacactccgacaattaatctcacatctacagatacaacatcggcaacaaaacctgaagaaaagaaagaaacgacaggatttaactttatgtcaacatcaaatacttcatcagcgccaagccttagttggggcaagtcatcaaatacagatggcacatcaagttttagttggggcaactcatcaaatacagatggcacatcaagtaatagttggaacttctcacttacatcaggaacatcatcaaatggatggggcaatgcatcaagtacaacaggaacatcaagtacatcaggaacattatcaaatggatggggcagctcgtcaaatgcaggagtcacatcgtttaacattccgcctccgccgaaacaataatacataaaaatgatttatttttaattatttaattccgattgctcacattgaagaaattattggtttaaatatgtttgataatgatatttttatttgacaaaaagtttttctgatgcatcacaagccaaacctttcgcaaaagcttttgactttctccttatccgcaacagtaattacattataatggattctcttaatgtattccattatatctttaattgatggtctgtttaatggatttttatctaaacacttaatcaatagatttgtaaattcgtcacttaattcgatagttttctttaaatctggtattattccatttattctttcgaatggataacttaacttatttatatcaccaaatggatcctttccatccaacaaaaacaaaactgttagagcgaaggaataaacatctgtagcctttgttaaatttgcatttgaaaattgttctggcgaaaaatataacggatcaccgtagtcgtaaaccattgaaacctgtgaaagtacaagttcaaagtgtttgtttactaaaattgacgatgggcaaatattacagtgtaaaatgtcatttttatgtaagcattcaattgctgacgctaaagaaacaattgaaatgcttttcatcgtcgaattgaacatgtttgcgaatttttcatttgacacaacttcgcgaatattaccatatctataaaaaggataaacaacagatttttcattatatgtaataatcggcactaaaaatggatgttttatgttggtatattttgttaaaacagaattattaattggtatttcaaacgttttcatcaaaaatttgtttttaatttcagggaaagaaactagttgtgaaatgcttaagttagaataacccaaattcttttcaactttaacattatctaattctatatgctgaatgttcttttcatgaatatttcgtacatcataatcaatgataaagcgtttgttacgttcgttcatccataaaattgtaggtttaatataaagtgaattaacaataaaattagattcttcactttgtgtaacaaaaccacttggaggcatttcggagatacactcattcaaagtggctttaccttggtcatttaattctatgatataatgttcagtaataccaaatcgtgattgcgatatcgtaatttcgccttgttgagaacaacaaatcactgatttagatgcatttctgaagtcacattgtatcatgttaactacacttttatcctcaacctcaattacatttttcgaaaatagttcaaatttacaattatcgaaaaacacatttgaatctttcattacacggaaacctgaaaggcttctattcgagtaacattcaataaatttcacattagaatttcgaataattattggtaatgtaaaattacaaccttgaatttcggcaactgaattttcgaatgaaattgctgtttcaagtggaccactaaagttaacgttacaattatataagaaagttttagcctttgatttgatgtaaaatccgatgtcacttttgttgattgtaaagttatgaaaaattccacttgatcggtcttctaatataaccgctccttgatgtctatcggctatacaatttgacacgcgaatttgtgatgttcctgagccaacaattccgtgtttattatcacaaaagtatgcgtgatcaatgttaccgaatgattggccaccaagcattattgatgagtcatttggatttcgattaaataatgttccaattaaatatatttttgattgatcatttactatgattgattgatttcgtgcattttcgaatatcgaaaatttgtcatgatattgtgattgttgattgagtgcaatgttatattgttgatatgaaaagttacaagaaaatgtatataattgactgttttgagataacgtaattccgcatgtttcattgttcttaaatgtgctatttcgtacgtataatatgatatttgcttcggcatctccaccaaatgattgattttcagttatcgtacaattatcaatataaatgttatttttggcttcgcttttagtggttaaaacaaagccatttctgccattgtttcgaatggttgtgttagttaaaaatgaataattgcaatcttcgatttgaatgccattcgaacctgactcattgaatgtacaatttagcaacgcgcttttttgtacacgccttaagactattccgaccaatttatttttataaaattcgcaatttcgaaaaattaatttttcacctccaacacaaaaagcgccaatttcattgttattattaaacttacaattctcaaaaatgccttcaattccttcaaagaataaaccgcaattttggcaatctgataaatcacaattaattaaaagcagcatagattttggtttggttataatgcctttttgaattgtgccagaaaatgttgtgtttttgatgagaccacgtgcttcattttggaaaagaattgatccatttgaaatgagacaatcatgaattgtggtaactgtgttatctaataaaacaagaagaggatctctgctttcagttgaggtatgtgtgagctcacatttgttaagatacaaatgtccttttgaagatactttgattaataacgtttgtacaccagtaaatttacaattgttgcagcaaattatagctgatggcgaactttcaatacagcatgtttgtcttgtagtaaaagtacaattatcaaattgaatgaaacctgcaagagctattacacaaaagcctttactatcctcaccatcaacgcgaaaatcaattccttcaaaacttacataatttgtaagaatttcaacgatatcatcttctgtttgtgaaattgttactttaccattagcttgaaagaataaaggtcttgatatgttaagatgttcattatatgttccgctgttaataagaattgtatctccagcatttgaatttgaaattgcatcatttattgtattataatgtgatgatggtccaacttcgagtgttttgtttttaattggtttattagcttgttggatcacaaaagagctttcatttaatgtgtctgataaagaaagtatttcttcaagattgctattcatttcataatgtaaactattcaaatcgtgaatatttaccaaaaaaaaagtcagtttacttaaacatattcgataggcgctgttgaaaacgctctgtttctaaagcgaatataattaatacttctatcgtaaattatcaagtttgcatcaacagctttgttgatataactttggatattttcaataggctttttcatgttagccttaagcaaaggttcaatttctcccatcgaaatcattgatttaccaatagatttcattgattcaattaatgtcttaaattgactatcaacttgaattgcttgttcttttggaacatgtcttggtgattttcgtggggacttagataaaggagatctaaggtcaatctgatatttgaaatctgaatttgaaagtggttgaattaaatcttcaacaccatcattttcagtttcttcttccaatccaatagattggttgtaattgttaatttcttcttcttcaaaaaacatgtcgtcatcaaattcttctttctgtgatttttctgattcagatttctcttcttggatttcataaacagtacttgtttctttgatagttgatgcattgtttttaagtggttcgaggctaggccatttcaaaaaggtaattggaaattgaccaacgacaaattcatattcaaatgaatcttgagggttcttagatgaagccaaaatgacattttttggtttgattttttggaataaagataaccaaattgaaaacatgtttgaaattaagataacagaatattcaccaccgcatgaatttgagaataacacaatatctgcaattgcgtcataaatagatttttcgccttgacgaattgaaacttgaaaaattacacttaaatcattaattgatgaaggaattgttttgggatcatttgctagaacaattacttttgagattgatgacttattcatttttgaaactttcctaatgaattcaatattattagatggacattgagtgcaatcccaaacaagaattgttccttgcttcatgatatgaatacgtttaaataaattcaaaacgtacatcatttggttcctaatgttcgactctttataaaacaatacaaacaagagaaacacgaagtcgaagctctatagttacaaaattatcaaaaataaattattgaaaaaaaattacatcttttgatgaataaagttttattaaaattagatcaacccattgtcctttaggaacccgggcattgctgcttttatgttatcaaacatgatctggaaaccattatcaccaccataatatgggtcatcaattccttctggtggattgaacaaaactaatgatgcttttgcattttttggcttttggtattcaagagtttgataaactgattgatcaagtgcagcaataacatcaaaagtatcccaatctgagtttttgatttgacgagctctttgatggctgatgtcaacgccatttttcttgcaaacattttcagaacgagaatcaggactttgaccaacatggaaactacatgttccagcgctatcaaccttaatagaaccattgacaatacttctgcaaattccttcacatgctggtgaacggcaaatgtttccaaggcaaacgaaaagcactgatttctgcatggacatttgtagaaatgtgatatgaaaacccctttttttcacatcttccaaatccataattcgtaaggattaaagacaaaaagacaatttaatccaactaacgatgaataatcgaaaatgatttcaatcaaattttcattaatctaatttgcatcaaattcaaactttttttattttcatcaaatatatgttaatattctatgaaacaagaaaacataatgattttaaaaaggaatttcataatattttttatgagataatcctgaaaaacattttatgcttttgcacattgaaaaaattttaaacggacacaatcaaagtattcaaatccaacttcccgtgaagttgatgattgaataaatatgagggggtctattccctcaagcttttttgatgagtcaaatcaaggctttcaaagaagaaaaatcgaaaggttccgatcaccagaaagtggtcatagaaccacaaaagaacattatgaaacaaatcaagatatgactgatgtaggaattcccccttttttacaaaattcttatttacaagggacaccaccaccgaaggtaactcaacttcggccttggcaaaaagaacttcttttaagtgatgattggaaaagtaataaaaatgcaattatcttagttccaacatctggtggtaaaacattagcggctgatgttgcttttgctcaacaattagaacaagacccagaatccaaaatgattttttcattaccatttgtttcacttgcatcagaaaaagcacttgaatatcgttcacgttttaacaaattccatgttcgcccattctatcaaaatgttggtggtatggattttcgtcgtggtaacattgcagtttgcacatttgagaaagttcactcacttcttaacagtgcaattcgcgatggatacatcagcaagttcaaagttattgtgatagacgagatacatatgataggcgagtcagagcgtggcgctgtcatcgagtccatcatcgtgaagcttctgttacttcgtccgcacatcaacatccgcatcatcggcctaaccgccacattgaacgttgcggacgttaagcgaatttcaacgtggattaacggtttctcctatgtgtgctcacaaagaccttctccaatcaaaaactatttcaaggcatcgaatggcgatctttacatacttgagaatggtgtacaaaggcaaatacttaagttaaattcaataccagaagataacaaacatattttacacccagttagaacatgtctttcacaacatccttcaagtactgttttggtctttgttaacacacgtaaactaactgttcaggtggcacttttcatagcgcgacatttatttgatgaaaataattcattaccacagattcaacaaccatcaacacggctttctgcgtcacgagacttattaattcaacgactttccaagcttgaaactggtattgatcccaacattggtcgatgcatcaaatcaggcgttgcatttcatcatgcaggaatgttattagaagaacgaaagcttatcgaagatgcagcgcgtgattctgtgatctctataatcgtagctaccacaactttatctgccggaattaatatacgaagtgtatccagagtaatcatttatgacttatatcgacaggggaacatattaataccgaattcggtctttattcaaatggctggacgagcaggacgaaatgagttaattggcggcgatgtctttatcttagcccggacaacaaatgaacgtgaaatacaagacgcgtgtgccttatcacgcaatgaaatcgagaatataacaccacaactttttatgtctgagaaatcatcagatcgatattttttacaatgtttatatttaggcttattaccgaacgttttcgactttgttaacaattcgttgcaattttataatgataatgaatcggatgaaagcgcaaaacaaaaaataattaatgaaattgttttccgtttattaacaaataatttaatagaaaaaaatgtaacaaaagaagatttgataatatataaacctacaaaacttggaacagctatagcgagctcaacattatctattgatgaaggtttggaacttaaagagacaattgataatttgcaagaaaaattatatctgaaagatgacgttcatttgttatatttgtgtatcccaacgaatttgacgacatatgaaaagactccgtcatatgataataagatttggaacatattaattaatgaacattatgaagtgttgaaactgataacgaagttggacaataaaatgttcgaaagacacttcataattacgttaaaaaatggtaatcgaaaaggtattacaaaagaattattgaaattggataatttgttggatcggtttttttacgcttgtatattggggaaattgatatcagagataccaatcattagcttaatgaatgaatttaacatcgaaagaggaacaatccaaatgctgcagatgaaggccgcaaactttgccaaccaaagctttaaattctgtgaaattaacggttatagcacgttaagcaaggcactgaacacgtttaaagaccgtttaaacttcggagtgaaaaatgaattgttacctttgatgaaattgccttcttgtaataaggaaatcgctagaactttgataataaatagaattatgacgcctattgaattggcggaatattcatctgatttcattttggaattggtggtaaatggaaataaaaatttgaaaaataataagaaattcgaagaaatgatatgcaaaattatcgaggaagctaagaacgtggcaaaaagtttgaacataatagatgatatagaaaataatatgaaataaattgtttgtattatataaatgaattttttttaattgtaacaatatgtgaatgactttatctaaaaataagagaagttaattacaataatttctttttggtgcttgttataatgttttgtaaatttacataatggaagaatgtgtttaatataaatgtataaagttgcatgagaaaagtagattacatataacttctctagaaacttcacgcataattccaatgctttttaaaatacatgtaaaagcatcataaaaaagcagaaaggccttttaataaaatgattttacttttaaaagttcagaaatattaagataaaagcaaatatattatatataacaacgaatgcattttcttatggaaaaacacaattattgataatcatttattcgcattaacactttatatttacaattgcctttcctgtttccttatattcgcacattgttattgcaatcttatcaaacagttgcacctctccaatcgccgcgcctccgatccacaccgcattttctctttcaacattcgccaaaactttaacttttcgattaaatatatttttcggcgcaattttctttatttctccttcgattctttcagggaatccctttaacattgtatttccgccagcaataaatatttgtccatacaacaaatttcgttcagttttacttttaatactttttatcgatttatttatcattttatgcaatccatgtgatgagtcaaaaagaatttcggcgcattcgaataattctttagataatgtgatttcatgttcattaggaagtaatattttagtgaatggaatcgatttggacgatgatttagtagcgacatatgcatatttctctttgatgtctcggacaatttggagcccagaagctgaagcaagactgctatcatggctggaaataagtttttgaagctgagtggtcacatcaaagcctgaaagttcaattcgattggcagaattcataatttgaactccatcaataactggaagagaacaagaaacaccgtcaccagaaacaaaaacaagcatgttgagaagacctgatgaatataaagcaagaacagcttcatttgtagtataatatgtaggtatattaaaggtttcgaaaagaagttctgccatcttctctcgtttttgtttggggttaaacattgtttccgaaagaatcgttggacgttgggatggatcagtttttaatttatcgaaatatatgtaatggagaagcttttccatatcatcccaatttgtgacaacgccacgattaattggaccctggaaacattgtgttttttttaaatcgttatcaacatttttaattaatgcgtcaacaggttgaaaaactgttggattttgatttcctgaaaagccaattttacatctcactgaaccacaatctattacaattgcttttgtttcttccacaactttaaatacgatagaaaatttgaatgattaaaacgattttgaattttgacttgtttttgatcgtttttgttgaatataaatgtgtcaaataaaattcaaacaaataattaatgtcagcaaatggatgattctatcaacaaacttattgatgttttctatcacaataaaatccaggatccaaatgctgccatcataaacatggattacaataattttgtgacacaatttaaaaaaggattaaataaaaaaattttagatttatcaaggcaaaacataggaatgaatattttaaatcaactaccaaaaattcttagacagttaaaagacattcgaaatattcagctatatggaaactcaattggtgatggagggataagtaatctgtttcaaattttatattccaatccaaatattactgttttaaatattggatgtaacgcacttacagatcagtcatttacttcaattattgatattataacatctagttcaattgtatcacttcaaattggaggaaaagatggtcgcttcaataaatttagtattttttcaatcaaagaaatattacatgcaattcgtgaaacagaaagaattagctgcttaggaattggtggcatcaaacttagcattagagaatttgggagaagaagaacgatagctcagaaacttgccacttttgttcgtaagtacagaaaattgagaacgctgtcaatttttgattgtggttttaatcaagaagaaatggaattattcattaataatggacttcttacaaatgatcaattacaaaacttagatgttcatatgttaccgatgtcagatcgtgttggtaataattttatgcataatttatatcaaatgcataatctacgatatattgatttaagttattgtcaattaaattctcaatctggaatagaactttccacatctctaaaccaaatgaaatatttaacatcgattaatttaagtcataatgaaattcgtgatttaggatttattgaaatattaaaagttcttttaacaaatgatattatcacagaaattgatatttcatataattcgattggaccgaaaatatcaaattatttatcacaattaatttcagataataaagtattatattcgataaacttaagtggaaattatatttgtgatgaaggagcaaaatcaatttctttatcgatagaaacaaatgaatcaataaaaaagttatatttatcatcatgtaaaatctctgatgatggagcaattaatttatgtaaatcactttcaaggaacaaaacattaaactgtttaaaaattaatgataatttcattaatagagaaactggttatgaaataataaattctcttcgtgaaaataataacattataattctcgatttaacttcaacacaaattgatcattttgttattcaagcagcaacaaatttatgtaaacgtaataaacaaatacaaaaagaaaagaattttttaccactgaaaaaacaaattattcaattgtctattcaacaaacaaaaattcctgaagctgaaatgcaattaaattctttggattcgacacttaaagatttggaaaataatataaatgatgttaaccaaacaatggaaacaattgaaaatcaattaaataaaaaaatatcaaaattagaaaaggctataagtgaaatagaaatagatattaatgaaaaagaaaaatcaattcaatcaaatgaagataaaaaacaaaaaatggaaaatgaatttaatgataaatataacgaaattatcgaaaatactgaaaaagaaaaaaatttaattcatgcgcttgaaaaagaatcaaatgaattggatgaaaataatatcgaatttaataaagaatataatattaaaaaagatgaattagaaaaagaacttcaaaatttggtaaaaattttggaagaaacaaaaaatgttcgaaacgatccaattgctataaaagattatgaaatgcctgatttagacttcttaaaggactttaacgaagatgaagagaaaatcttcatcgtagatgatgtaataaacaaaaaagaacaaaaaaagaagaaaaaaagcaaaaagaaaaagaaaaaataaaattgcggtttattattaaacgtgtttttaatatgaatttggcactttttggtcgtttaaatgtcactttttagctaaggcatcgaaaccgaagatgctgatgtaaagttaattagaatctatcatttttctaaatcaattccatcattatttgaaatttttgaaaattttcctgatataattattaacaatattcattgcacacaatctctgtgtgtattggttcactccttaacgtataaaagagtgaataaaaattggacggaagaattaatatgtgtaaatccaactgataaagttcgaatcagtcatatttcatgcggattctttagcattacaagcgttggctaaaatcaccaaatatttatgtaatcaagatttttattgttatattaaatgtgactttgcatttaaatgaacaaataaaatttttgtttattccttttgtgaatgatttttttaattctttgaacttgagattaataaatgaacaaaataactcttcgattttaacagaaactattgtggcggcattagatattttaggaaattgtataataaaggaacaatttcctttcgataatttgttgaatttaatggtgaatgcttttcctattgtggaaggcgtctgttaatgttattacttttatgcatttttaacttgtaacttcgataaaatggaaaatgaaacaaaaataaaatatttgaaaatgttcattattttgttggtacagccgtatagtaacttgttggaaatgaaaataggtttggaaacttgtaaagttatttttgacttgtcaaaacaattgtttaatattgaagcaattctgaaccttctgaatggtaatgaaaaaaaattttcgtttttcatggactcggtacaggaaattatatatgaattttcggcaacagataaataaaatatgttttgtttggatatttttgtagtgtataaaatcatcattttatttatcaaaattgattctaatattagaattattcaaaattatatatttcacaaatataaatgtgttatcatttgtttttttctaaaattctcatcctcatacaattaaacaagttattcattttaaaataagtgaatgaaaaatattattaaaactagtttaaatttattcatatatcattaatgaatttttcttctttgaaatcatctgcaaaaggatcttcatcaatattggtaacaataacgcctgtttcaaatgagttttcatgtggttcgtttccttcaaaactttccccttctatctcacttaaatcttttttatttcgtaatcgaattaataccacaataagtaatatgataataatgacaactataacaactaaaacacatgctgctatggttaatgttgtgttattattatcattcataattatttcattttcatataaaatagtaaatgaattaatgtaataactataataaaatgtatatgcaataactatgtattcataatatatatgttctgtttgaatataagtaaaaattgaattaaataatgaaagcgaaaatgtcattaaatttgttgatttataaattaaaattttactattaatagtaatgtttgttagaccagtgcaataaccaaaagcagaatcccctatttatattatgttttcagtaattaattttgggaataaagaacatttatagaatgcataatttcctattgtcataactgattcgggaataaaaatatcatttaaattagagcattcataaaatgcataattgccaattattgtaactgtacatcccattgtgactgtatttaatgaattacatctttcaaaaacattatttggaatttcggtgattcctggatttataacaacaaattttgcttcatatttgctagtatcgataaaatcattgggattataaattataattaaagtagttccatcataagattgaagtgaatgagaaaaaaataagatataaaatatcatgacaaaagtatttttgatttttagctttcttttatatttattcatgagaatttttgctttacatttttttctcctgaataaaaacaaaacaattatggttttaataaaatgaaataaaattaatgttgcacacattaaaattatatgaaaaacattaaattgttccttttttagattattataaagaaaattggatctattcagtaacacatctccaatacattcaaacgaagttaaacttttgatgtttatttaatatcaaaaatttaaatgaatattgattaaattgatgagaattcatgatgaaattttcttttataactttaatgttcataaaggttgagcgctgaaagtttcttctgctatctaatttcatcaaaaaaaaaattatattttcgaaatgctcttagtttcccttcattataaatagcataattagaagaaaaaagtgtgttgataagaatgaaatgaatgataaatgaaaattcttctccataacgacaacaggtcacctgactttttttcttcaatttaattcaaatattgtttaatcaatatgatacaaaaaatcacgcacaaataatcaattgaaatcaatgactctttattaagaaataaagaactcaaatataagattaaaattattaaaggatgttttatttttatagaagtgaaaaaactgatttatgaattttcagtatatcggatttatcgcaaaataaacatcaaaataaaaaatccatccctacactcacttttattatgtggataatatttcgttaaataattgttttaatcttcaatttgactttactcagagtattatggatgtccataaaaaaatatccagcttagagtgagaattttcaattaggaaaataattgtaaataattattgactttatttattatctaatgcatcatctactgctccaacaatcaaagcaagtggcacttttacggttattgcgttcttttggaagaacacaatgacaacaattgcgtccttcttcgagtcaggtgccgcaaacaaaaactttgaaccctccaaaggttttgtcagttttactgtaattgttttattgttgttatcaatatttgtgattgataaaaatgcgccgttatgaagcgcaacaatataaccgcacgttacatcccataattgcagtgtacactggcttaaaccaaaggacttgccgccaaccaaatggaactttagattgtgcttctttaattgtgtcgcaattattatttttgtatcatcgactttaagaaatgatttcggtggaaaattaggataaaaatctgtaagctttccatcagaataaagttgcataccatcgctggttgttagtaagtatccatcaagataaggtgtgattgatgtagcactgacattaaattgtttaacaatggaatagtcatctaaatttactttaacaacaagaaacctacttggtgtaataatagctatttcaaatggttcgacgtttgagccacaaaaacttattatatcataaacatcagatattaaaaatttggatagaacaagacgacgtggacaatcaaaaaccgtgaagtgattactttcatcaagacatataagcgaaggctggggctttggaagatgtgattcattgatgagaatattggcttggctacaatcaacaagaatacaacttgcttggcgtatcttgcacatgtgtttgtagaaggtattgtgcataccaccaagtgggcgatttgcttcaaaaggtgaacatatcataatatcggttcccattatgatggctaacacagatctgtcgaatttaacaacgttctctacttcttgctcaaaaacaagtagattagtttcttgaggatccattttttatctcttgcgttttgagtccgcgggctgttcaatataaggagaccgtttttcatatgctgacacttattttcttgaaatagatagcatgttgtttttcgaacaaaattaataagtaaagcccaacgcccttgaagcaaaaatacattttattgcttaaaaaatagtgattaaattttgattaataattttcgaatttcatgaaaaattaaaaaagctatcactcgatttatttatatgataaagtttctttatataagcgttcaagaaaaattatgtataaacatttaaaaataaatacgatgatatccttagattgggaattacaaatgttatcatttattattgttacactatcaatccatttttaaagtattttaatgaaaatcaaaaattattttatttcatttttaaaatattcaaaaattagaattaaataaaaaatatttcttttagttattttctttttcaacccacaataaatgattttcttgcaacaatcgtaatatcataagtgactcattgtaatctgaactcatcgaatccaaattatcaactgtctctgtgaatgtacgcgatgcgagttcgatcgcttgttcatggaagcccataatttcatatagaaaaacggaataatttaatacaacacctaaatatgttgacgaagtgggtgaaagttcattcttagcaatggcaagtgcttcatcataacattgactggctttggtgatgtattcggaaacatcttcgcctttgttctcacaaatataccggtaataatctccttgcattttcgcataaaaaactcgttgttcacctgcatatgtttgtggtaataacgtgtccttgataaggttaataagatctaagcaaatatcttttaattcgcttttgagaatagttaaatattcaaacaacttttgttgacgtgctggtttgttgttattagatggatcttgtaaatgtgtctcaacttctcgaatagcatttcgtcgcaatgtaactgcattttttataaactaaagaaagaagaactttctcatcttcacttaatactggattaagttcaataatcttcttaatcatatcaatatattcatttttcttcttccataccttcattaggaactccattattatattgaattcgaagataataaataagttgttctcgttcgtcactcatacgaaatacgtttattttatattttttgtaaatatctgaaaaatattgtaatgataaccgtagttgtaaataaacggcttcctatgatttatgaaatattctgttttaataaaagatatataaaatctttatcaacaagaatccactatcaaaaagagaaaatattatcaattcgaagaataaattaattatcattaagattaatgtttatttaatttatgtacttaaaaaaaaaaaaataatatttttagaataacaaaatttaaaaaaatatataaaataaaaaattatttagcaaaatcatcaaaattatgaatcatgaagaaaaacgtcttcctcttgtaaaaagaatccgttaaaatcgattgaaaattaaattcaagaagattttggccaaacacaaccaaaattttaaatatcacgatataaataaggaatatgaaaaagtatgaatgaagaagaaaacaaagatggacgttatttcccaagtgatagtgaaatgcaaatttttaattaattatcttcaaatttatttttcacatccagaaagatctattcaacgatcacaagttgttcaaacagttgtaggtattctttctacgactaataaacattggagtcatcgaacagttcgtttatggtttaataataataaacgcgtttttttacgaccaaattcacctaattcatctaattcgtcaagttcaagtcaaagtcctaatcagaatattgtttcaagtcaatcacaagaaattaaaacagaaacgagttcaagttttttcgtcacaagtcaaattttttgattccaacgcgatctttatcagttacacaatttcctattaaacaagaacaagaaccacaaatcatttcaacgccacaatatgtttcatcacaaagtaaacaacctaaacgtggtacattagctatggaattattaatctctaatgaaaacatattacagaaaccacaacaaatttttcaagcacaagttgaatcagagaatcatattacagagaaaattatatcattacataatcaaagattggaagaattaattggagttcaacaatcgcgaacatcattaattgatttttcgacagttccacaacatgaatttcaaaacattcgccgaattaatacatttaataataataataattctattaatattaatcctaatgaaaacaaagaagataatttacctactttagataattatcaaccatatgaactcattgaaagtagttatatattacataatggtgaaagtattattattacatataatacagaagaacaacgacgaaagattcatattcaagaacaagttaatgatattgaatttttatcaccagtcacatctatagtttataattatcaagataatttaatatgggttcatagtgataaatatattaaatcatattatcttgatacatttgaaaatgtacataatcttctaattagtcatcgtcgatcatatcaatcagtaattaatttttggaatgataatttagtattagcgacaggttcaactattctttcatggtcaccagaacttttaagtcaagttaaagaaacggaagatgaagagaaatttgatatttgtttatgtttatctcttccgaatatttcatctgttactacattaggtgaatcacttgtagttggatcaagtgaatatcatagtattcaaatctatgcgaagaatggagccataatttcacgatgtattggccattcatcaggaattacatcattatcaagttatgatgaaaatatgtttttatcaggatcagctgatcaaacgtgtaaaatgtgggatttacgagtttcacaacctatttttaatatcattcgacatgacgggattgttactagtgtttttgggaatgttacagaaagtccgaatttaatctttacagggggtaatgatggaatagttcgatgttgggatattcgagaatttaaacatttatttacattaccaattggtgaaacgtcaccacaaaacattcattataatcatgaaatgcaacgacttacgattgttactagtgaagttacatcagattattttttatgataattgtaaattcggacaaaaaatttgatcgaaatattatatttcaaccaaattctgttttaaattttcatttttaaataaaatattaaattcgaaaagataaattttagaaaatttgattccaataaaaaaattttttttgttttctttttgattaatgttttttaacaacagcatcagataaccaattcattccatcaacaagtccctaaccctgtaagtgcacaacttgcttcaatgtgatatcgcgattgatcaatgacttgtaaatctaatgcttcactaagcttttcaactgaaactgcaccttctatgtcttgtttgttggcaaatattaagataggacatcctttaagttgtggtgattgaacaatttgatgaaattcttgtttggcagtggcaaattgtgttttatctgaagaatcaacgacaaaaattactccttgtgctccattaaaataatgtcgccataatggtcgaattttatcttgtcctcctaaatcccagacacaaaattctaaatctccaaaatgaacagtttccatggtaaaaccaactgtagcaactgtatgaacaacttcattcttcttaagacgatacaatatagtggttttacctgcggctccaataccaagcatcaagattcgatactctggtttcgcgctacaacctcccatattgttgaactgctttatatgaaaccgtttattacgatggaaaaaaattttctggtaatagtaaatgacacgaagtggcgtcacttttgcgttcaacacgaaatttttttcaatcaaaagtgccaacatgaggaaattaaaaaaaaatcagaagattgaagaaagttaatcatgataattcaatgtcatttatcaagaatttcacaataaataataaaatgtcaattattctaagttgcaagatcataaataaaatgaaatttcgattatacttcgacaatttcgtggaattggtggataataactattttcgtttattccttttaatcatatcttatttagaatatatgtttttatgaattattaaacaaatgtgaaattaatataatttttattatagtgaatcaggtattgtttataaatatagtatcagttgagatatatgatttaacatatcattatcttctaatttttgaccataatttattatatatattagttgtataattcctatttcatccgagacatccatagactgattttgtatataccctttgactgttttccattgaatatagttaattcctgaccttcttattaaatttgctggtcttgtcctttttcttccagagaataaatttgaatttatatctttatatcattaaataatttaagaactagttttttcactctacctttttcttgaacaactgaagcgatatcttcaaatgcttttgtaagtggagagtaactcagatcataatgaggtattactccaatttcatgttctatgattttatttcttaataaattgccttcctgtatttggtacaattttttaaaataaatctcaggtatttcattttgtgatattaatgggatttgctcattcgaacgattaatgatttcatgaacacaagggagaccatattcaatttttgtaatacatttgcaatttttctcattaatacattacaataattcgatattagctcttccatccattatttgttttttagttttcttagcaatttcgactacatttttcaatttatttactgctactgaacctataatattatctttataaatattattgtcaattcctgtgagcattctctcacttcgccaagcaaattctgtagataaataatccaatatatttataataatctcaatatctctttacacatctaatctttcccgtatattaccattaaaccttcaatcgcattagtcgttctttgttctctcgaatttccagaaaataagaaactaggatcataacaatcggcatcatcaattaatgcttgaatagctcttgtatttttgacagtactccgaatagtttgatttaaagaattaatatattcattacgatatattcgattttcaatgaatttatgaaatgacttatatattatagattgaggaccaaatgtttgttcaactgatctcatcatatgaactttgcaaaaaacaatcatagtatttaacattacctcttcaattactgctttttgtgctttttagtctatcaatgattacaactcttggtatgccaactatatttttatatcatcaaatacaagtttaaatatttccttttctttactggacattattgaaaatgctagtatctgtggattattattctcatcaatgaataagaaatttagaataggcatatcaaaatcattagtcatcattatgttatctatttgcaatatatctatagatattattttatttttaaacctccttgaaacaaatgttgctgtgagaatttgattatctgctctgttcaaatgtaatctcgtttcataattatttgataactgttgaataatagattggattgatttgattgtatcaacattttcttgattttaaataagaacttctgatatcataaaaatttccggacactgacagattatgttattttccttctgatttatgcagcattttctcgttgtttagtgtaagttatacattaatttcgcgtagaatttgatggacccaaccaactattatataaatcttgtgatattggatgtttgtgtcgaaaattgccttcaacaaacataacttttgataaattatgatcaactttcaatcttatgaagctcttgcgatcatattgttttagcgtacggtttttttttgctttgcaacgtcctccaaaacgacaccaaaaatcgcaatattcaaattggccaaagaccttcgttattgtgagtgaataatgaccaacattttgcttgaacatttcttgtatatcagaaggggaagtctcttgtaagttaatcgacatttcccaatttttaaataaaacaggatatataatttctagagtatcgatcgtgttttccattcatctgggcttgtaagattatatcaaatttgatgaccggatgaactttttgagaattttgaaagagattgtgatgatttttgatggttttcaaaatttgataattgaaattatttttaaccccctcatgttggcacttttaattgaaataaaattatcgcgtagaatacaaaagtgacgccgcttcgtgtcaattacgattcctcaaattttttgttttgagtgtactaaaattttagcttatgaaattctgaattcattcaattttacttgggagcgtatttaacggttccatttcaggatggaggaatatccttttcaaatgattgcgaaaaaaaaattaatttatgataaaaataaaataaatttttaacaaatgtgcatgttaattttctatgtcatggagtaatttaactattggtgcaaggaaaaggtgtaacttcttaattaaaattcaattataatcttaaaatattgtgttaacaaaataaatattatataaaacaaatagccattttttacatcaatattaattccttttagttcaagaagtaacatcgcttttcattgtgtttataattagatgaacaaataagttattaattattaaaagaaaaattcaaatgtcgtcttgaaacattatatagtaaaaaaatatcaaacaaaacaaataaaaatcatatccgttttgttcaagaagtaatttaactatttctaaatttccttattttgcagtacatataaatgctgtaagaaatattttaatcacctgtatcatagtcatttacaccattcatatacaataagtaaatttacttattgatttccttcgatataaatgtcattgtaaattaaaatacttgatgaataattaatcgaaaaaatccgaatttgaacacgattaaagtcaaatttctaattttggatcaacaattaaaattaatataattttattgtttatttttcatgatatacatttatattcgcatcaaaagatttgcagcatttcgccttcgtcttcaattagcatttcatttgagtattccttattcattgttggcgatgttgttctcggcgcaaatatacccgcgtttattaggtccttaggttcatcgaattcgatcaatggcttactgttatccccattatcgcctcctttgaagttcatcatcgattgctgcaatttttgtctctgctcaatagggacaaagaattggctctttccatcagcgctttcgaaggatgagaatgcacatatccatccgagctttggatgttcaattgaattcttattgatgaaatcaacaatttgagatgctttcataggcatcacaaacgtgaacaacaatggtgttagaatagcgctgaataagtcaaagcagatttgcttagagattggttgaaacatcgaagcaaatgtagaataagtaatccatgaattagccgaattactttgctctctaaagtcgtaatgtatgtatttctcgacttcagtaagtgcttcgtttggtgtataaggatgagaatcaggtgtgattgaaactttacaaacgccatagatagaaacggcgattgaaagagcccaagttagtgacttgttcccaaagattttaatgttgaggagatgtcccgaatctgtgcagaggccgataacgaaaataaccgctataaaagcgccgctgatgaacgataggagtttgagaagcggttgtacgatagaacttgggaacaggtccatgtaaacgttcgcaaactcataactttttgagatgcgttcgttgaaaagatgcggaagttcattatactcacgaatcttccatttagcttgcgtagtccaacggcgtcttgaaagtgagtcagggctattacgaattgcttgggcataattgaaaaataaataaagaagttcgaatataagaacaaacggtgaaaatattaggagaataatcccaacaaacttaaagcggaaggaaagagtgttcgtaattttgagacggcggactgattgaactccattgacaagtgaacaaccattggaatcaagaacaacgcctgtgagagtaagcttgagaacataaaagaagaagtctgacataggaaactgttcagctgtgtttgattttgttaatttccatgtgagtattgatggatcagaaacaagagcacatatatagttgtcataacgtaatatttcctgtgcaactgaaagcatggtgttgttttcttctggttcgttagcaattattgtttcaaatacatcactccattctaaaactgataattcatgatctgatatacctagagttgcaaaataatttctgattcgataatactttggaataagtaataaaaattgaacaatttttatcaaacaaaataatgaaaaaattatagagcaaataatgcataaaaaaaaggttttgtgaaagcctactgatagaggaacaaaaatttctgaaatatgttctgaggttgttatcttagaataattgatacatccgaataaaaaaataggagcaattgcaaccattgcaccaattaggcacgaagcagtgttctctaatagaaacgttataaaccctttcgtacgaaagtattcatatgcatccacccaattaaatttggatttcattttgattttaaaagtgtcaaaattgaattgatttttcggtttaaaattttgaagaagtactttagcatttcctgattaattattcacagcatattaaccattctgattggataataacattaaaatataattcccatcaaaaacaggaacagaacagtgagaaccctaaaaaagtattgtgtccttttctttcttttttatcccataccttgtcacttttttatattgaatggttcaacttattcaagcaacaaaaaattatgagccattatcattattcacttgacaaataacacttcaaaccaactccagaagtaaaagaattattaatgaacgaaattattataagattttcttgtttcgaaaaaatccttgataatttataatatttttttctttagtactacattccctgacagcaaaaaatgtccacgaaattaacgagcgccgaaattaacgttcgtcggtcagtaattttggctatgtgtcatctgattctgtccattggccagaaaaaatgtccatttcctaaaaaggctaaattgaagtgtaaagatttgtgaaacaactaattgaaatggaatttttcaaatacaatgcatgattttccaaagaaatatatgaataacaatgaatattaatgttataatcatttttgcattgataaaaaacattctttgcaaaaaaatgaattcaatgtgtatcaccctaatgttggcacttttaattgaaaaattttcacgtgttttatttaatatgtattttatattatgtatgattttcaataataataatattataaacgattaaacaaattcatattcaaaaacgaaaaatacagcattgtaatatttgtatttatttaaacaaaaataccacaggagaaaaaaataagtattagctgtaccaacaaaactttaaatgaatttatagagtaaaaaattgattccacaaatgtaaattctgatcctagaataaagacgatcataaatatcacaaatttatgaatttgactgttaaaacaaaagaatcgattccattttgtaagaggaattttcaataaaaaacatactgttttcacaaagaaaaataatatgttactaaataatatgtaaaatgtttcaaattaaacactattttaggaaatgaacattttttctggccaatggacagttttatgtccgatggatatttttttctgtctcgtgacaaaaccgtaaaagtggaaaaatacgttgaccagctttttatgtcagatgcccaaaattactggccgacgaacgttaattttgtcgtacgttaacttcgtaaacattttttctgaccgatggacagaatcagatgacacatagccaaaattactgaccgacgaacgttaatttcggcgctcgttaatttcgtggacattttttgctgtcagggactgtattaatgcttctcaaaatgatcatgtcgaaatagtaaaatatctttttaaacaaaaacaaagcaaagtaaatgctcaatttttttttattttatttaaaaataatatttcgtttattataatactgtagtattttgcccataaaatacatttgtaacccatttgatacactttcatcagcacttatatatgcatcaatgaatcgtaatacagaaatttttagagtgtttctgatgggattttcgatataattcaataaagcctctgacttttccttcagtaaagggaaatagtttaggtgccccttcaataatcacaaagtaattagcataaatcttgagtaatcgttgatattgatttatagaactatcagctaggcttttggtttctatttcggttgacgcttgaacaaatgcattgaagtttattttaaacaataaatgataaattttattattcgttatggtaaataaaaatcctctcacttttagacactccactttttgaatcgtttatgatgttcaatggttcaccaacaaaaaaattcggaatagagtatcactgatttcgatacaattcatgtttaagaaggtacaaccctctacaaattttgttgcagattacacatttattgaagataaaatgaattgaaaagttaatgataaaattacttcaaagaatttaaaattgtaaaaataattcatgaatcatacaattttttacaataatgtatttatgcattttgaaatgagtttcaatatcgaagagttcagcagcgatatcgagaatctaaatgtcgaaaggacaatgcagaaatatcgaattgaaagaaagaagcttcacatgatctgccaaatgttcaatgtccaaatcccaaagcagggtcaacctaaaactcctctaacccaagaagatataaattatattgtcaaatataatcaaaaagctcatgtgggttacattacaatggcaggtattgccaagtaagatcctttcgctcccaaatgattaacaatatggcaatgccatttggtatatgatatagacaatctctactaattattgcatttgtatcgtccaacagatgatgaggatcacccaaacagatatgttgcttgatacattaatcaagctttgcacacaaatctccactatttggaaaaacttccagaagaaaatttcatacaaaaatgcctgatcgcttttattgataacatgagtagaaagattattcattatcagatacttgatcaaaaaacaagtatcttcgcaatgaatgcttgtgcgaatgcgtttcagaaggaaagccctcctaaaaccatgataatggataatggaactgagttccaaggtccctttgaagaacttctacatatgaacaatgtggaaataaagaagactcttccttatacaccacaacaaaatggaaagatcgaacggtggtgggatatcatcgaaaggaaaaagactcaaccacttagaggcgagtatattgattggttagttgatcagtacaacagcaagtgggagcatagctcgctcatgattcttactggtcagaggaccacaccgcaagaagcattccaaagcataactcaggtcagcaagatgcaaacttcattttcagttaataaaaactgaaatgatttattttttttgagggctttgtaatgaaagcttggtgatcgatgcaatcgatcagattgcatcaacaccttggatgactgtttgtgtgtttactgttaactgttgaataattgtttttgagttttggtcccgccacaactgtgaccgtatgtggtcgttctttttgcgagcgccaaaagcgctaacgattttgatctttatgcattgaaaaatgaagtttttcaatgcataaagatcaaaaccatccctccccattcttgcctgattcttttcgataaatgtgtatgccattcaaaaagtgagcggaattttatttattataaattttattattcgtacacagaaatgacataattttatcatctgaccagtaatcaagtaaagtactgaaaaagttggtcaagaaccgaattctatggtggcacttttaaatgagcttcttccaaattattttaaaccacagaaatgattatatttaaaataagactattagcactaatgtggaaagtttaaaatgcagtaaaatgaaaaaattataaattttttcttcagaattaaatttcgcggttaatttcccacacacaaaaatttccatcgtaataaacggtttcatataaagcagttcaacaatatgggaggttgttgcgcgaaaccagagtatcgaatcttgatgcttggtattggagccgcaggtaaaaccactatattgtatcgtcttaagaagaatgaagttgttcatacagttgctacagttggttttaccatggaaactgttcattttggagatttagaattttgtgtctgggatttaggaggacaagataaaattcgaccattatggcgacattattttaatggagcacaaggagtaatttttgtcgttgattcttcagataaaacacaatttgccactgccaaacaagaatttcatcaaattgttcaatcaccacaacttaaaggatgtcctatcttaatatttgccaacaaacaagacatagaaggtgcagtttcagttgaaaagcttagtgaagcattagatttacaagtcattgatcaatcgcgatatcacattgaagcaagttgtgcacttacagggttaggacttgttgatggaatgaattggttatctgatgctgttgttaaaaaacattaatcaaaaagaaaacaaaaaaaatttttttattggaatcaaattttctaaaatttatcttttcgaatttaatattttatttaaaaatgaaaatttaaaacagaatttggttgaaatataatatttcgatcaaatttttgtccgaatttacaattatcataaaaataatctgatgtaacttcactagtaacaatcgtaagtcgttgcatttcatgattataatgaatgttttgtggtgacgtttcaccaattggtaatgtaaataaatgtttaaattctcgaatatcccaacatcgaactattccatcattaccccctgtaaagattaaattcggactttctgtaacattcccaaaaacactagtaacaatcccgtcatgtcgaatgatattaaaaataggttgtgaaactcgtaaatcccacattttacacgtttgatcagctgatcctgataaaaacatattttcatcataacttgataatgatgtaattcctgatgaatggccaatacatcgtgaaattatggctccattcttcgcatagatttgaatactatgatattcacttgatccaactacaagtgattcacctaatgtagtaacagatgaaatattcggaagagataaacataaacaaatatcaaatttctcttcatcttccgtttctttaacttgacttaaaagttctggtgaccatgaaagaatagttgaacctgtcgctaatactaaattatcattccaaaaaattaattactgattgatatgatcgacgatgactaattagaagattatgtacattttcaaatgtatcaagataatatgatttaatatatttatcactatgaacccatattaaattatcttgataattataaactatagatgtgactggtgataaaaattcaatatcattaacttgttcttgaatatgaatctttcgtcgttgttcttctgtattatatgtaataataatactttcaccattatgtaatatataactactttcaatgagttcatatggttgataattatctaaagtaggtaaattatcttctttgttttcattaggattaatattaatagaattattattattattaaatgtattaattcggcgaatgttttgaaattcatgttgtggaactgtcgaaaaatcaattaatgatgttcgcgattgttgaactccaattaattcttccaatctttgattatgtaatgatataattttctctgtaatatgattctctgattcaacttgtgcttgaaaaatttgttgtggtttctgtaatatgttttcattagagattaataattccatagctaatgtaccacgtttaggttgtttactttgtgatgaaacatattgtggcgttgaaatgatttgtggttcttgttcttgtttaataggaaattgtgtaactgataaagatcgcgttggaatcaaaaatttgacttgtgacgaaaaacttgaactcgtttctgttttaatttcttgtgattgacttgaaacaatattctgattaggactttgacttgaacttgacgaattagatgaattaggtgaatttggtcgtaaaaaaacgcgtttattattattaaaccataaacgaactgttcgatgactccaatgtttattagtcgtagaaagaatacctacaactgtttgaacaacttgtgatcgttgaatagatctttctggatgtgaaaaataaatttgaagataatgaattaaaatttgcatttcactatcacttgggaaataacgtccatctttgttttcttcttcattcatacttttcatattccttatttatatcgtgatatttaaaattttggttgtgtttggccaaaatcttcttgaatttaattttcaatcgattttaacggattctttttacaagaggaagacgtttttcttcatgattcataattttgatgattttgctaaataatttttattttatatattttttaaattttgttattctaaaatattatttttttttttttcatcaagtacataaattaaataaacattaatcttaatgataattaatttattcttcgaattgataatattttctctttttgatagtggattcttgttgataaagattttatatatcttttattaaaacagaatatttcataaatcataggaagccgtttatttacaactacggttatcattacaatatttttcagatatttacaaaaaatataaaataaacgtatttcgtatgagtgacgaacgagaacaacttatttattatcttcgaattcaatataataatggagttcctaatgaaggtatggaagaacaaaatgaatatattgatatgattaagaagattattgaacttaatccagtattaagtgaagatgagaaagttcttctttctttagtttataaaaatgcagttacattgcgacgaaatgctattcgagaagttgagacacatttacaagatccatctaataacaacaaaccagcacgtcaacaaaagttgtttgaatatttaactattctcaaaagcgaattaaaagatatttgcttagatcttattaaccttatcaaggacacgttattaccacaaacatatgcaggtgaacaacgagttttttatgcgaaaatgcaaggagattattaccggtatatttgtgagaacaaaggcgaagatgtttccgaatacatcaccaaagccagtcaatgttatgatgaagcacttgccattgctaagaatgaactttcacccacttcgtcaacatatttaggtgttgtattaaattattccgttttttctatatgaaattatgggcttccatgaacaagcgatcgaactcgcatcgcgtacattcacagagacagttgataatttggattcgatgagttcagattacaatgagtcacttatgatattacgattgttgcaagaaaatcatttattgtgggttgaaaaagaaaataactaaaagaaatattttttatttaattctaatttttgaatattttaaaaatgaaataaaataatttttgactttcattaaaatactttaaaaatggattgatagtgtaaaaataaattatgattaataataaccagaaatatcgatgtgaaagaaatgaaaaatcacttttatgcttatgaaaagtgaatttttagggtgctccattgagcggtttggtcgtcctttcggatgggacaccttaaagcccacgagctcatacaaaaatcacgtgcagatcttcttgaagaacttgcaacattagagaagaagcttttcgaactccgcggtcagattgccacatcatcatcacgccaaaaactttcagaaatccaaactgttcgtcgtgatgttgcacgtgttaaaactgttcttatggaacaacaacgtaaggcccttaaagaaaagtacaatggaaagaagttagttccaaaggatatccgtaagaaacaagttaaatcacagcgtaaggtccttccagccaagtatgccaacaagcttacaaagagagctgcacgccgcgccaagtatctcaagccagttaaatttgcacttaaggcctaagtaaatacttatttgaaaaattaaagctagaaggaattacaaactgctttctcgtttctccaaatattatagctaatttttttttattagctgtcgaaatttttctatggtatttcacattggtaaaattcctagtgggaatcattagttatatcatttattctgttgttttttcttttaatgaaaataattttcaattctttttggtatctagataattggtaaaatttttatttattaaataaattatttttttgcttttattaaagcgtgttttgatgaaatttaaattactgcccattataaattcatttttatttcgtttctatatctttttagccatttgaccaaaatgtgtcaattttctaacgattatttgtaattcaatttatcaactttttaaaaaaagttctatcgcaaccgtttcccatttttatgaaagctctcacacttaaaacaggtaagtcaccgaatactgaatgtgccaaaaccaataaaatatatgttagccacaagaatctcgttcaaattccaaatgaaggccattatgtcaaagtcggactgtatctttttcttgttgatgaaaatccaggcgtagacgacaatactgttgccttcaacacagaacaacgacggcttctcaattgttcgcttcaacaatcaataaatctcaaatttgaggttccaagttaccaatgtacaaaagtcacgtttgatgtttcatttctcacacgtagcaaagaacgcaagcttacacttgatgcagataaacttcgtgaagtatatactcgcaccatgtcacaaataccattaaatcttaatcaagctcttatctttcaatacgatggagatcaatttttacttaagatcgctgccattgaaggtggaacacttggaaaagatctcgaaattgttccaaaggaacatatttctactgcattctttaatcccaacatcacgtctatgatctttaagaaaggttctgattcacaagtcatcattgaagacaattcatctccaagtgttaccactgtcattcgaccagattttaatttcgaagatttaggcattggaggtcttgatgccgaatttgcaactcttttccgccgtgcgttcaattcccgactttatccacccaagatgattcgagatcgaggcatcaaacatgtcaaaggaattttactttatggccctccaggtaccggaaagactcttatggcgcgacagatcggtaaaatgcttaatgcatgtgagcctaaagtcattaatggaccggaagttttcgacaaatatgttggtgaaggtgaacgaaaaatccgcgaactatttgcagacgcggagaaagaccaacaagaaaatggggacaatgcgcaattacacttaatcatcttcgatgaaattgattccatctgtaaaaagagaggcaccggtgcaatgtccggagttggcgacactatagttaaccaattgttgtccaagatcgatggcgttgaagcgttagatgacgttttattgattggtatgactaatcgtaaagatctgatcgatgaggcattgttaagaccgggccgtctcgaggtgcaattaatgatatcgttgccagaccaacatgggcgtgagcaaatctttgcaatccacacgaagaaacttgttcaatgtggcgcattagcaagtgatgttagtattaaggagttggctgagcttacaccgaattatactggtgcagaaatcgaaggtgttgttaaatctgcgcaatcattctcattgaataatggatttgatccaaagacaatgcaactaaagagtgaagctgatctaaaggtcacacgcgaacatttcatgcttgcattacaagaagttcgtccagcatttggtgttgaagatgacattaagaaattatgtacacgcggattatgtgaattttcaagtacattcactaatacgaagaaacatgtcgagaaattcatcgattcattgctacaatcgaatggtacttctttaatgagcttttgcatctatggcctccccgcgaccggtttgacgtcatttgccgtgacgatagcgaaacaggggttcacttatgtcaaagttatccttgccaaaaagttcattggacgatcagaagacgccgtatcgttagaaattttggacacttttgagaacgcttataaatcgaagcaaagtgcaattatcatcgatgacatcgagtctatcatcgaattctcgccaattgggccaagatttgcgaacaagaccttgcaagctttgttagttttgttgaaacaaactccacctgaaggtcataaacttgcaatctttacgacaacaagtaaaagagaagcaatgtctatgatcggaattgacacaagatatttctacgaagaaatagaattgttgccattgaacaagccagaacatttgattaagttggcaaaggaatcttgcaacgccaatttgattatagaagaagatgacttgagaagcgcaagcgagtacttaagcgctaacccggtgcctgtgaaaagagcaatcgaggcaatcgatttcgctgtgttcgaggcgaaggacaagccgttggtttggaagaacttggagaagtgcttgagacagcacaaccgaacatcagttaattgaaataaataaaaaatattttctttatggcgaaagatgttcaatgtgcatcaaattcgaatttgctgtttgactataagttcttcataacttaattttgtttgttatgtatttgtaggtgaatgtatcttctgcaaaagagtattgttcaattgttaaatagtaattcctgtcgttgaaagaatttgtggtttcattttcttatgatattcattttcattaatttctgtggctttatttcaaattcgaaatattaatactacttgttgtgttatgccaataacaattacaacagcacgaacaataataccaattattattgcatgactattattgtcattttgaaattctactgaatttatatatgcaatgaaatttgatgaaaaattgtcatatgtcgcgtaaataatgattacataatcataatcattatatgaaattgttgaattataaagaaataactcagacgattttgtttgagtttcataaatagtgaatgaatgtgtaattgataaccaaactgttaatacgtaagaaaaagatcaagttaaatcattttgaagtgatattgtgaatgcatttgattgtgcaaatgaatatatcgataattatattcaatctttcctggaaatggtccaaatgccgaagttcttccatatgttaaatatgtaacaactgtcgctttgactgacgaaaatgcattttcaccaaacgcatcgaagtttgcaacagttcaattacagtgctgaactccgatacttttgttacatcgaaacattatgtgataaaacttttattcaactgcatgcaaattgtattatgaactcaccaaagttatcatcagttgtcatccaaacctgcgcagttccacagtcgccccatgggtttgtcgtttcatatgattcttccatttccatcagcagcacagtgtcgtccggctgatcatctccttgaacgaacagtggataaccgcctaaataagttacgcattttctgttcgggttatactcttcttcgattatcctatttgcaattaataagtcatcgctttgcatgtttgggagtaacttcttcagcatttcaagtgatgtcggatatgatgtcgattggcgccattgtttaatcactcgattctcattaaatatgaattgaggatcgatttcttcatatatcaaatcattaatttcatcgtttttatagcaaatgacttttaaattgctataacaatgttcacatgctaatccgattaatacacattcgcgttcactaattggaaaatagctttggatttcagtgggaagggatgggacatataatgaaaatattaatgaggtcgtttgaccgcatgattcacatttatgatatccgttacatggaagatatggagcacgtccgccaaacttggacacgcgtggattagtggtatcataatcttcgacaattggtgcataacatggtttagctaaagattcaatgattgatttaagttcttttaccttttcattcacttgtgaaacaacatcaggaatatcaatgccattgcgaagtttgattaaataaacaagatatatctgggattcagtaagtgatttgccagaaaatgttttgacaaagtctttgtccaaattaagctttgcaagaacacggacaatgctgttcaaaaagtaataatcaatgtattgcttccaattagagcagaaagaatagaagctatcaagcatttctttcgaatttgtacaaagtgaatcgatagtgagttcaagaagatttccatttccaagcgcgaaataaccacagatgattttcttaataattatatgaagatttgttggtgttgcatgttttttaatgactgaaagaaaatcatcaataactttcttgtcaccagcattttgccagggcacattctttgctttgttgaatgcttcttggatctcagggcaaagctcttcggcaccaagcatgtttttgtgaagtcacttgtgatgtgtattaataaacgtgcacacatttgaatcgaatacaatttttgtgtggtcgattttgacaaagtctgttcgaataatgcttttcaaaaaaaaaatttcagcgttcatatttttacttattcatcttttaagtcttgtaccgatgttgcgccttccttttcaactgccaccgacatatcatacaacaagtcctcatcatagtccttaaaattatcaattttttcttgcacctgatctattgacaagaaacaatacttatctcttttaaatatttgtatgttttggaccaatttattaacacccaaacattttctaatattaattagtccattaacgaatgtttgtgtgttttcataaaacataaacaaatctcttaataacattcctaagtaaggcaacactggttttgaagcacttagtttttcttcattgagttttctaatttttgaaaagttatcattaatatcaagtttctcctgtaaagcttttaacttctccaaataatttgaatcgactctttccattgtgatctttagtcgaaacattgcgttgctttcgaaacttgacaaaactgccatcgcgtcataaaaattgttataatcgaataactgttgtgctaaatcgatcatttgttgaatcctttgtatccttacctttaagctttttgtgtctaagattgaatatgtgacccattgtgataatcgattataatgttcagtcaaagcagtaacgtttggagcgcgatactttaaacgtggcttttcccatgcgcaatccaatagctcgctgcgcccaatgtcatataacttgttggagcaccaaacggtcaactggcgggcaaattcgataattggcaaatccaaaagcgaaaagtctccggtccatagcccaaccactccatccactttcactccgtctttaggtgcattagcttctatttgtttaatacgtaaaatggtttccttggaacgattttcaaacattccagtaactaatttaccaaatcgtgggactaagacttcatcattataatgagtggccgcatcaaggatacgtggctcaatatcattgatagaattacgaatccatactttgaataatttgacacataataattgctctgctttttgtgatggatcatttaaaaccatcgagaagcgatcaatgagcttctgaagaaagttcttggatgaagtataggaagaaattgtgagacatattgcattcgttaaatcggatacaaaagagttcttagtattggcatcgtctttggattcttcatcgggcgttgtgatgtagaatatgatttggttaagagtggcttcgacaggaagattagtattaggatcatatttgatgtcatcgggattattaaatacatcctctttgagtggtttatccgtctgtgtaccacttggagctgcaccaattgtttgtgatatttcattatcaagtgctgcttgagttattttgaatgttggaaatgaatgtgatgatggcatagataactcccaaaacttttcaattcgatgtacgccgcgttgaagaagtatgtttagttgcgaataaagcatatgtggtggaattataaaatctgatccccattctgaatgaagtaatgtttgtgatgttgtaagaccaagagtcctaaaatgttgtgagataagagctaagatgagttcttgtgaaagaagtcttgatggaggtaaatacattcttgcaaatgcagctgagcgagtaataggattaacagcaagacgaagcctttgaatgcttgggtgtgaggttagaacatcttgaagccaaccatttcgattgatatgtttatcagcagtacattcagatctaagacgatcaaactcatcagatattttcagtaactctttcgctctcctcctgtgtctttttcgtttttcagtttgtggcgtttttgaatttatttgttgttctttttctggaataacaattgtttcttgagaagataaaactgattccgcagacacacttggcactggatcaaaaaaatcacatccatgttgttcttcttcatttttattgtttgaaatttttttgttttcttccatttgattgtaaaaacaattgaatcgccagtacaatcggaaggagggggccgttataatggctgattaaaacaaattcaatgaatttacgtttttgaatataaatacgattatatttcattcatttgattctatcgttgtgatatcacatgcaaccactttcaagactttatgacaattttttttaagaaagatgtttttcatttggtttatttaatgcacaaagaatttgcttcaaatttaatgtacatctaatcaaatgtgataaattcgtttgttacttcaactagatatgaaattttgaaataaatctttttcgcttatcatcattggtaattgatatattcttcaatttaaagtagcaaaccaagatttcaaaataatatttgaaattttaaatcaccttaattacaactaatcatatgttttcacttgtatctatattgtgtgaaatcctctatccaaaaaaataataattttcacatttttgaatcaaaaatcatttaaaaatatacaaaccattttttgttcatattaataaagataaatcagataaatatgaatctttctttgaccaagaaaatattgcttatgaagaactttcgaagtatgattttgcacttataattaatatgatcgaaaagaaagaagaatatttaaaatgtaacagataccgttaaaaagcaaacaaaatttgaacgagcacttttttctttaggacttcagtagattgaatgaaaaacgattaaattcatgatttgttgtgaacggtcaccaccgagaaaatattgttttgtcaataaatcaatacatatttatagtttaatattcaatatttttgatgtgttctttcaatagtttttgtttcttattccattttctgattatagttttaaaataattcatctcgtgttttataaatacaatataattatatattttttacattataatcgaacatggaaatcttcatacatgaaatagaatagctcaatatggtaattattcacattatgtaagccgacaagatttttctttctctgtgtattttccattctgaagaattcattgattttcattgaagtcagtacttccatgaaggaagtactgaatgtatttattattattattattattattattattattattattattattattattattattattattattattattattattattattattattattattattattattattattattattattattattattattattattattattattattattattattattattattattattattattattattattattattattattattattattattatgtattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattttattttatttaattttttttatagtctaatgcatacaatagttcatcattcacattgttattttcaaaaatattcattaacaaatgatatcatttatttatgtgttcatacgcaatgtgtgatatattgatcaaactcgaaattaaataaatagcatcaaaatattgtaataaatatttagaataaagtaatagagggatattgtagaaattttgaaaaacgattcaattgcaaattgcaagataacttcataatattatcatgctattttttagatttataatatatatactaacgttatttatttaatgcatcaaataattaaattatatttaaatttgtaaacgaatttttcatgttccaactttttaatttttttctatggtttttgaacgtatttttttattataaacatttttatttccaaatcaaataataatttatcaaaataatattgtagcatcaattgaaattattatgttatttattatatttcagaatcaattttcattattttttggtttttaaaatgaattattctgataactaaatattaagtgaatataaatcgacattaataaaaatacaaatatcgaatcgaatactaaaaaatgtaataaagagatttcaaacctcctaatctaaagtgaattgattatcaatcataaaaaaatcaaaatcaaaataattaagtatttaacaaagagcattaataatatcaaatattttttgagttcacaaattaaaattatgaatatgtattgatttattaacaaaagaatatttatcggtggtgaccgtttggagtacgattttaattcagaatatttttgagtggggcaacggttttttatcaaaaatgttttgttcggactttattccaaattaattgataagtcaaagtgtttaaaagaatcatttaatttaagaaaagaaaaatcataatcaagaaattgatatttgaaaataatctctgatcgaaatacaattttgattatgttgaaaatcaagaaaaaaaaatgtactaagattccttattttttatttttgctgtgttttgtggttgattcttatttttgatttgtccaagtagttccttccttaaaaagagcagtctgtttattttcactacgatttcttgttgtttcttttgcaaaacgaataagatttcagtttctttttccttcgttttaaaaaaattatttaagagttctgcttcttgttgctcatattttttaagaacttctaattcatagtctatttcttgctttttttgttcaattatgttttgatatgtatttaatttttgagttgtttttaattcataattttgtaatgctgctttttgtttcctaattagcctagaatatttggatcttaccttaagtgcacgctttaatttttcttgttcgattatatccatatttgaatatttttcttcaaattgagaaattaataattgttcgttcttttgagccattgaaatttgatcttcaagtgcttgtttttgacgattaagtccatttacatatgtaacgactttttcttcatgagatgtgaaatcttttagatgtttgctatctgaagcaaatttatcttgtagttttcgataatctcctctaatagaatctaattgagatcttaatctttgtttttctgagctgctttgctttgatttcatcttttggaaatgttatatgaaaacaagaccgtttattaacgaaatgtgacaaaaaaattaaatcttttaatatttttttataatgtcaacttatacagaagtattaaatgatttcccaggatttgatgacagtttgaatacagatgttggttacattccacttgctagtcgtgatcatattcctattattcatattgttggaatatgttgttcaatgctcgcatatcaaattgcttattccgttgaatttgcattgggcactccaattatgaaacgtcttggtgtatcacaagtagctgcatctatcatttggttttcaggtccattatcaggtttaattgttcaaccattaataggttattacagtgatatttctcgtttcaaactaggtcgtcgacgtccatatatcattattggaggtgttggcatcatcattggttttcttcttttatattttgttgaacagattggctcgctttttgggagtgccgagcatgccatgtcaatctttgtctttatcattgcacttcttgagaccaatatatccataaacatattacaaggtccatcacgagccatattaggtgacattatcccacaatcccaacaagttctttccaacaccattggttcccttatgttaggccttgcagcgatcatcactaatctcattggcggtttgaaacttggtgacaaaaccaacggcgtattcaccaacgatgagctcaccataatcgtaggtgtaatcttaatcattattggcattttgatcacacttttctgcggtaaagaagaaccgttactcgaagtaccaatacgcgaaaacccatttaaggaaatctttaaagccataaaaaacataccgcgaccagttcttcgtatttcgctggtctactttttttcgtggatggcgtatttcccattccaaacgacgacgaccgatttcttcggctctgacatctatggcggcgttgccgactctgaagatccgactgttttccaactgtacgaagatgggaaagcgtttggaatgttagtcattgccatctctaactttttagttttgttatattcatttgtccaatcagcaattatcaaattgttgggactaaaactttcgtattcgatatcgcaaataatcgaagcgttagtgttgatacctgttttcttcgtcaagaataaatgggtattgttgggccttttggcaccgctcgggatatcatgtacgatatttaactcagttcctttcgctgtagtcggaatgattataccgttggaacaaatgggtacgtacatgggcgtattgaactgcttcgccgtcttaggacagcagtgttcaagcttcttgctcggatctggtgttggcgcactgtcgaataaaaaaggtccaatcattggatcgggttcggcgtttgcaattgtggccgcagttttgtgctattggataattgtgccacaagaaaataatgaaattaatgaagagcttttacgctcagatcctattaaatgatttgatttatttagaattaataaaaaattttgttgttaaaatttagaggaaaaatatcataataaatgttatgtaatgtttgttgtttttggataacgaaaattttaccaaagtttgaaactgaaacataaaaatgaaaaataactcgtaatgagaatatgcattaaagaattctttctcaagataaaattgatttcaaaccaaaaaacaacaattatgataacatctaatgtactcacaataaaacatttcatttaaaaataaatccacaagacaattttttgaaagtcgtataaatttgaagctttaatttatgtataaaaaaattaaaaaaatctatcttctgaaattttagtaaatttaatggaagtcattacctagtgatcagatttatattttaattattacggcttttcaaatctatttttaatttccaggtatgatttctatactttacatgtgagaagaaatttacttgatcaataaaagaattttattaaattccgaatcataattctattattagaagtcggacgcttcttttaatactaataatttgtcgtttttttatctgatgtaattgttatattcagtaattcttcattatgtaataatatatgtattaatatttatttgtttaattcaaaaatattataaacagcactttgggcttctttagatggtcatgtataaaatatggtatcatcaaaaaatataaatacagatataatttaaatgacgtaataagtttttattttgaaaccttcaatcaaagaatagttacacattcataaagtattcaataaattattgtgacaagcatcacttttttaatgttttttaatcgggctgtattttgccaaaccgttgcttgttttacattttcatttaaaatatttgtcatttatatttttattgaaaatcaaattgaaataaatttgttttttaaagaatcgatcgattgagaggatttggaggtttggtctgcggttatgtaattgatccctcacttcactaaaatttaaattcaaaaagttaggggaaacggttatgtatccatggaaatgccattcaattttaagattttcattgaaatagtcaatttttaaccatgtgcgagaaggacaagtttgttccaaatatccacacacaaaaatttgaaggttatttaagcgaagttaaaaacaacagcgctcttctcaggttttggtttgaaaatgatcttcttgaatttccgatgaacgttgaaatgtttcatatggatgaagatcctcttgaacaaggcaaaaaaatttcatttcaactcatgttttttcaatgtggacccattaaaattttcaaagataaaaaagagttcaataccgacgaagtactgtgtggctttgcaactgaatcaattataccatctggtactttctctgcttcttctgatgaagaagaaaagaattttcaacaaaatccaagtgtaattatgaacggaatagtaaactctgtagaaaaatgtacagagggtgaagaagacacccttttcttggaggtaatatgccaaggtttcaggttcactgtaagtattaatgaaccagaaaacctatctgttgaagaaggaaatattatttctggtgtgtttgaggcaattggttcaccagtgcatagagattatagttcataaaaaaagattattttatttcacgaatttttttgattctaagttgagataaatttgatcaaaaataataataatatgaataacaaaataatgtgttaagtgcagttttttggttcatatgcattgaaacaacttattaaagaaaaggaaaaataatttttttaaagaatgtgatgttggtttggagtgccccaaaatttggggtgttcttttaaacggctttgtcggttttggtccttccttttttaagtctcatggtttgcaaaaataatcgcgttcctaatgatcaccttcgtaaagattggttccgccgcataaaattctactttgatgacccagctcgtaagaagaggcgccaaattgctagagcaatccgtgcaaagaagatcgctccaagaccagttgaaggtccacttcgcccacttgtacattgcccaacagttcgttacaatcgtaaagtaagactcggccgtggtttcacagttgaagaagtcaaagctgccggatttgaaccatctcgtgctaggttcatgggcattgcaatggacaaattccgtgttcatacaaaggacgaaattaagcaagccaacatcgaacgtctcaaggcttataaggctaagatggttcgtgttcatacaaagactgaaaaactcccagctggtgaatccattccatcactctttgcccttccaaaggctgatcaaaaagtcacatggcgtgtaatcaaagatgaagaaaagaagacagaacttttcaaggctaaacaacaagcccacaaagaatggagagcatcaatcaaagctaaggaagctgctaaacataagaagtaaatcattaatcaattggtgattgaaatcaacttaattttttattggaaaatgaaatactaagaacattaggaaatagtgaaataaaattcgaaaaacattttttatcaagattttatggaaaaattaaaaaaaggatttcattgagtttgttcgatttgagtagaccgtttacgatccttttggtaagtttattttcagaaaagtagatcaaaattcatagaataatttgaattggaggataaaatgtccactttttgagcgcttgcagctggtcatttggtaaagttgctgatatgaagagcattgcagttctttcaagtggtaatgacaactgtgggataaacggcgcaattagatcagctgttagaagtgcaattggtcaaggtttaaaaatatatggtgtcgaatggggtttccgaggactactagaagatcgtattcatcctattacaagcagatcagttagtggtattattggtaagtcaggttgccttcttggtaccactccacccaaagatgaaatggacaaaagcattcgtcaaattttagcaaaccttaacaaaagatccattgaaggtcttgttattgttggaaaccttgattcattccaaaaggcacaaaagctaattgacaacggaatccgtgttattggaattccatctgatcttcaagacagcattccatgcacagaaatatcattaggagtcgactctgcagtcaacaatatcatggggtgcattgatcacatccgtagttgcgattcttcaaaaaatcgtagttttcttatcgaagttgaaggaagccataacggttctcttgcactcaggtctgcaattgtttcaggctgtgaagtctgcttaacaccagagaactcagcaaacgatgaagctggacttaagaaaattgcagatattattgacaaaacaacaaagctcgggaagacgcaatgcctttgtataatagcttctggatggaaaccaggaattaaagcccttaaccaatatcttagcgatcattatggagaaaatgatgttgcaattcgagaaacaatactcggttatgtccagcgtggtgggtctccatcagcatttgatagaatattaggtacagaaatgggcaacaaagctgtacaagcactcattgatggtgaaaccgaatcaatggtttcttggaataatggaaaactaagtttggtgccattctctacagtagctaactctaagaaggacctctcagagctattacgaactttcaagctgactaattcctattgagtaaaacttttgttattgatttatataaaagtggcaatgtatgatcgaccgtttaaaagtgtcgtttataataaataacttttcacctgaaatcaacatcatatgttaaaatgtatatatcgcttcttcttaagcccaaaacagagatttccttgtagatccacaatttaatacatcgcaaaaaaaaattatttctttgtgtctaaaccattcctcgtaaaagttgtttcgtcgacagattttaggggggtcgttatataataaaccgatttttgagcactttttgaccatcagaatatcttggtaaataatcaaaattaaaaaatataatatatatattaatatttactctattttaatattatagctagaaaaaaaagaccaccacttaatagaactttttagatacgatttaaaataaagtggtaataaaattaagaaaattgaatgaaaaaaatcattctgaagatttcaagaactaccatttataaaatataatatacatcgaaaataattaagattggacttaaaaaatatatatttcggcaaaaattgatttcgaaatttgcattttgatctgtatatttttttctcaatttgaagacagatttttacttaagtgatgataaggataataaaagtcaaaaaaatcatcagaatatgtttattttcccagtttgagtactcatacatgttaattaaactgaaaatcaaaattcagaaaaacaataaactcattcaaatccgaaaaatgtcaaaattgcagaatgaacagtacccagtttcaaaagcagaaagatgaatctattcctaaaatgcttgcttctcattatactaatgaagaaatacaagatttcttaagtgttggctcggaaagaatatctaaagttaaaaaaggattccaaatgaaccagaagattggtcgtccatcagctttaacttggcaaatgattgattacatcgaaactctttcatatgcgaataccagactaactgatggagatataacatcatctctaacagaaaagttttcaacaaagattttgaaatcaactgttgctcgcacaaagaagacgcttgggtattttttataggccaccactcgttaaacaagagatcactgaaatccaaaaacaaatgagattcgaattttgtcaatgggttcttgacaacaaatcccagttcgagaatatcaacttttctgatgaatctcgttttggaaagtgtccagataacagctggtgaaggataaaacgtggtcactggaacgattcgtgttatcatgaaaaatccaaatttaccccgggattatggtatggggagctattgggcatggattcaccattaatgcaatgtttgagttcggtcgattcatacgagtacatcgaaatcttgaaaaaaagtcaactgattccaacatgtgatatgaaatacggacgttttaattggttttttatgcaagatggggctccatgtcataatgcaactcacacaattaattggttatgcaataatgtttataatgtgccaggatggcctccaaactcgcccgaccttaatccaatagaaatcttgtgggcgattattaaacgaaaatcaaaaaagttataattggagaaagaagatgatgttttcacagctatcaatcaaatttggattacaattgatgataaaattctcgatgcgcttttaggagattttatcagaagatgcgaaatgattagagatcttgcaggagaaagcgcatcgcaatttatatcgagtcacagaacggtgagcaaaaaaattgatgcagataattttcgtgcatggacaagatttgaggatgatataatattggtgatgcaaaagaatgtggggaatcgtctgacattgattggtcaaaaaatcgggagaaataagattcagatcaaaaatcactatcatacatctctaatgaggcaaaataatgaaagactgaggtcaattaccccacttcctagcatttaaagctttccattctgtgctaacaaccccacctgcatttggaattgacaacttgattttcacagatcaaaactcagaagtaaatcgaatgatttacagttttttttgaattacgatagaaacgatgatttttatacaaagcccgaaaacagtcgttttaaattcaattcacttctgagttttgattaccagtttacataatttaatgaatcaaaaaagttatggaaactcaatagaaaattgcctgtggtagcttttaatttattttttttcactaaaataactttaaatttcgtgaaaaaaaaaaagcaaacagctgtaataattatatttttcactcactaaaaaagaaaaaacgttaacatccaaatttttcgatattagcggttgtttaagaggtagatggtttgcacatgggtgatcacggttgttatttagataaatccctcttccacatgattccatacgttctttgtaaaaatatttttttgattaagcctttgtttttggtcttcaaaatttgtgatttttttattaacggtcactggatctcaaactcagcatcggcattcgggggcggttttgatttttatattttacataatccgctaaaatatttcactactattataaacaattaaacatggatttcaattcagttgtaaatgtatttttaaatacatctcaagaattttataataaaataggaaacattgttcaatctgcaaaatcaatcattaacaaatttgataatacttatccattatttttttttatcgaaatgatgaaatagaaaaacattaagaaatatcatcacaaaatgattttaattttaaccaaacaataaaaccattgctttatggaatatgtttttatattaattaataagaaatgttacattaattacaacgatattataactttcattttatatatatttgtgattaaatattattatacaattaattatataaatatgttttggtttatactgtagtgatcgctctttttattaaaaaaatatatcataaaaattttcccttaacatatataacaatctgcaaattactatatgaatactatacaaaactttttaaacttaattcatttaattaattattataacaatatatttaccgacctactaataaattataaaatgacataaatttataaaaattatttttcttaattaaataaataaaagtgtcaaaaatattcttttttattattttactaaaaatcatttttttatataaattcggacactttattttcataagcattttcaggtaataataacattgtttcgtcaatgatttgtcttggcgtttttgatcttttcattaattttctcatttcttttctttcatttgatatttctcttggtgtttccttaatacaaaacgaatcaagtaacgcacctttatccaatttatctttttggaaataatttcttaattctcctttatgtgttgcgtaagcattgatagttttttgccatgcatttttttgccatttcacttaaatcattctcttcaactgttgacattgtttcttgtttcattccattaattgctttttgttcattatttcctttcattgctgaaactccttttttaataagttctttacatttatattctttaatattaactttactgttttgaagtgattgaataaaacttaattcattttcacttaaaaaaatatatgatataccttcattacctatacgtgctgttcgccctattcgatgaacatattcttctttatcaagtggtgaatcatattggataatagtagttacatttggtatatctaaacctcgtgatgcgacatcagtacaaaataatactccaaattcttctgatgtaaatttacttatcgttttaggacgatcgttcaatttgttcaacattcccatgaattcgaaatattggacattttaaatatggagaatatgaaccaatttcatcattatctgtgctggaatggatatcaataatcgtggcttcttgtttgtttcgtttctgcatttcattatattgtaatcgtggaacatgtccacgttctgcatctgttttaaaatcaaagaaactaaaaaagtgataatggaaatcaactgaatcacatgtattaataaatactatacttttcatcccagtatgtcgtcttcgtgcattcgttatttctaatcgtaataataatgctaacattactaatcgttggcgaatatcaacaagaagatatctttgttgtagttgtggtggaattgaaaaatctttttggttttctgtatgaactccaattgtaatgggatcgtttaatgataaatttgttaacgctttaaggtcttctgttaatgtggctgagataagaatagtttgtcgtggtggtaacgattcaataatttctgtaatgggtttgaaaaatcctaaatctaataaacgatcggcttcatctaaaactaaaaattgtaaatttggaaaagatttgaaattttgcgtgttatgaagatgatataaaaagcgtgatggtgtagtaattaaaatattaataccttttcgaatacgtttcttttctgtattaactttttcaccaccaattaaaataccggcaacaataaaattaatacttgaattcatcttatgaatgactgaatatgtttgaagacaaagttcgcgtgttggacaaataattatagcaagtggacccatagatcgtttgataggattaacctcagttggaaatctaacagttaatatttgcattaaaggtattaaatatgataatgttttaccactccctgtatcagcacgcattaaaatatctcggccatcaataataggttgatatgattctgcttgaattttggtaagtgtttgaatattcattgctttaactaaagcatcataaacataaggatttaaattaagtgaatctggtgtaatttttgaaaataatttttcatctatttcttgagttggttgctcaatatcttttttcttcattttttttttaaattttttcctttggtcgtcatttttcagttatcattcaaaattttgaaaacaaaatttttatggggtaccctaacagcccctgtcaaaaaattctatcgtttcagctggaaaaaagattaaaaatatttcatttaagtatttgaacttatacaaacaaataatgctcaataaacatggcctttaaatgaaaatttatcatatatgaaattagaattttactgatttaaagacgacgaccacgacgaccacccttacgacgtgtggaatcatgtggaagaggggtaacatcttcaatacgaccaatcttaaggccggcacgtgctaatgcacgaagagcactttgagcaccttgagctggaagacgacgtgaagaaccacccttacctgagaatttgatgtgaaggccatcaatacccattgttttgagacgtgcagcaaccatttgtgcagcaagcatagcagcatatggtgtagattgatcacgttgagctttaacaaccataccaccagttaccttaacaagagtttcggcaccagagagatctgtaacgtggataaaggtatcattctttgtagcatagatatgtgcaacaccaagtgcaatttcgttttgtgccttagttggaccaacataagcttcttcctttgtcttttttgttgtttgttgttttgcttcaacagcaggtttggacatttttgcaaaggccgaccaaaccgaaaaacctctgttaggggtacccctaattataaatccaaaattgaaaaacttttaatcgttaatatttcatacggataatctggctttcaccaccatgagttaatgttttattcattaactttccggaattggtaacaatgaaagagttccatttatctcaaaaaagaaaattaatcaatcaaaaataaaaatttattgataaaaaaaataatgtggttataattccttccctaaaaatgcatctaacttgggattttcacaagcacctttagatttacatatttcatatggagtcatcgttgtttttgatgcttctgaaaaaagcaaatcaatgttatcgcgtacatagctgcggcacccaaacctaagagtaaattgctttaatgaagcacattttctaaataattttttttgaacttgttcttttggaattcccttttttgctaatcgaattccaagtgataaggttgtttcgcaaagtttacaaatatttggtgtttgttcttcacttgaagaaagagacaaaagaatcaaaaacatcatctgaccaagcattgttaaaaaattgagatgtttacttctaataacgaaaaaaaaattacgataaaattcaattagaaaataaacggctcaatcacacagtttgttggaaaacattcaaaaaagtttaggaactttttcataaagtaattaaaaagttttcgagtgaccgaattacgaaaagtgaaccatattcttgaccgtttagaattttaggaaaccattacagatggaacaaaaaaaagtagaaaagatcattggtattgattcccaaattattacagaaaaatcggaattttatgttaagttttatggactttcatacagacattgtgattggattaccaaaaaacaattaaaaagtactccaaactttacaaacttatatagaagattctcaaagtatcatcagccttttcgcccaattaattttcttaaaaattttaccatatacaaaccatacgaagttccatttgatgaagggtatataacaccacaaagggttattgggattcaagaaaacaagaaacaaaaagaatatttggtaaaatgggtttctttggattatgaatattgtacttgggaaactgatgttccaaaacagctaattactgaatataaaaatttcatatcaaatccaaatcctgttaaaataactacaccttttcccaaaaatccggataattttgttcaaatagtaaattcaccacattttaaaaacgatcatactcttactaactatcaaattgagggcctaaattggcttcacaataattggttaagagatgttaattgtattttagcagatgaaatgggtcttggtaaaaccattcaagccttagctttcttaaaactacttgaacaaaaatattctatccgaggtccatttatgattatttctccactttctgtgattcctaattgggttcaagaaattaatgaatggacagattttcgaactcttgcgtattttggaaatgaagggtcacgtgaagttcttaggcaacattgtttttattcaccagtcaagaatggagggaagaaaacgttgatctttgatatcgttgttatttcatatgatttacttatcaaagatttcaatgtattcagaggcattgaatttgcctatttaattttggatgaagcacacaaaattaagaacttcaattcaaaatcatacaaattttgcagtgaagtcaaagcacgaaatgttttgttgcttacaggtacacccattcaaaacaatgtattagaaatatattccttatttcattttattgatccacaagaatttagaaacattgatgaatttgaaactcaatataatgaaagtgatcctgcctcaatgaatcaattacgagaaaaaataacaccatatatcttaaggcggaagaaagttgatgttgattatcccataacagccaaagaagaaacgattattgaagttgaattaactaattcacaacgaacaatatataaatccattttaaatgataacagagaagttttattacaaacattaaccaagaagaagaccaatttaaataacatattaatgcaattacgtaaagtttgttgtcatccatatttaattgatggtatccaaactacagttgaagaacaatataaacaaacgaaacaatatccacctgaatatcaattaactaatgatgaagttatgcaattattaattatgtcgtcaggcaaaacaatacttattgataaactattaccaaaacttcatagttcagggcataaagtattaatattttcacagatgacacaagtattagatatcttagaagattatttaacatataaaaactatttatatgaaagacttgatggtgctactaatacatcagatagacaatatgcaattgatcaatttaaaactaatccaaatgtatttatctttttattaagtacaagagcaggaggcttaggattaaacttaactgaagcagatactgtaattatatatgatagtgattggaatccacaaaatgatattcaagctcaagctagatgtcatcgaattggacaagagaaagatgtaaaagtatatcgtttaatcactagagctacttatgaatcagaaatgtttctaagagcatcgaagaaacttgcgttaaattatgcgcttttagattctaattctagtgaacaagacaaagaaagttataaagagattgaattaatattaaggaaaggagcatattatacatttactgaagaatgtgatgaagccgataaattttgtgcggatgatattgatcaaatattaatacatagagctcatgtagtgaatagagatctgattagtggtgggaactcattattttcgaaagttaactttaatggtaatgaatcgaatgagaataaagttaatttcgaagcgccgaatttttgggagacaatattagaaccaaataataaaaaagatgaagaattaccacgaagaattacaagacatattagttatgctgaaatggatcgatatgattctagtgaagaatcagaaaacgaagatttatctgataatgattttaagccatcacaagatgagcctataaatattccttcttctgctgaacaaattaagacattttcatcatcaaagttaaatttattttataagtatttgtttaattatagttatcatgttattcaaaagaatatgaatgaaaatgaatttagtttcattcagtttttgatttcatatttttatcggaaattaagttataaattacaagaaagattttatctttatataaaaagaactatagttttccctgagatacatattaataatttctctgtttctatatttagaaatcctttttttataaataatattatcggtgaaaaagaatttttacttatggaaaaactcgaaaatttatattatactgcaatttatatatcaaataatgcattaccaaagaatttcgtgttcgcgccttcgatgaaaatggatttatttaattggtgtccaagtgatgatattatgttaataataagttccgcacattctccttatgaagtttttatgtttactataaataaagttttccctcaatatgaaaacattgaaaaatattcaaaattactattaaaaagaagggatttaattgtcaatgaaatttcattgttaattccggagagtttttcagccgaaaacaaaatcattaaatcatttcctgatataaaatatttaagtccaaacatttttaatcaaaacttccttacaaaaaatgaccaattaaaaattattcacgttttaagtttatacggtgtgcctcaattggacccaatccaaaaaatccaaaaaatagcttgtttagaacatgttaatataaatgaaatttattcgttcgtccattcaattatcgaatcaaatcaacttttgaaagaaagaatcaaaattaataacccaaagggcaccctgtacgatttgaattggattcctaagaaaaagttggcatggacaaaaaatttgattagtttactttgggagataaggtcgagattcgaatggtttttactaaagaaagaaaaatttaaattcgataaatggaataaagccccgaattggtgggtaaaaagttgcgattgtttcttgttcgaaaatacttgtaattacggttttttatcttttgctatatttgcatatataaccccaacttccgatagcaacaaacaagaaactcaacagtttattgcaaaatggaaaaaaaaagagatggaaacattaagacctttttgttgtaagagatatgaacatttgaaatttttgtttccttttaacacaagatatgaaaggcttaagagtgttttttcacaggcattaaaacaagatgcacatgaataacagatattttgatttaccaaattgtttgattttttttatataaattaaaattgttaataaatcaaattttagagtacagtgttttgcttttaatgaatataagtttcacaaataattttcttctttttggattttttttttttttttttgactttttaaatataaacgatcatttttcattcaatcttccatttaaaagttgataagcaaaaaaataaaagcaattcactgtcaatttacacataatttctaagcagatctttttcttgagctcttccatttgcaattttcaattgtgtcttcatcacatcctttaatgaaaataccactctggtgaaccaaaagccttactttatcgaagtcaacaccattgagttctgatttgtccacatattcactcgcttcttgcgatccaagctcaacaaatccatgtgaagggaagttgccttgttgatgaaacagtgatccatctattgttttgatgcctaaaagtcttgcaaatacgaatttatctactttaagaactttttcgttgacccattcaattccaataaaatcaatataaaaaggatcatcttcgactattttcaaagcattgtataacttgtggtaaaatctgctgttagcattgttctttctttggaaaaattctcgtactaattctccaaatgtcatttctttgtcttgccaataggaatgaggaataaagccaagcctatgaggattaaacttaactccttgatctgaacaaattgaattaaattcatggtctgcagaattgacattattaatttggggaataggtagagttttttgtcttgatcctttctggttcttgaatacattgcctaattgtacttggcgtagtaattcaaggagattaacatttggtggaaaattaattggtgttgatggagctctttgatggcgacgtgacccagcctttgactgctgaggacgtgaattagactttttaggtgaattgtttactttatcaaattcaagagtatttggaaataaaattgatgaattgtcattttcaaatgaaagagtgtcttgatgtccaagggttgggcttggtaattcgcttgggacgttgaatgcactccatccaaacccaaaatcgtcattatcgaagttgaacgccatttacttgttgtgttcaaatgaaaaagtattcaatttaaataaaattctgaatttttttcattaacatatttcaatgcatttagtaaattgaagaacgttcttccatacaaatttacctgtccgtttatttttatcggaaatggggctccttgtttcgaattttcctgcaaagtgacaactcttcccgccaaatccaaacaacattatcggtataaaaaaccaccccaaaaaacaataaacgtatattaaagtgctttccagcttttcaaaatttgagttaaaccaaaaaaattgtgaaagctatattcaattcttttctgacagcggttatttaggggttgtttgatcgaacaaatcaaatgaatatattgagcataaaaatattgtacttctaaaatatttcttttgtcattctgttggttgaatttatagcttgtcactaagcccacagaataatttttgagcttaaggagagtgacgattggatgctagaaatggaaaccgtttgtttttaatgtgtttattatatattttgatcttattcgaaattaaactttaaaaatatccaattctttattcgttttatttcaataaaaataaattcaatttttaatttaattgcaagataacataaaaaaacaacatttttaaaacagatctgttctcttagaagaattcagtcatcttgtgcaaatatgggcaatcaacagggttgattgaattccctggctcacacaccgatagaaaggggcaccccttacatggcgtctttgagatggggcacgccagtggctgcatcgggcctggcttgagagtattccctattttaaagatctggccgctgcttattgtagctgttaccaattgttcggcttcatcatcattataacgaagatttccaatgccagatgatttgatctttcgctttaattctcctactgtgatacctggctggtttataacaaattgcactacgtggggaagaagttggtcgattagctctgagttaaaagttgatccagaaaaccatattccacctgtgacttctgatgaaggatcaatctcaaataagaatagatttttctttttgtctgtgacagaagtaacttcttttataagttctctttgtttcatttggttgagaatttgaacaaattgcttttcatcaagatttgtttttttcttgatgtcacctctccaaattcccttatcgccagcttgttcaattaatgaatatattctgtggtgttcttcatttagtccagaaaatttatctgcaagttcatctggaacatatctataagtatttcgaccatcttctgtttgtatattacgaacattaccattactaataagatgtctaaggaacttaaataaaactgttgtttcgatcggaccaccttcaacttcaagagcctgtttaatttcttcaggagaaaaatttctctctggttgctcttgaaaaacattcataaagcgtgctatcatcgctctttgtttaatttcttcacgttttgatgcaatttgtttagaagcagcagacatgaaactaaagccaaagctttggcttcttcttaaaaagtcgaatttttgaattcatattgatcgtaaacctctttttgtgcaaatggaaagtttcagaatcatgattgttagatcaaaataaaattttgaagtattcccaagaataactttatgaaatgtctcgaattgccatttcgaaagtaaatttaacttttaaccttagaacacattccacatcattcgaaacgatgataagaatacgtttagattcagtttgctttggcttggccacccaccaataaatccacaattaacaaatatattttatgaatatataattattttttaatgaggaaatgattttggaatgattatacttaataattaaagaaatgtttagaaatcataagtgaaatttgaaccgtaactcaatttcttttaattagaaagacttaaacttaagcgatttatgctttctctttagttacttcattgctcactatatgtgggaatatagaaggaaaaagggcaggttttttggcaaaccaaatagactttttaaatacaatatattcaaaccgttgtttttaaaagaaaattcaaagaactaaatttaatacaaaagtgtcattactcagactcgaatgcaagcaagcgatcctgacttccttttgaaaattgtccttattggtgattcaggcgttggtaagaccaacctactttctcgctttacaagagatcaattcaatccagaatctaaatcaacaattggtgttgaatttgcaacaaagacaatggagattgaaggcaaaactgtaaaagcacagatttgggataccgccggtcaagaacgttatcgtgctatcacttccgcttattatcgaggtgcaattggcgctcttcttctttatgatatttccgcagctctcacatttagctctctttctaggtggctccaagaacttcgtgagaatgctgacagcaatattgttgttatgctcgttggtaacaaatgcgaccttagtgaactcagagctgttaccaccgaagaaggaattggttttgctaagagcgaaaaccttcttttcattgaaacatctgctcgtcaaagcatgaatgttcaagaagctttcacaactttgatcacagaagttgttcaccgcctttccaagaacgatctctctaaagacagtggttcaccatctcaacctgaaagaggcgtttcaatcacaagccaagacaagccaaagaagaatggtggatgctgcaaataaagttcgtcgtaaaaaatcctttactcgattctataatagcaatgttgtttctatttttttagcttcttgaaatgaaaagtgtcgcctttatgtgaaaagtgacggatattttaccatctttttcaaatagataatttcgctaccaacttttttttatatttaaatgttttggcaattgggaaataagaaataccttagagttggcacatgaacgaaatgcaatttcataatcgttgtgtacggaaactctcaaaaatcatttaattttcgagtaaaccactcgaaaagtgaagaataagagataattgatcgttgttaaagcgataggaaagtgacggatgcatttttgggatttttgagaatttttatacaatttgtgtaccaaaaatgatttgaatgattatctatccaaacaaactactcaattatttcacagtgtggatgaaaatctgttcaatttccactttttgagtaatttatacatcatgtgttatttgtgaataaaatattcaaaattcataataaaatttgaataggatccgttcttgaaatattataaatgtgaacattatatcaaataattataatttattagcagtgttttttatttcaaccatttcgccgtgtgttgatgaaatttcattgatggacctgtatgttggcccttcaccaaaacaatcttaaaatgaacaatttttatttaacatgaatattttaatttttttttctatcttcattcgaggattttaatatatattttgtgaaatcaatttatcaaaaaatttatttgttttaacaaagagcgatttcaacatcatttttcacacaaacaattgaaacatttgaatcaacaactgaaactattactatcacttaaatagtattttgagttatcaagaatatgaaaatgcaatcaaaaacaaaatcaacacagaaaatgttattaatttatctctctctcatattgaagtagatccatttgccaaatattttaaagagaacaattttatatgaatgtaatgtttttattgtatttgctataataaacatataatatataatagaaggaaacacaagacccgtaaacaacaaaaatgtttgtatctaataaataattattttgttcttaaaatatgtttatttatatctgactgacaaatttttcttcttttaaatcgtctgcaaatggatcttcttcaatatttgaattattaatcccaaatgaaaatgtattatctatttcattaattttattattattttcatctgaaatattcatttcttcttcattttgtttccgcttcttattttgatatttaatcataaatattatgattatcattataaatacaataattattacaattacaataacaattataatgataattaatgtattattatcattagtgtttattattacatcttcgatataagaaatataaaagaaattcgaataataagtaaaatattccggaaaatatataattgtataattgtaatatatgaaatcgacataaatatatttagtttcagattcaatgaaagtaactgaataagattttaagaacgtataataataaattgataaagtttttattaacgataaagaataagttaaagtataagtgttaacgaaagtaaaattcatcgaaaatgtattgacataagtgtttgaatcaaaattactttttgatttcgtaaatgtatttaatttcgtaaatgtatttgagttagtgaatgtgcgtgttggctggagacattcgtcaagtgttgctcccttagtaatttccatatttccaaatgtttcattttgatatgtttctattgtcataactcttgtcgcattgatattaacaaatgcatcattttgtatttctggtgaaatttctccattaaaatgaatacattgaagtgatgtacaattagtaaatgcacatgaattaatataatgaacattttcatcaataaaaattctttctaaattattacaataagcaaatgtataattcataatagaaatgactgatttaggaattgtaaatgttttacttttcatattcggataactaataatttgtgtaattactttattatataaaacgccatcgttttcataattcgaatatttgaaatttttttctgaaacattaataaattgaagtttcgtacattctaaaaatggattcccaattgaagtaactgcacttggtatataaatattcacaaggtttgtacatcctctgaatgcatctgagccaatacttcggacgccttcatataatgttatcgtttcaagtcctatacatttgtaaaatgcattatcactaatgctattacaacggattgtaatgttatttaatgaaatacattctgcaaatgcaccacctccaattccactcattaatttatctggaaattggacatgttctaattttggacatgatgcaaatgctctactatttatatttccaactgtttctccaattattactgttgttaataaaggccattctctgaatatataactttcaatcacgccaacattaataattataatacgctctgttacattcatataatatttttaataatcaatgaagtcagatattgtgagattttttgtctcttcgtcatatgattgctttgtattaacaaaaaatataagcaataaaatcagaataacttcgtttttttgatgaatgcttttctgattaaaataaattttggaaagaaaagtaaaaacaaaaaatataaatacgaacaaagttatatttgaatatatagatgtaattaatgcattaaatatctttggtagatttttaagaatattattgctgaaattcattgataaattacattgaaaactttcattaaaatgatatatattatgtaggatatgaaagattgcagttattttggaatataaatacgaagttatgaaatttgaagaaacgaaatgttaaaaacctattctgttgttatctagagaattgttgaatgaaacgcattgcagtaaatgatctatgttgtttgctgttcgaattttttgtaaaaatattttactttttatgtgttcactcttgttacttggcatgtaactaatgcttttgttatgcacatgtatgttcattgttttattatgaataaaaggattagaataatatttatatgacataaaaacatgtttgttggaatttacgagtaggatgaaagtgccaatgtgaattaatgttatcatcaattgagaatatccatcatatttcattgatttggtatatgcgtttccaatataaatctactttggttgtaacaaaaaacctataatttttcattagaaatgtgtgtaacagctgttttttgatgtgacacgcgagtttttttcgaaattattttaaatgtaaaggcacacacatgaagcattaaatgacatgaaaagatttcatttacttgctcataagtgaggactcgacatttgaatgggatttaagggaaaacgacaaaaaacaaccaactttttatgaaaaaaaagtttcaattgaatgttcaatcaacttttgtgtgtcaatggtaccgatcatttttaatacaaaaaaatgaaaatataaatctaaatatctatatttggaattggttatagaataaaaaaaagatatatataataaaacacatcatatgttatttatgaattaaatattcaaaatttaataagaaaatttgaataggacttgttctcttttgttgaacaagctggtgataaaaatcggcgatatcgttttaactttttgaacgtgttctattaaagccgataggaaagtgctggttatccacaagatatagcagaaaaagcacttttctaataatttacttcgttaactttttgatggcatatatggtcatataatattcaacaaaaacagccatgctgaaaaattttgaaaaatttaaagaaaaggctcggacatatatagagcctaatgattatggtatctttgtatcacaagacaatatatttcggattgaaagaccatctgtttttattggaagagcatcaccaaaatgccatccagatattgatttatcagaatatcaaaatcaagatgtatcacgcgagcattgccttctaacactttgttctgatcgtaatttttatcttgaagtaatatcaagagatgtaattgtgaacaccaaaattttttataaaggcacacaaatacgtctaaatgatggagacatcattgatttagggggcatttcgcttctttttttagaaaacaaatcttttattgaacagatccaaattaaatgtgaaaattagaatccttttaataaaaaataaattatttcaaatgtaatataaaagaatactcaacgatcattttaataagccattacatgatatgacaaatgtaaaattttattacttctcatcgatcagttgaatatatttgaggagagttccgcaaactccaaatcgtgaaatattttctcaggaataattttatatacagtttggcgattatgaaaaacattttaatctttcattacattaaaagtcattaattaaaaaaaataaattataaaataatatgaaattttatttcaaactcaaaaatatataaaatattttcatttaaaattaatatttcataccaagtgcgataccataaccaactgaactaataattaatactgcgataatcattgttacccaaccaattttgaaatattctggaccttctaaaaatgtttcttgtgttaattgatctggataaccataaacatgtttacaaacaccactaactaatgcgttagggaatgatgaaatatgaaatagttgtgcgccactaatcataattgcacttaaacaaacaaataaactaacatgacctgtatgtcttcctaagattgcgataactggataaaggattgaagcagctgatgtagaattaattaatgaaccaagaataccttcgataagtaaaaagatagttaaaagtggccacattggaatagattctaatgcacctgatactgatgaaagtaaatcaagaagtccgcttaatttcatagcttcaccaagtgcaagtcctccacccattaatgaaagtgttgaccaacgaatactatgaaaatcttcagtatttaacatacctgatccaaaaaatgagataactgggattaatgctgtaatacctacattaccaagaacacttggaaatgtttcttcaagtgtccataaaactatagttaatatagtaataatacatgcatatgtatgtttaattgaccatggatcatatttttcattagaatttaatgtaatattaatatgatctgttaatggtttaaaacgtaatattaaatataaccattctgctacacaaattaagattgataatggaaatccaaaacacatccaatctgtaaatgaaatattaatcttttctgatgtttgcatatattgtaatgctaatacattttgtggtgatgctatagttgtaggcattcctccacaattaccactccatgcaataccaaataaaaatgctttaataaatggatcattaggatctaatgaacgaataattggcatcgttaatgataatactaatgtcgtcgatgctacattagataaaaatgctgctataaataaattaattaacattatcgttaataaaatccacttaggatttttagataaacgtttaaaaacaaaccctgaaatacgatctgtaatacgtaatttagataaacatgcactcatggtcatagatcctaaaaatacaaaaataattggatccataaacttccaagcaaatgtagatgctaatgtagatgcactaatacgaagacgtgtttctgaatcaataccaactccaaaccaaacacatataatagggattaaataagctgaagcatatgctggaagtccttctgttgaccataaaaaatgcaacagtaattaataatgcaagacatgtatgttctgttggatatgattttaatattgggataatataaacaactccaaagattaatcctgctataagtggaagaaatgatactttttgttttggtggagtatcaactgttaagttctcagtagtaaacgctgataattcgttgtcactctggaagattaatggtgacggatcagtttgaagaacagctgtgttgctcatcttgaacggtagcacttttccatatcgttttcatatcgttttattatggtcaaaattgaatgtgctttatcgttttaattcaataaaagtgacaaaatatgccacatgcttctttacaacacatgatatgccaaattcttaattgcagataaagagaaacttacgtttggactgtagcctattttttcctcatggactaataagaaatatctgggaaatgtattaatttgaatcatgtttctgatcaaatcgaagaaactcttcgctgaggctttaggaatttttggaaacaatcgtttccaaaaaataatacttcatgttggttgttggaaaaaatcattttaatgtttcaaaatcttccctatgttcctttctaggtgatttttattgtttcggagcatgaaacatatcttggttttagtttttttgatggaagataggttttggatgatctcttttaaaatttattgtcaaacgccacgtcgatcaaattcaatttaaatacaagtgggatgattggaattgaatgggattttgtgaggagttaaaatgattttttcgtgtttgaattacaccccattcattttttcaattgcgattgaaaaacttatttaattttgaggttacagcgattcaaaaagtgaaaagtgatggaagactccactctccaggcccctctccttttacaaagcgattcggaattatcagcgtttactactgagaacttaacagttgatactccaccaaaacaaaaagtatcatttcttccacttatagcaggattaatctttggagttgtttatattatcccaatattaaaatcatatccaacagaacatacatgtcttgcattattaattactgttgcatttttatggtcaacagaaggacttccagcatatgcttcagcttatttaatccctattatatgtgtttggtttggagttggtattgattcagaaacacgtcttcgtattagtgcatctacattagcatctacatttgcttggaagtttatggatccaattatttttgtattttttaggatctatgaccatgagtgcatgtttatctaaattacgtattacagatcgtatttcagggtttgtttttaaacgtttatctaaaaatcctaagtggattttattaacgataatgttaattaatttatttatagcagcatttttatctaatgtagcatcgacgacattagtattatcattaacgatgccaattattcgttcattagatcctaatgatccatttattaaagcatttttatttggtattgcatggagtggtaattgtggaggaatgcctacaactatagcatcaccacaaaatgtattagcattacaatatatgcaaacatcagaaaagattaatatttcatttacagattggatgtgttttggatttccattatcaatcttaatttgtgtagcagaatggttatatttaatattacgttttaaaccattaacagatcatattaatattacattaaattctaatgaaacaatatgatccatggtgaattaaacatacatatgcatgtattattactatattaactatagttttatggacactttaagaaacatttccaagtgttcttggtaatgtaggtattacagcattaatcccagttatctcatttttttggatcaggtatgttaaatactgaagattttcatagtattcgttggtcaacactttcattaatgggtggaggacttgcacttggtgaagctatgaaattaagcggacttcttgatttactttcatcagtatcaggtgcattagaatctattccaatgtggccacttttaactatctttttacttatcgaaggtattcttggttcattaattaattctacatcagctgcttcaatcctttatccagttatcgcaatcttaggaagacatacaggtcatgttagtttatttgtttgtttaagtgcaattatgattagtggcgcacaactatttcatatttcatcattccctaacgcattagttagtggtgtttgtaaacatgtttatggttatccagatcaattaacacaagaaacattttttagaaggtccagaatatttcaaaattggttgggtaacaatgattatcgcagtattaattattagttcagttggttatggtatcgcacttggtatgaaatattaattttaaatgaaaatattttatatatttttgagtttgaaataaaatttcatattattttataatttatttttttaagatgttcccataagatattaatgaaataacttgagaagtaacaaaatttttggttatgtgaatctttaaaaaactatcgaataaggaattatcttttgaaaaaatgattataaattatttggcaaaatgtgttcctcgttaaataaattcaacaagacatcaaaatgaaaatatgaacatataagttggatgatttattttaaatgattgcaaacaagaagttgaatataatgaaagattattaaattattttcctgattaaccaaaggttaatcttttactttatcatttggaatcacttcaaaaatatggatttaattttaaagaacttaatcaacttattcatcgcttttaattcattaccgggacaaattttgaaacattcaatttttctaatcgattcagatcaaaattgagattgattaacggtgaatcggtgaaaatttctatacgaaacaaagattgagaattacttcatttttattttgatgtcaatggaagaaccacttcttgcaaatgctgaaattgatgttacaacagataatgtaacagaaataccttcacaagaaaaaatagaaacacaacaagaagaaataaatctcatttcatttgatgaaaatgatgaacaacaagaacaaaaagagaatcaaaaagaagaagaaaaaataaacatcaataataaagacgaaacatcttcatgtcaaataatcaagaatggatttataagagctattgaatttgcagatagtgttacatgtcaatgtgttgataaagtaaaacaattacatgtcacgcaagtcctttctaatgtatttgggaagatgtgtcatgcagttgataattccacgattacaattttttcatttattccaaagtaaaagtaaaaagaatcatttaaaaaacagaatagataatatttaataataatttgatttttaaagttatgtttatgaagaccgtttactaaggataaacgttctattaataaaagaaaaatgaggagcaaaaaaccagttcttattgaagaaaaaaaaaacccgaaagagaaagagaaagaaaataatcctccaaaaaaaataaaaaaagaagttatttcaagtatttcaaacccacttttaactccttttaattggaatggttatgatgtatttttaattatgattcttgttatattaggtacatttagtcgattttggattattcaatatccacgacatctagtttcatttgaaagtaaccaaattcatgttcttaattcgtttcttaatggatctttatatgttgataaacaaccaccatttggaagttatattttatcacagttagcgaaattttcgagtatgatctttcgtatgaaatgccacgaacagaatataattatacatatcataatatgaaatatgtttcacttcgttctattcctgcattttttttcaacattaacgattccaatttcatattttatagttcgaagttttgggggtaatcgttttacatcattttcgacaggactttttgtaatgtttgatttcttattgatttcgcttggccgacattgttttacagatggacttttacaattttttatttcagtttcagtacttttttcatcactttctacacattttaaagttggaagtatttatcacagtatattatatttaatttcagttattttttcaggattttcattgtcaacgaatctgaatgcttttggagtttgcatcttttcattattatttagtcaatttcgtcttcgacttcttttaacaggaattattattccaatttttatctttttatctcattttctattcaagttatatcagagccatataaatcagagcattcttggtcattaccacaagaatatcaagacacattactttcaccaggacaaatttataatattcaacataaattaattcttcgacacagcattgaacttattaaagaaatgtttcgattacgtcaattaacatttgttgataaatctgaatggtatttatggccaattatgggatgtaaatggaatattttatggacacaaatgaatcgatttgtttcatcatttggtaattttattgtttgggggataatatttcttattgtaatttatttgattcttaaaatgctcattcgccatcgaattgaaagaccgcttgataaactttgtgttggttatgttatttgtttaatttattatattcaagggttaaatgaacgtgcaatttgcgattatgaaatatcagatctttttggtctttggcttttagcgctttttattgaaacagaatttaatgaaagtgtttatggatttgttcttccattgttaaatattattacagttgtcattttttatttatggagtccattagtttatggatatgaacattttgatcaacgctttcttccatattttgcaaaataaattttaacttttataaatatatttttttttttttcattttttcattttttgtgaccaaataatgattcaataatgaaaagtgacgaaaaattaataatttttttcttctttatttaatggattcacaatcattagggatatgtatttctattacgaatgaatttatgtcacgtccattaaatgcattttttttaaatccagttagtaacgacgagttacccggatattctgaagttatttcaaaccctatggatttttcacagattgaaagtaaattaagccaacatttatatcgaaatacatcagaatggtataaagatgtttgtttgatttatgagaacgcagttcaatatcatacagaaactagtatttggggtattatagccacacaattattacatgattttgaaaagatggccaaaggattaaattttcaaagtcgtgaagaatattttgaaagtctttctaaagaaacgattaaatttgggaaacttatttcatcatcaccacataaatatgagaatgattcatttcttcaaggatgtatcaaacgttcagaaagtgttactcgttttccacaagaaaaggttggttacattcttgataaactaacagagcattcagacgaagaaattgttcgaatttctattctttatattattaaaagcatgcacaaagatccacctttaacatatgaagacgacacagttaccattgattttgataaattgaaagatcaaacattaaatgcgttatatttatattttcaaagtctctaataatttatacatgaatgaataaatgaataaataaataaatataataataataataaaaatatttttttgttgacaaaaatcagtcaaatcaataaacgtccaccgtgtaataattgatttggtcattcaaaagaaaagatggaaacagttacatgggaaacattattaagttcagaacctcgtttacttgatgcagccaagaaattatggccatcaccaacattaattcaacaaaaagttatccctttagcattagaaggtaaagatattttagcacgagcacaaacgggtagtggtaaaacagcgtcttatattatacctattttaattggaattttacgttcaccacttccatggagttataaagctttaattttagttcctacacgagaattatgtaaacaagttaagatgcaatttgaagaattatcacgttattgtcatatttctataacacatttaggtgatgatgtttcacttgcgtcacaacgagttgctttaacagccaatccacccgcaattattattagtacacctgcacgtattacattattatcacttaatatttataagaatatttcattttttagttatagacgagtcagatcaacagttaggattagatcatggcccagacattgaacaaattattagcaaacttccatctacacgacaatcatttttaatgtcagctacattaggcgatgaaattgaacgacttcaaacgttagttttaaattgtccagttcgtattgatattcaagaagaaagtcgtagtaatcatttaatgcattattatattaaagttgaagaacaacgtaaatatgaagtattttatgctttacttcaaaacagaagtattggacgacgaattcttttatttgttaataatagtaataatggatatcgagttcgattatttttagaacgatttagtattaaatcatcagttttaaattcacaattaccagtagcatcacgtattcatattttacaagaatttaatcgtggtggtattgatgtattagttgctattgatgaagataatgaaatttttagtcatgaatttagtgcatcacgaggtattgattttcaaaacattgattgtgttattaattttgaagttcctaaaactattgaacaatatattcatcgtgttggtcgtacagcacgaggtatgaaagaaggtattgctattacatttattaataatgagaaagatattgaatttataacagaatatcttcgaacacaagaaaacaatgaaattcgacgatttgattttaatgttactgatgcggaaatctttcgatatcgagttagttcagtcttagaaagtattacgaagacacaaattaaatcatctaaacgcattgatattaaacgtgaattattaaatagtgaacgcttgaagagtcattttgaagaaaatccagccgatttgcaaatgcttaaacacgattcgtcacttcttccatctcgtgttgacaagaatcttcgagttttacccgattatttaggtaaccaaattcgacggcaacaaaaatccactcacacaaaaggcgcgcgaagcgaaaatgaattccacgcacacacgtaatcaattagcgaaacttgacagtatcaacgccgcgattaagaaacataaacataagaacaaaaatcgacgtcattaacatataaatagataaatacatacacaaatataatgttatgaagaatgataaataataaatttaataaataattattatatagaaataatttgtattttatttttatttttattttttaataatttgatgaaatgtaatataaaatgttatacatcgatatcaaaaaatattaaatatttggacctgaatcatcaacttcagtcactgctcaaaaaacatgaaactgttgaacgtaactctatatgaaaatggtttttattagagaaaatgtatatgcaattgagaataatgcattttgttcgtgtaaaaatcatatattcattaatgttacaaatgaaaatttatatttttctaattaaaaactatggaattttatatggaaaacacatcaagatggtaatgattaaccttatgaatactatcacaaaaaaagaatacatttactaaatcatctgattccatttgttatttcaaatttatttacttttttttattcaaatggtataaaattgactaatacaataacattaacacaaacattctctgttacacaaataattaattataatttgacgtacgatttcattttctgtttctatttacattttttgttgaattatgtttggaaataaattttttctgaatatattattgttgtatatttaatattttatattatggcaatttttttacaattatatatatatcaaagtgaaaaaaacgataataaaaacacaataataattataagtgtttgtgttgctgttgttgtaattataataattgcaatacttgtcatcatttgtattcgaattcataacaaaaaacaattaagtaatgaactagaagtaaaaagtttccgagataatcaatgaataatattaatgaaggcccatttgcagatgattttatagaagataaatttatttatcatatttattgtataaacgcaggatgagcaattaagaaaaattaacaataatttcttttgatataaaaaaaaatatatgttttacctttaaaatctgtattgattagcctgttgtcatgttttcaatacttctcaagcaatattataatgtttgtcttttcaagggattttttatgtaactacataatatcggtgatttgaattaaaatatattaataataattgatgatagttgcgattattttatatgtgcatttatgacatttctaataccaaaagaaaatcattagtttgaaccgaaataataattaatgatattgtatgtgtttcgatatactgtatttaaaaaataatcgtgttgatttatttaggaaaataatcttataaaatttcccaacttgcaaatgttatttgtgaagatgatatataatccaattataagaacaaatgtatattatcaaataattttaactcattttaatggagtgaaagtaggtaatagtatattgagggtaaatacatcaaaatataaaaattacatttaaagtaacaagttattttatatcattataaggctatcaagcataagtttataaaatttacaagggagaaaatgcaataacgaaagaaaacgcattcttgtatattaaatattatgaattaaacttgggatgataaatgattgatagaatttgattaatggtcccaattttttatagtatccatatttttttgaagctatcaataacgcacattgagttccttaacttgtttcaatataaaattatttaaaaatataacattttatattacatttcatcaaattattaaaaaataaaaataaaaataaaatacaaattatttctatataataattatttattaaatttattatttatcattcttcataacattatatttgtgtatgtatttatctatttatatgttaatgacgtcgatttttgttcttatgtttatgtttcttaatcgcggcgttgatactgtcaagtttcgctaattgattacgtgtgtgcgtggaattcattttcgcttcgcgcgccttttgtgtgagtggattttgttgccgtcgaatttggttacctaaataatcgggtaaaactcgaagattcttgtcaacacgagatggaagaagtgacgaatcgtgtttaagcatttgcaaatcggctggattttcttcaaaatgactcttcaagcgttcactatttaataattcacgtttaatatcaatgcgtttagatgatttaatttgtgtcttcgtaatactttctaagactgaactaactcgatatcgaaagatttccgcatcagtaacattaaaatcaaatcgtcgaatttcattgttttcttgtgttcgaagatattctgttataaattcaatatctttctcattattaataaatgtaatagcaataccttctttcatacctcgtgctgtacgaccaacacgatgaatatattgttcaatagttttaggaacttcaaaattaataacacaatcaatgttttgaaaatcaatacctcgtgatgcactaaattcatgactaaaaatttcattatcttcatcaatagcaactaatacatcaataccaccacgattaaattcttgtaaaatatgaatacgtgatgctactggtaattgtgaatttaaaactgatgatttaatactaaatcgttctaaaaataatcgaactcgatatccattattactattattaacaaataaaagaattcgtcgtccaatacttcttttttgaagtaaagcataaaatacttcatatttacgttgttcttcaactttaatataataatgcattaaatgattactacgactttcttcttgaatatcaatacgaactggacaatttaaaactaacgtttgaagtcgttcaatttcatcgcctaatgtagctgacattaaaaatgattgtcgtgtagatggaagtttgctaataatttgttcaatgtctgggccatgatctaatcctaactgttgatctgactcgtctataactaaaaatgaaatattcttataaatattaagtgataataatgtaatacgtgcaggtgtactaataataattgcgggtggattggctgttaaagcaactcgttgtgacgcaagtgaaacatcatcacctaaatgtgttatagaaatatgacaataacgtgataattcttcaaattgcatcttaacttgtttacataattctcgtgtaggaactaaaattaaagctttataactccatggaagtggtgaacgtaaaattccaattaaaataggtataatataagacgctgttttaccactacccgtttgtgctcgtgctaaaatatctttaccttctaatgctaaagggataacttttttgttgaattaatgttggtgatggccataatttcttggctgcatcaagtaaacgaggttctgaacttaataatgtttaccatgtaactgtttccatcgtttcttttgaatgaccaaatcaattattacacggtggacgtttattgatttgactgatttaaaaaaaaaaaaaaaatatttttattattattattatatttatttatttattcatttattcattcatgtataaattattagagactttgaaaatataaatataacgcatttaatgtttgatctttcaatttatcaaaatcaatggtaactgtgtcgtcttcatatgttaaaggtggatctttgtgcatgctttttaataatataaagaatagaaattcgaacaatttcttcgtctgaatgctctgttagtttatcaagaatgtaaccaaccttttcttgtggaaaacgagtaacactttctgaacgtttgatacatccttgaagaaatgaatcattctcatatttatgtggtgatgatgaaataagtttcccaaatttaatcgtttctttagaaagactttcaaaatattcttcacgactttgaaaatttaatcctttggccatctttttaaaaatcatgtaataattgtgtggctataataccccaaatactagtttctgtatgatattgaactgcgttctcataaatcaaacaaacatctttataccattctgatgtatttcgatataaatgttggcttaatttactttcaatctgtgaaaaatccatagggtttgaaataacttcagaatatccgggtaactcgtcgttactaactggatttaaaaaaaatgcatttaatggacgtgacataaattcattcgtaatagaaatacatatccctaatgattgtgaatccattaaataaagaagaaaaaaaattattaatttttcgtcacttttcattattgaatcattatttggtcacaaaaaatgaaaaaatgaaaaaaaaaaaaatatatttataaaagttaaaatttattttgcaaaatatggaagaaagcgttgatcaaaatgttcatatccataaactaatggactccataaataaaaaatgacaactgtaataatatttaacaatggaagaacaaatccataaacactttcattaaattctgtttcaataaaaagcgctaaaagccaaagaccaaaaagatctgatatttcataatcgcaaattgcacgttcatttaacccttgaatataataaattaaacaaataacataaccaacacaaagtttatcaagcggtctttcaattcgatggcgaatgagcattttaagaatcaaataaattacaataagaaatattatccccccaaacaataaaattaccaaatgatgaaacaaatcgattcatttgtgtccataaaatattccatttacatcccataattggccataaataccattcagatttatcaacaaatgttaattgacgtaatcgaaacatttctttaataagttcaatgctgtgtcgaagaattaatttatgttgaatattataaatttgtcctggtgaaagtaatgtgtcttgatattcttgtggtaatgaccaagaatgctctgatttatatggctctgatataacttgaatagaaaatgagataaaaaagataaaaattggaataataattcctgttaaaagaagtcgaagacgaaattgactaaataataatgaaaagatgcaaactccaaaagcattcagattcgttgacaatgaaaatcctgaaaaaataactgaaattaaatataatatactgtgataaatacttccaactttaaaatgtgtagaaagtgatgaaaaaaagtactgaaactgaaataaaaaattgtaaaagtccatctgtaaaacaatgtcggccaagcgaaatcaataagaaatcaaacattacaaaaagtcctgtcgaaaatgatgtaaaacgattacccccaaaacttcgaactataaaatatgaaattggaatcgttaatgttgaaaaaaatgcaggaatagaacgaagtgaaacatatttcatattatgatatgtataattatattctgttcgtggcatttcatacgaaagatcatactccgaaaatttcgctaactgtgataaaatataacttccaaatggtggttgtttatcaacatataaagatccattaagaaacgaattaagaacatgaatttggttactttcaaatgaaactagatgtcgtggatattgaataatccaaaatcgactaaatgtacctaatataacaagaatcataattaaaaatacatcataaccattccaatgaaaaggagttaaaagtgggtttgaaatacttgaaataacttcttttttaattccttgaggaggattattttctttctctttctctttcgaatttttcttttcttcaataagaactggttttttgctcctcatttttcttttattaatagaacgtttatccttagtaaacggtcgtcataaacataaatttaaaaataaaattattattaaatattatttattctgtttttaaatgattctttttacttttactttggaataaatgaaaaattgtaatcgtggaattatcaactgcatgacacatcttcccaaatacattagaaaggacttgcgtgacatgtaattgttttactttatcaacacattgacatgtaacactatctgcaaattcaatagctcttataaatccattcttgattatttgacatgaagatgtttcgtctttattattgatgtttattttttttcttcttctttttgattctctttttgttcttgttgttcatcattttcatcaaatgaaatgagatttatttcttcttgttgtgtttctattttttcttgtgaaggtatttctgttacattatctgttgtaacatcaatttcagcatttgcaagaagtggttcttccattgacatcaaaataaaaatgaagtaattctccaatctttgtttcgtatagaaattttcaccgattcaccgttaatcaatctcaattttgatctgaatcgattagaaaaattgaatgtttcaaaatttgtcccggtaatgaattaaaagcgatgaataagttgattaagttctttaaaattaaacataaataaaaagcaaattcttaaaggttgtgaaaagaattttttgtcagtcacataattaaatatttttagttaatttacatattttttattaaatttttcattctttcgaaaacaataactgaaattttataccatcgccaccgctataattttcttcaagtttatctcttatttcttgatgatttttcaagaatatttttaagaatgcgattattccttttatggtaacctcatctaatttcaaatgaatttgttttctttttgttaaaaatatcacatcaattaatttgtcacaaattaattcgatgtgattctgtaacaattcgatattctttagcacgtccatactcaaagaaatcaaatcttttaagatttttggtattgtataaaatgaaaactgtaaacaattttcaaacaaattatcaatgttttcattttgataattaataatttgcttctttaataacaataaaattatttttgtaacaaatggtaatatattttcttcttcatctttatcatcgtcatcgtcatcttcctcttcataacctgaattatattggaaagatggaagtgtgaaaattaaatcattaaaatcatttataaaatctgaataattttcgactatcaaagctaaagactctgcaattaaagcaagttcagaactaaatgtatagtctaaaaagtgcacaggcttaaccaaaaatttataaattatatttatattttcttgggaatcaattttataatttttcaaaatttcaacaacaggattcaaaacgttcaaaagcattgaattttgaacggagtaaagccaagaaattatcttatcgacgaggaatccactttttgaagggaagactctaataaaagcagcgtaaagtaaaaacaaaaattcatttaaagatgaattcatataaggaggataatttcttaatatataaaatgatccatttatagaatcttgaataaacgggacaaataaatccccgtcaacttttttacttaagataattttcgttaaaagattacaaaatgaaacaaaagtgttcttcgtcgaaacataattcgccattttccgaacaacagtaattattagacttaatttatctgcttcgattagatcaataaggttaagaatggagttagaaagtactaattgagctttagctatacgtgaagaacataaaggtaatatacaattaaacgattttaatgcaaatgattgaaatggtttattctttgtaattaaacttaaacagaataatatatagtaacgattagtttgatcaaacgaaggattattaacattattaattatatcatttatatgattttgtatgatattaatagagaatttactatttaaacatgacgcacctgcaaataatgaaatggttccaattgtaattccgttttcttttatgaaatcatttgaatattcgatatcatcctcgaaaatatcataacaatcaatggtatcaataataaaacttaataataacaaacaattatcctttaaataaattggtgaatttttatcgtgaataactttatgaatataattaattaaaacttttatttcttgttttgtttttggtttgttttcattgttattgaaatctaaaggttcattttcatcttcttcaagttcttcaacttcactgatagctaaaatataatgtttaataagatgattatatttatgaagtcgatcctttgatatgtttggcattattgttaataatgattcaatcgaaatcggcgaaatgattgttaatgaatcaattaatgttttcatcgattgtgtaacaagataaaataacgaaggatcttgcgtagttaataaattaactaatatatcaaatattgaatcggaaatagcattcgaatcatcataaaaataatcagaataaatctttaataatatgcagccaatgccttgatttaatggatcacccttaagtaatcgttttatggttttaaagagagtgggcaaataattgtcgttttctaataacgtttttgatattaatgcatacgataacatcgctccgggcgattctttatctttgatgtattgcaaaaattcttcaattaatccagatgaataagaacgatcagaaagaatagtttcagtaaggtcgttgatttcatgatatggaatgtctgagggagtttttaaaattgaatcaaatattgtgacaaaagattttaatatgatgaaacaatcaaaggtattcaaaaatgttgatatataaagtagaggaaatattaacttgagttggtcatttggagataaagattcattttgaagtgaaatgatgtctttttgaatttgggggtctatgttcgttacttcatcaggattttcatcgcagtacctagtaatatatggcaaaatgggaattatttgttcaacatcagatgtttgtgaataaaattccctaattaaggactgagtatcaaatgtttcaatttgatctgtgtcatcagagaagtcagatgagacaaaggcattaattaatttctggaatatttctgggattttctttccagacataataggggtaccccatttcaattaaccgtcaatgaataaaaaaccgtttattatcaattgactttaaatcatcattttcgggaattactgatttaagccacagcttagggctgataaatggtaagtttatatatatatatatatatgtatatatatattatgattatttacaattcaacaaatgaaaacagttgtatctatattaaaaatatgatctttttatttgtttgctaaaaactatttataggtgcctactttagtttcaaattttcaaatcggaaaaaaatcattttactatttttactaatgtctcatttattcaaattatatttgaacaataaatttctcatcattaaaatcatctgcaaatgggtcttcttcgatgtttttatttgacattcctcctataaatgtatttgcactttcattattttcttcgtcattatcattttcataaattatgttattacttatttgtttattatttcgaatacgaattattatttcaatgagaacgataattacaattactattataatggaaacgcatacagagataataattatatttttattcatatcatcagattgtaattgttcatttgtatatataatagtgaagaaattggagtaataactataaatcactgtgtatataactattgtgtaatcataaaagataaattccgttttaatataaacattcgatgaattaacaatacaaagcgaatatgtatttctttgcgtaacataaaatgataatgtttgcgtaattgatagtgaatatgctaaccaaactgttaaagacaaagttatattaagtagaaatgaatttgttattgtatttaagtgagaaaatttaagtgattcagtaaatgtacttgatttagtaaatgtacttgatttagtaaatgtacttgatttggtatatgtgtttgatttagtatatgtatttgttgatatttccatgaagaaatgcgatgtattactaagttttccatagttatcaattaatatgacatgtatataaacattttcatttaaaatatctgcaataattctttttgttatacttgtattatttaaatttactaaggttaaaattgttgaatcattgttatcaatgatataataatattctgttgcaaatgatgttaaattaaaaagaatttcgtctgattcatatattgtaccatttgatgaatttccaataactttataaaaaattgtttcggtttcattatttgtgcttaattcaacagttctatatcctaatgttgtaatgtttggagattttaatttaggcgtttcaatagaattatcatatgcatattgaagcgttgtcttctgatataagtagtatatagtatttgcaagaagttgtctttcatatagagtagcacttgcaaatgtatgacctgtttgaatcatagctgtgtttttatatgttgtcaagtaataatgtggatttccatatcttggttctgtatatccacttaaattccatgcatagttttcaacttcggtataattagaataattatattataagtcagcttgtgtatttctacctagttcctcccaaacttctccaaatgctgcatttgaacatgtgtgcgtttcaaagcatgttagattaccatctggaattgaatatggataatttgttaataatccatgttttgtcacacgaaattcatcactaaaatgcatccaccttgttgaaaatgtaccatttgaacagttatcagccttaaaataaattgaatcatattcttctgttccaagcaatattccgaattttgatgtaattggcccatatcctttttcatttccaaaaacaaatctaacaacatcatgaccaaacagaactccataatcgagatcaatataatccgaaacgcgttgaacagtttcatttttgggaaaccacgtaccccagagcccatttgcatccatgaaaccaattacaatgacatcataatgcttcatttcttctaaactcatgttatcaaaatcatatttagaaaccggagtcacatgaatgatttgctcttctggtgagaaatgatttgtgcctaatgaagtgaaattataaaatatatcttcataagtataacctatattttaaacaatctaaaaagttataataatttttatttatgtttgcaaactctcatgttttcttgaaagatattataaaacattgctaatctcatatgaaattaagttatcttaatgatcttataactctgaaaatgaataaccatttaaattgaatgtacattttatgcttttgcaattgtttgtttttgtttctattgttttactatcttccctatgcttttgtacctaccaacattatgttctgtttagttcaacaagtacaataaaagatgacaacacttatatttatattattataggtgttgccattgcagcaattattataataataactttgtgaatgattttgttaataaaaattaaaaacaaaaaagtaatgaaaaaatcacataaacatcaagtgatgataatacaacacaagatgtttcacataatattaaaatggaaaatattagcgctgatccacttgcagaagattttaatgaaaatgatatctttataaagttttcatattattaactcaaagcaaaaaaataataaattttaatcatgaataaaaaggtattaaaaaaatttatttttgcattaacaattttcaaactctttcaagaaattcatatacagtgaagaagtgtttgctattgaagaattttggcattgagtgaaagattcgattgatgaaacaacactttcatcatttattattacttttaaagaatataaaatagtgatacaatttaaaatgacattatcatcatcactaaagacaaaaaatgatacaaatgataaaagttcattatttaaattctttataataccgaaatcaacgcaaactttaattattgataaaataaatttttttgattcataattataagaatcgattttattgatatttatacaagaaaaagttttctcagcaaataaatttgaacttttagatagtattaaagctaactcaagaatatataaataaacatttggatacatatttaaatttatattaaacatttgtaagatatcaatttgattaattaattgttcttttctaaattcatttgatgaataataaattaaaagatctaaagctgaaacaactaaagaatttgttttaaaatttgttacattaataataatattaatttgttgttcatctaacattatatcatcatttgatataattatttttgttattatttcaagtaaaacattttgtgttgataaatctgaacgaattaaaatttcaaataattttggaattaattccataatatttggaatatcaatatactcaatttgtcttttgaggatttttaatgttaagcaaaaaagttcattagttttgtttaatgacaaattaaatatgaattttaattgttcgataccaataaaaaactttttatctttagttaataagattaatataaatatcacttgtgtatatgacttatctgatggaatattatttaaaatattagtgcaaattgaaaatagattatcaccaaactcagaaattaatatttgattttcttcaattatatttgttattatccaaagaagaatttccataagttttatatcaattatattcaaaaaaattgttgaaattgaactatcaagaattcttttttgactatcaaaatctaaagacttaccaaacgaatttaaatagttttgtattttaattcccatttcataatcaataggagcagaaatttgtttaatctcttcattagaaaaatcatcatctaaatcaggtctgtaatatgaaacatgtttttccacatattttggtcgaaaatcataatcatttaaaggtggtgaaaaaggttttttccaatcatttaaaggataaggtttcataaaaaaaaatggttcaaatttccaaatctacaaacaattttacttattttccatcatcataaccaaacaaaacttcagttatatcctcaaaaaacaaacaaaacaaaatccaacaaacccatcatcgaccgtttataccatttcaacgatatacaaaaatcaaaactttattccacatcaaactttcaatgatcgaattcttgctcttttctttgcgttcatttgtttttcgaacaagtcgaatgcagcgtttgccactatttcctgtgttaattgtgctgttttcattcttctcttgaattccttcaaagccctagctattgattgtatcaattccttactcatcaacttatcaggaatatttcgaatgaattcatcgaattttatattcagcgacggcaaattatccaacatcacttgtaacaaagcagggtcatcatatgccttcaaagttaattcatcccaaacacttttatcagcgacttggattgcatattccacagtttcctttgggtttttaatgttatttaagtgtattctcataccgtcaagtatcgcaccagttttctttgataagaacgcggcttctctataaagcttttcatctattgcagtttgtctagcaacagtataatcgaattcggaactatttaataaataattcatagtttccggatgatggaacttaatatataacacagccaaatcagttccataaggctttggtattggtatatgcattttatataattgatgtaaataatttaacatatgttgacacatttggaccgtatttgtcttaaagttcggcaataccaaaatcggcttcatttgttcagtatgtgataacataaattgggtgaaaatatctccataagttcgatataatgtatcgaatcgttttaatggataatcatataattgatatttctcgatatcatcgaaaagatttaaataattcgcagtgagtcctgagtcaaaagcttttgaatgttcaccaattcgatgatataatatcattaatgggatatgaaatactttttccgaatctgctttgatttggacgtcatttatcaatagtttcggatcgaaactatcaggcggtaagttcgaaaacacttgacaaaatcgttgtgtatcattatgaattaattctcgtaaaatcggcacaagttttggtgtgttctttaattcttcaagtggaacataacttgcaagtgatgatatcgcatcattgttttggaatagttctatagctcgatcccattcttcattacgtggcttaagatatttattacatagttctgctgctttgttataatcacttttggacttaataaaatgtgataaaatgcgcataactaaatcaacacgttcattgtccgttaatgatggtaacatactttcaaacttcttaagacataattgatcttcattacgatctaaatgcatttgtaaacgctcggcccaacttgaaaatgtaatacaataaacaaattgatctaaaactaatataaatttgcctttcgttgtgggtaataacgtgacgtatttactcggcttaatggcattctctggaggagaaacataactaatggttaagttttggtcaatataaaacatacattcttttttcgcgtcatcataaaataattgcatcgtgatcgaatcttgaactgctaaggataaaacattacgatggacattgacaacaatctcacgtgtggtagtaagccatagttcataatataaggaaccaaatgataaacctaagatggaatctgataattgtaaaaaggtacacctggggttttggatgggagaattgggaaatactggtgttattttataaagtttttcttcgttcttttcacgaattacattaatcgaagtaaaagaggcccaagcaataattccgtttttccaccaaactgtttgtataaaaccttcattctcggaaattgttgtctttttcattcggagccagccttgacttatacgaataatactaccattggtatctgaaaaaatggcattgaattctttggtggaagcatagtttggatcaagagcacatgctgaaatagaaacgccgtgcgaaactgtaataactgacttattttccgatattggataaagatttaaatttccatttccagtggaaaataaaacaaacttccctgtggaatcaacagagatataagttatctgagcatcacttttggtatactcaattaatgtttcacctgataattttgccacaacacatcttccatgttcagttccaaatacaattttgtcatcagaagttattgcaaatgcggatatttgatctgttttatcatttttatctgtaatctgtaatgaaatttgagggtatttgagtataggttcttccattttgcaggcggttttgtaaacttgaacttaacggtttttaagcaattcactttttggaattgcagaaattttacaatgcgcacgttaaactctgcttcagttgtttatcttgactgtatttttggaaagtaatgaattcacaaaaaaaagagctaaaggttagcctactaggagatggggctgttggaaaaacatctttaatcctcacttatttttcaggcaaatttccccttgaaataatgggcataattgagtctgattataaaaaaaatgttatttttaacaaaattccatataagcttaacatttgtgattgctgttgtggagctgaagattttgtttctcttagaaggaaacttctatatcaaggtactgatgttgttattctatgtttctctcttgtttgtaaaaattccctagatgcaattatgaattattggatagatgaaaccaaacaatatttttcagaaacaccttcattttgttaggaaccaaaacagatttacgtgacgaattcataccggatccgtcaaattattcttatgaacctatttcatctcaagaaggaaagtcagttgcaaaagaaatagatgcgtttggttacattgaatgttctgctaaaatcggatataatttagatgaagttttccaacttgcaataaaagctgcttcaagccaaaaatttaatacaaagatagataaaaaagaaatttgcagaatattttaagtaaagaattttgctctgttattattctcctatgttttctcttaatttatttgtcatgacaatttgtgtttaataactttaataataaatatatttttaaatatatatatatatatatatatatatatatatgaatagaaaaaatatattatttttattaactaaaagttaaacatcatgatgtgtgatatcatgtatgatatcattgtttaattcataccatttttttatttttgttagacacctaaaatgcatataaaattaataaagatgttaatgttttttacccagatatatgaaatagatgttgatttataaatatcgtaagcttaatgatactgagtgttatagtactctaattataattatatacaatgtacaactgtctcatttatgtcatggaagaaagatatattatctaatttgtatcgaaattccaatttattaactacgaatttcacaaatatgcaacataaaagactgagtatccatgtgcatcatatgtatattatgagcaaacactgtatcaattacgatcatttttttacaaatgggtttttgttgatgattcaaaaagttaaaccccttaagtgcaaaagcggctattttgaggaaaattcaatataacattgtttgacaacacacaattcaaaaaagcttttttcgatatcccttcaaatttttcagaaattccggtgttttagctctgtggttaaacctaaatttttttctgttcttgatataaacatattatataaattgatcataattaataacgaggtagtctaccttataaatacaaaaatagataaaatttttaataatatatttaaagaaattcatatttttattttcacaaataaaaaatttttgtcaattgaattgaaatcatacttcacatcattcatcaaattcattgatcaatgaacataaaaattattcttcttattgcaactggtgttattgcactagctggtttgatagggcaccttgttgtttgcgccacatggacttcaataatcaatccaacattttcaaacgcgggtggaatctgtgcaacgctgaacatttctgctatttgcatttgtttgtttgctgcaataacaattgtaggaatcattgttttaatcattcttaaatttgcaaccaaaaatgttaacaagtggctcctaattggtattggttgtgtttgggccatcacttttgtatgtgcttgcattaacttttctaaaatgtttaatccaaatgatgatgcagagaaattagcaaataataataattttgtagaattttcaaggcaagttgctaaatattctttgtcttctactgaagctttaaaggattggagggaattcttgaaaagattaactgataagtacggagataaagaagatgattggaaaaagatagtttttccctatacttcacttcttgctttcttgatcgttgaaatagtcggaatcgttgtatacatcattactcttatatttttcttaaagggttaaacaaatggaaaaaagaatctgagtaaattattttcttttctttttttaaagaaactatacaacagcgttataaataatattgtttttatgagccattttaatctttttgattgtgtggcttttgttaaaaattacaatagtcaaaatataacgaaaccacattaatgtggtaaacttctcaaaataaaaaacgttatgtgcaaatcaaaccaattttttgcatagtttattatgcacttttttcatttccaaaaaagaggaacatgcaactccacatttcaaaatttttgaaatagagataatttcaatatgcagacctatattacaattcttatcatcttcgaaaagaatgtaaaccgcgtttaatcttcacatttgaatcaaccattcttgatcaataccaatatttaagaatgtcttaccattttttaaatatttgatgacgactttttgctttctacatgtgttttatttcactggtaatttactattcaagctaatttctaatttatgacttagttcataaatgtgtttatcaagcaaaacaaaaattagctttcattttgtcaaatcaagccattaaatctaaatgaaaatattaccaaattttctttatttctgtcttaacattaatcaaaataagatccaatgaatcaatacttctaagaaaaaagattttattatgtttactgttcaaaactgttatttaattccttcctttctttttcattgagtttttacaaaagtatttttttcttgttgttgacaaacaagcggttagttgtcaatttctgttgacaaagaatgagcgccaacgtggacgaaggaatccaagttggccgtacgacagatgttttactggcaaaagcgcggcattataccaatgtatattcgacccgcaaagattgtcagaccataaaagagcaaattcttgaaatcgttgaagataaagacaaatactggaacacacttgcatcatttcttcatggtcaatgttccaagcaagaatatgatgatgtcatgaaccaatgtcttactgattacagagccaaacttttacataatgatttaattcgttccattttatttaatgcgcatttttctatgattcctcctcctggagtgaacatagtcaaaacgcccacccctccacaacccaggcctattcaagcgccatcacagaattctcgtaattcctcattttcaacatattccgcttcagacatgcgccatcttccttccattaaccagctctctagtcgtattggcatattgcttagttctcgcaacataaaagtcgaaagtaaagcgactggaattttatttcaagaattaaagcgatttataatgtcaattcttgaaaacagtgcgctgcttgtgtcaagtaaaggcattaacccacaggagaacatcgttataacacatgcgcagattatgcacgtgttaaattcggattatcggatcttaaacgttgtctctccttcgctgctgtcgaaatattcgtcatttttgcaatagcaaatttataaacaacgtctttattattcttttggccttaaatttaattaaataaaaataaattttttttgataataatggaaaatttgaaatctttaaacaatgaattactttcttttcaagtgaagacttgccaacaaaaacatgtttgtgatttaagaacttcttgtaaaatcattatgacattattactgtaaaaagataatttgcttataaaaaattattttaataaaataatatttggaaattatttaaaatatttaatgcatcacttatgaaagcaacaaaagaaaaacatttcgatatcattcaaatcattaaggaaaaactattaatatattaagcaaaaataaagatcaaacaagtaacttatatataatgtaaaccaacaatgatatcgaagaaaaacatcatcaaattagatttaaaaatgtgaatttcaaaattaacacattttttttaaattggtgtaaaaaattattttaaatctacttaaaccagtaaaagttaccttatgaaaaaatttaattttatttatttttagtataaactttatttacatttttatacatattttttcatcaactattgataacgaatataaatttaaatacaaattcaaacaaaaagtgtatgaaatcgaatttcatcactttttatgttaacaaaattacaaataaaaacataaaaacagttttatgaatctataacattcattggcacaaatacgattttcccatcatttaacaccactaaagccaatgaaattttctcgaaatatttcacgtcaacgacatttccattacatctaaagaacggcttctttatgtccaaacaaaatgcttcgaattcgtacaattttcctttttcgtcagcaaccaacacgaaatcgaaccctttatcatcactccatgtatcccatgcaatgatttggaatggtatttggattgttttgatctctcttccattaattgtatacaatgaaatcaaatgtttaattgtttgattttgaaacaattcttgataaacaagtataaaacaccatgattttgtcagtaaaatcaatttcggagtcccatataacttaataaaatgtattatagtcccatgacttaatgaacatatgatcaaattttcatctttggtaccacaaacaaatgaatcaaatacatgggaacaattactacatgtaatggaatcacaaaaatatggtattgattgcgtcaaatttttaaatttgttcttataaatataaattaccgcatttttcgatgaaacaattctataaggtccactttttgatatgtttacaatatcgccaacagttgtcagcttcctaaccgtctgaccggtttcactttttactttataaagttcgtttttattttttgagcccacaaatagaaagccctctgaaaattgaatgaatatatttgaattttgaatgttgtcaaaatcttgaatttgaatttcattaatttttaagtcatcgaaatccttaaaattaacaattttaattaaatcttttttcttcttattattattacctaaaaattttttaaatttatttaatttaattaataaatttttcgaaattccttcgttacatatcaatgtaattttgattttatttaaattgattaaagaaacatttgaagtaataacattaaaattgccgaaatccaaaacgatttcttcattaataatttgttcttttaataacaacttcttatttaatctttttggatgaggattcttaaataacaatggaggaatttgaccaatttgtgataatttatcttcaatttcatttttaatttgtgaattcttcaaattatttttatctttccatacatcagaataaatttcttttggatatgaattaatatcacaatattgtttatatccccaaaacaaatcgatccaattatttaagttttcagacacataatcactttcaagagcttttcgatgtaaatatataaattccattggtgtctttgcccattttggtaagacaacttctgaagcagataatttctcgtttaacattcccaaattaaaattattttcattaattaaaaactccggcatataaaagaactcgggaattaattctcggaaattattaatcgatgttgaaagtttataagagtttttaatcgatgtaaacattcgagctgaatgatcaaatcttccgccttgaatttggatatgtaatgaagtaaatggttcgattcgaattagccatgaataaagtgataatggacatatcggaccactactatataaataaggtttaatacctgcttcaattaatacgtcgaatttgttctttaatgattctaatgttttgggatcttgtgcgcctataggtaatgataagtcacgaaatgtttctttattagttaaatctaatgtttcagatgtataatctttaactatccatgggaaaaatggatattgtgatgatgaatgaaatgaacgtccactataaatatttaataacattaaatattcgaaatttgagattttataattaagccaatcattagtgaaattcttttcgatgaaataattataaaaattagaaatttgtaatacttttgttgataaattcttctttaatcgatttaatatattattaaaaattatattatctttaaaatctatgaaatatgattgatttgaatcagtgaaaaattctaatgatgttacatgatgatttcgagttcgaattaaaacgtgtattaaatcctttaaataaaatgatttaattttatcatcggaatgaacaatttgtattttatcattataaaatcgaaattttgaattgtaaatgtttttaatagttaaatgttcacatttacattcataaaaaggtttttcgatatcatcgaagttattaatattttcttttatatttataatgttttcttcgacatttaataaattagaaatcgttgtattcttatgtataatactcatttcgatttcttctttagtacaattagttatagaagcattagaatgtaaatcaaatgaaaaattaatccgtaatttcatcggacaaaaatatttacaaaaactatgatctaacttaaaatgtggtttcgttcgatactcaattggtaatgatgaattccatggagctttagatgtagtcatagaacgccataaatgtgaccataatcgagaattatattgatctttctcgttcttttgatttatatatattaaatatgatgatttttgtggaactgaaatttcttcgaatttttgatttaaaaattcgaactcattaacatttgggaattctgattcatttattaaatcttctaaatttgatatataatcgaaaaatattttggtgctttctaaattagttttattattatatgataaaaagaattgattttcttggaaaatagaatatatttcattcggtaaaaggattcctgaacgtaatatatattcggctaatattaaagatgtttcatcatgtgaatatgataataatccaatcatagctttcatcgctatacctaaatgattccatttaccttttttattaatttttaatccgaaatgatacgattttttctcagatttaaaatttaataaatttttgtataaaacttttggattaaaattcaattttttcttcttatttttaaaatatttcgttgtattaaatgaacttttactatataatttaattagatattgatttgatttagtgttttcttggaaaaagatataatgacgaattaaaacatcaatagaattcacagtattttcattaatgttattacaaatttcatcgaaaaatatatcaaaaattatataatttttgactttaagtattttactaattaaataaattcgataatacaaatttattaagttatttaattgatattttattaaatatttaataattcttaatctaattttatttgaattaactttaaataataaaacaatagtccaaaattcattatgaattgttggagtatttttataataatttatcattttctttatacaatttttcgataaatttaatgccatatatgaacataaatgatgtaattcaggtactttcttagataacttacaaaactttataaacaaatatttattatcttgaaaaaaagtcgaataaaatgaaataatttgatgtatttcttttttaatatcgaaacaagaaaatatttttataactgtatatataataattgggtttttaaatgtaaaaagaaatcgtaaatattgtatatcgattgggttttttattattttcaattttattaattttaataaaaagtttaatgaatcaatgatttgtaattgatctggattagtcacaagattactaatgaaatcagttagatccgaatctttataatttttcattaaaatcgatgtacaaatcgaaaataataagtttcgacatttcgaaatatttaactcttttgaatgtgacacttttgatcgaattttatcattagtttcataccaatataacattcgcatttgatataaaatcgatttaaaatcaatgaaatattcgatatgctttttagaataagtttctaaatgtttcaaatatttaagatgatctataggtttacaagaaatccaaatttcgaaattcattaaaatcgattgaaacaattgaagttttaattctttatgttttaatttctcaaacaaattaaagaatttcaaatatattttatacgtaaaatgtattggttgactttctttaaataaatgtgataatattaaaaaaccattacttaaataaaatgattcttggattgaataatcatataataagaacttagataaaacaaagaatatggaattaaagaagttatccgatgttttaccatcttgataagttaaatctaattgagcaaataatggtaaaaaaacatcgattttaaaaaagtttaataaaacttcaacaaatgataaataataaggacgttttgatatattactttcatattttatattatttaatgattttaaattaataaaaccattaaatgatttagggacaaaagcaaaaattggcgaaatttgtaaatcttcataattcacatttaatgataaattttggatttcaagagaacttaaattattaaacaaagcaaaaggtccaagtaatgaacacttttgattattattattgttactattgataatacaattcgaaaatttatgtttaaactcaacgtcaaatgtaactatttcaagagtatcgaaatagcattttaattcattattcttaaacataaacacataaaaagaccattgttctaattggattctataaggaatttcttttattattatatattcaggtgtttgtaatttaattataaaattattttcaataatttcgattgataatgaaatgttttgatcataaatttgaaacaattcgaatttattctttatagaattatgaaaataccaaaatgtaaatgcaaaatcttgaatattattatttaaagttatttttatctctgttttatcatctaaaggaattccatattgtggaatacttttagcttgatcaattaaagaacataaaactatgataaaatttatattataatatggaaaatatttaccatcaattggacataacaaagcaataaatttttggacaattgtaaatgaacaaattttcgatgaaataatttgtataaattttaatgatgttaaagtttcattttgtaattttttagttttccattcgaataaataatttaaaattaattgatcgatttctccttcatgtatagatatacaattttgtaaattattttcacataaatcaattaaatatgttaaacattcgattaatttcggtgagttaaaatatgattgaagatataaatataaattctttggttgaattattttattttcatcattaatacataattttaataatttatttgtaaattctgttgttggttcattcccataaacattttttatagatttctctaatgatttaatttcattttcttgtaatgattgaatttttgttgtataatataataaatcaatagtttcatttaataaatttaatgaatcaatgttttgtattaaacttaattgtataattaatggattaacaatcgttaaaaaatgttttaatatatttttcgttttagaaaatacataatttaaagtatgtaatatatttgtagttaattcgatgaatgattctgatgttaaattataaatatttgttgataaaataaaataaattgtatcaattgtatctaatggtaaattatcatattgatcaaaagataataaaaatcgttcaatataatttaatattaaagttcgcaaaggtttatcataaactaatgataaaaaaaacttagaaaaatgtacattcgaaaagaaattaattaaaaacaattgatcaactaaaatccattgtacatatgataatattgctacacttgcaatatatattatatctttatcagtagttatagtcttataataaattaatggatctaataatgaaaatgaaatcgctgatacaaaatcactgatcgaataatcaatagaacaacaaaacaatcgtgaaactaattccgaatataaaagtggtgtttgtgctgcttgataaaatatggtacgtaattgattcgcattattacataagaaaaaatcaaacacatatgaacgtaatgatgatatttctatgaatttttcgggtttttcatccataaaaattgttatcgatggatcaaatattacggaattaaataatacttcaattggaaatgaaatattacgaaaatcattataaacagaaactaaaatactaaaatatgtaatgtaaatatcaatacaatgttccgattttaatgaactaattaataaatgaaaacaatcagttaaaaagttttgtaataaaaattcatgcttatgaattatacgtgtaataatttttgtaactgaatatattttgggatttataatacttccaaatggcatcgtttttggtataggaaattctttggatatcggttttgaatcaaatatactttcatctaaaaaacgatattgaacagttgtggaaccatcaaatggtactcgtagataatccttgtttgtttctggtatcggaatattaatttccgatttttcgatgttgtcataaagcgcgcacgttaaaaccgtcaaaattgaatatattttttgatcgttttggaattttgctgatgcgttactaaaaaatgttaaaacatatggatctaattctttaataaacttcgtacttcgttctaatatcttaaatgctatatctgcaggaaatgtagaatcaggcgcttgtattaaatgatctacaacaacaaaaaaatcttgaaaatttgttgacgatttaatgatatcatttgaaatgcaatcaataagactataagctgttactggaagaattttgttaaataagaaaaaatcatttaaagatgaaagatatggaatcatattttcattaatatgctcattaataacatatgataatgcataataaaaagcagatgtagcaattgttggattgtgttctttcgggtcaacgagttgcgaaacataatttaatgaattaagtaaaacactaagcttagaactttgttttgacgaatgaaaaacagaacaccatcccaagtaagagtaaagagtaaacacataaaggaaataaggtgaagattttctaaacttataattttctactaacttagatagaaaaaaaggaacatatggaaaactgatcttatttttagccaaaacatcgacaacatttgatgatgaatcagaaagttgatttttaattgatatcatttgaaactttgaaatctttggaaattcgatactttcaatagaaatctttatttcttctggtaatgaatcaagatcaatattttggaacttaatttttaatgacaatatttcatagcatagttgtttttctggtatgaaatcattcatctgggtttgaaaaagtgccaaatattctgtggaacccctacccgatattgcattcaatttatttacccatattttcatgcacaaaccgcctgataacgatcataaataattcaatttatggctatgtacgtttataattttatccaaacgacacattttattcactcattctttttatttacataactctataatgtgactctaaaaatttgttcttatattacatttttttctatctgattgaatatcttaaacaaaacacaaataacaccaaaacgttttcataatttgtccaaatgttaaattaaagaaaatatttttgaattatttacaactgcaatttcaatgcattcacagttgcgccacatcacatttccaaatattattttgttaaaagatttactaagatccgagacctttcgaaaaatccatatttaatttggcaaaggttcgaactgtataaagttttcagttctcttcttcttttgtctacagtataagaacaccaacagcactgccaccagcgccaatgcgactgagagacaagcgatccagatgattcttgttgtcttgcttggggtggtgaactcttcatagttcacatctcttggcagcgtgcaagcgccagtcaatgggactgtgaataacatttgttccgggtcagaagccttcttaatgaagactggttgaaccaaagtttcgcatccgattttatctgttatctcgtttggaattaggtacaaaattccttgtgaaattatattcttaatattatcaaatttgacattcatttgattcgataatgttatttgtttttggccaacgattttattatttcctaaatcatataagccaacaaatgcattatgaagataactatcagatcctaagttcatatgcataacaactttcatatcaaacgatacactttcgttttcaatgttaatacttgtgtatggttgtggagatgatatataatcatcgctattaacattctcatacgtaatgtttgctgacccagaaacagattcttttctgttctctgcgtagatttgatattggtcattcttaaagaaacatgggatttgaagtgtgtgctcaacgcctttaataaggtcagagcctaattgataacgcttcccatctttcttgaggaataagtcatagctgtctttgtttccattgattttgactgtaaagttagtgtcgcatttaatggcgtttgtagataatacaatttcgggctctttcgttaagtctttggttgagtcagatccaaacttacgttcgatttgtggtaatgttggatttgaacttaacccataaacattaatcttgatgttatcaatggtcgttgtactaccataacctgcacgatgcgcgataactgtccatttacctttggacgtttcaccataaaatccacgaattgtatatttgactttgttgttgtttgtttctttgacttctgatggtagtataactttaagaacggtgcctgatggtgatttaacacttaaataaagtgaatgaagttcattataatttaactcgatttcaacatattcaatgaacttaacggtctcggcggttatgtcagcagaggactcaatttcaccgtggcgaccgttactgaggtcaatttttggtatttcaattgaaacttgtttttgttctgataaaagtgtcaatgagcgtgctgctttaaccgcgagttcggaattaatacgtccaaaaccataaacgtcactatagtaatagcgcgcactattgttgatccatgactcatgttttggatcattaattgttgatgaaagtgcaaaaatactttgaatatctctatatgtaagttgtgaattaacactaagtaaaagagaaacaagtccggcaacataagaagcaccaacaccattaagattatcatgcgtggaacaaccagttgtatctacactaagagatggcggagatggaagattaattgtgttaccaaaaagatatgatgatccaccagatggagcattgacaacaatggatgtgccacgattgctccaatatgaacgagatccacttggcgtagtatcagagactgtaatggtttcaggtgcacgagttaaaacatagaaattggtatcaccaccaattttgctatctccgcctgctggtgctacaatgatacttttacaattatgaatgtcagtttcaagagatgatgaggttggaggatcacatttaccattggcgcattcatttggaactgaaaaatacttgacatgagtggaggtattttcgcgtttaagagccgctctaattacatcttctgatgtctttttggttttaagacaataataagaggattgatatgctacaccaagtgagcaataatcatttgactcacctacaacatgaccaagaagtgaagtggtgcggcttttttgattgtcatcattatctggtgaaacatttgtagttccatcatcaagattataatgtaatgttgataattgtctgccattgagatcagtatttgaatttgcacatccattaccaataacaccaatagtaatactgtttccgtttaatccttcatcccaaactggttttatgttaatgtcttcgccggaagaagatccataagtacccttatttgaaaggacaaaatcatttgagaactgggggtcctggggatcaaaggaaatcccgaaaacaatgaagaggagcatatggtttaattgtgatcaattttcaaagagagtcatcgtttgatcgttttgagttgcttgaatggtttacaaatatgtgcacatgcgatcatttggaaagtggctctgaaaacaaaaaaacaacatgtttaacccctgaaaacaacacttcacatgtaacccaaaaaaaatgaagaacgttaagcaaaatttaataaaaaaagtcaaaaaaaatggattttacttaaaacatccatcattgatcatataccaagacttatatattacatttttaactattttcagtgtgtatacattttcttgttttattaagaaattatctaatttgatatttgaacatcattacctttgattctcagaaataattgttgccctcaaatatgaataaataatcaatgttagattaatattaaaggaatcgatcctgtatagaattcagtgcattgaaatttaagtttggtttagtatacgtttaaaatttagaaaaatcaagcagtttatggatgatctttttggtactcaagaaatagattgggaatttaatgctcctcactggtttgattttgaaaaagaagaagtcgaaaatttagatgattggttcgacattcaagaaaataatcttgcaaaatttaaaaaagaatttgatctttcttcaactcttaagacacagcagccacctgtaagcaacaaaagtgataaaaatgataataataaaaatgttaatataaaatctagaaagccaacaagaattcctgtttataattcaagaagagcaaatgcaaaatctgttcaaattcatcacagcaatcagcatccaccagtacatgaaacaaaaacaacctcaagaagaagtaaaatggctgctccttcatcaactaaacaaaccacaacacggaacattgagaaaaccaaagcacctacgctagcaaaaacacctattcgagtccccttgaaagagagacagaatgttactaagaaattataaacgattaataaattttttgtactttatttgatcgaatttgtttcctaattttgtttgtagctataaaactaaacattttcatattaacttatgcatatacataagaatattgaaaattaaaattaatcaattttttaaaattacacataaactataatatttaactgaaaaaatactatgaaacctaattttatcaaaaaatccactagttgtttagcaacactttttttcttcttcggtcttttcaacaggttcagctggcttaatttcaaatgtaatgtgttcttcggttttaacctcattcttgagcaaatatttgataagttggtcaaatgcatgatcaatattttgtcctgaaagagctgagacagcctgatacatttcaacgtgatgatcagaaagccatgaatcaatgctttcttgaggtacttctatttgatcttgaggtagatccattttatttccgacaagaataactggcatttcgttattggtaggagaataactgttaagaaacagatttaagtagtcttcaacaccagtaaatgattgagatgatgataaatcaaatacaagcatcatgcaatttgctccatgaagaagagaaggtgtaatagccttaaagcgttcatcacctgcagtgtcccaaatcatgagagttacttctgacgaatctattgttaatgtttttgtgaaaaatcctgcaccaacagtttgttttgtctttgctataaaaacgttgttacaatatctttcaattatggatgtttttcctacgtgataaggtccaaggagcacaaccttaaagtctttagttttgcctgacattgcaaatgaatttttgaacacaaaatttcaatgtaaaacaacggttatattaaacgcttttcaacagcagcacctcccaaattaactacacgaaaattgggtgcgccgatttttcattgcattataaaaaagtgactaaaagacaattttacgaagacttacatatgaaggaagaaaaaataataactattccaaattttaaaacataacttcaagaacaattttacaaaatacttacattttattcaacaataaacatatattttatttttgtacttccgctttttttgtttcattgataaatcttttaattttattatataaaacattacattctttatcattaccaaataatttttgtatttcatcattaaacttttcatctatctgtgaatacacagactttaatggcattggaggtggagttgaacataaaattcttctaaacaattccgtcaaaattaattctttcattaaatcatctccaaattcgaacaagtgaatcaacaaatttttagtcattgtagtgaacaagttttgatttcttaattgatctataatcgcaatcattaaaattttcgatatatcgaaatctaatttattaaaaagatataagaaaaatgtttttccattatttttttcatcgtttgaaaaaacatataaaactaaacaccaaaaaattcgtggaattcttttattattcgaaacaaaacatttctttaaaacctcagctatatttatgaaatcattttcatttttctcatttttttctaataatatatcatcaacgattatatcaattccgaacatttttaatggcttttcaatatcgaaaccaaacgaaggaatattattttcattattttgatattcgcttgataaaattatatttctaaattgtatgaaatttaaaggaagttgttcaagcaacaaaacataaaacgaaataaagaatagtggtgcgttaattgaaatccgatataaaattcgagtgacactcttatagaagacatacggcatttctttacataatgagaaacatataaccaaaaaattaatacaaaactgatttgttttatattgatttaacttaataaacttaggaataatcgatttatgcatcattaattggatccaacaacatgaaaatgatggaaaatgtttcggctcgaaaaaagatataaatttaatgagtttatcttcgttttgaaaaaataatgaacttaataaaccataaattaatctaaataatgctaatggacataaagtaattgcttctttagctatggattgaattgctttagtagtgactgattctaataatactttacctgaacatttagaaaatgatgaacataaataatcaacaactgaataatcaattttattgccttgaattggtgaactagtttttcgtgtcgaatgtaatgcaaataatatcaaggagcgaatagaagagactgttggctctttcattttatctgtaaagtctgagcgatcattatctgtaacacaataacttaaaaatgatcttagtaaaggaatatgactttgttctggatatggtaattccttaatttttggtgtttcttttatgtttaacaagattttagtacttgtaaaacttgtcgagttatattcaagtaacataggcattaacggtaaaatttttgttttcgaaaattctgatgtgaaaggattcgttaataattctgagaataaagcattcaaatcctcgagattcaaaaagttcttgagtttcaaacaaaccgctaggaaacgtttatttggaaaagtgttcctaaaaaattgtattatatcgatgttatattggttatttttcataattcttaggaataagtttgaaaaatttaaagaaataacatctgagtttgataaagaaagagaaattatagccctaattattgattcatcaaaatcatcttcttgttgtactgttctaatgtttgttggatgattttcgaaataaattttatcagcaatttcgacattatttaaagctattgagatatcaaatggcaaaactgatatatccggttcataataaaaataatttattaaagacgagtttttagagtttaattccaaaatatctttttgctcaataaatttcgggttacgaaacatttgtattccattttccacttcaacgaattgggaaaaacgtgaagttgaatttaaagggatataaaatgttcttttataaaataatgacaaatcaatttttaatttattttcgaatatttttatgctttcttttatatctgttcttaaagaatcatcatattttaaagaagcaattatttcatataatgaaacaatataaggatttggcacattaaaagatctcggaatataacctaaaaagttcgaaaggaataataacgattcaacaatagtaccattaataatcgaatcctttaaaattttatgtatcgatattaatgataatggaggtaagatttcgttctttaaagtaagtgctgaaagccaaagtcccattttttcgaattgtgaatgcatattatatgattcccattgtttttctttcgcttgtttaaacaaggaattaatatataaacataaaatttctaaaaaaaatggattaacttttaatgctaatggcggattaaatgataaaaatatttgtactatgtaattaaattgtttaacaccttccattttattggcttcttcaagagatgaataaatgttttgactaagacttacttcttggatatcaatgtgtcgaatgggatatatattaatgattgagtgtggtggaaatgattttcgttgcgttggaataatataaaaatatttatatgaagatgtataaaaagggatttgtggattgatcttaagtgaaaaatatacatctgaatctaggtattgaagattgggtatttttaatatggaacgacaaaacgattgataattatgtagttctggaagaatggaatgtgctaatattaaacaaaatttaacaccttcttgtgatggtaaaagttttgtaactgtcgataaaaataaaaattgtgttggtaaaggaattaatgaatttaatatataccacccaattattgaaacagataattcatttaatggtcgttcaaggaggattctgagaatgcaaaaaatcattgatttttcttgtatgtttgatgataatttaataagctcttgaaaaatttgatttggttgtaaagaaagaatttcattggccatgttaactgtgtaatcactaaagtcatttacgtaatgtgatggatacttaattttcattgatggtgaacgtgttgttgaaattaacgttctacataatccgtttattggtgtaaatgcaaacatattaaaaagtggaaagtgtatttagttaaacagcatttaaattgtatataatcaatcacatactctttttcgcatgatttaatgaatctttcgatgctcgttaaattaattatcacatatgttgcaaaatataagaaatgtatggacatcgccagcaaatgcattttgtgaattatctgatgtttatctctttggatgtaagggtaattaattttttatttgcataaatattaaattacttcgcttttgttattctttccacaacttaactccatttgaagtcaaaatcagttaaggcggacgaatactccgctcagccatcgcaatgcctttgcctctgtcattagtcaaaacggattcttatacatagcctcatgatgcagaaatgccaatgcaagtccagtagcaatcactcgctggttatctctactacatcaacttcattaacctttggcacatctgtaagctccgtcagcttaatgatctctttcatgtcctcccaaaagcacatcatgttatgataaatcgaaaccattatatgcagatggagcagttgtggcgcgtagtggtggtgacagcacaaaagattgaggtggaaaagccgtgaaggtggcgcctcggcatatatttttcagcaagggatcttataatgctaaaccaaagaattccaaataaagagatcaagattccacattttgttcttttaggagatgatagcacacaatccgaagataataaagccttttcataggcacattgatttatgatgtatttataaatccttaattattattaatcataaatgatttattattagtcaattttcaaaaattaaatttaatttattggaaagcaattcaaaaatttatatgagatgtaatattttaatatattgattaaaacataccttaaatatatttaaaataaatttgataaaaaattcgaaattttaaaaaaaattgaatagctatatggttggatattataaaaattgaaaggtgtcacttttaaccgccgtcgactttttgtatggtttatttcgaaagtgccaaagaagaacgaaatttttaattttgcaaaaacgttttaattaaattcaaattaaataataaattaagaaatgtttaaggatggatattcaaatattttattgaagcggccatacccgattggatacatccagctccatttcgaacctggaaattaagcaatcgcgggccatatcagtactaggctgggagacttcctgggaacgtatggtgctgcttcctttttaatttatttttacattaatatgaaattatattttttatagaaattattaaatataaatgttttattttatttattattaataaaattatttaaaaatttatataagtaattaataaaattactttaattttaataatattatatttttaattatattaacatgattattaatgattattaatgattattaatgattattaatgattattaatgattattaatgattattaaattgtttaataaaaaagaataaaaaatttatttaatttacatgtttattttaatatttttattgttgttcttttgtttctttgggttcttccttagtttcttctttaggttcttccttttttctctgtattttctgatttaattgcaggtttttcttcatttttactaccaatagtttcaataccacgtcttaaagaccattcattttcaaatgcatcaatttcatctctttttaacaatcttttgttgtgtttcttttatttctttcttaagttcttcttctttaggtttttcttcttctttaggtttttcttcttttttgttctttaggtttatcttgttcaatcatattattaaattcttcatcaaatgtatctgcaaataaagaatttaaacgacgttcaagattattaaagtatctgttcatcgcattaaatggatgataaactcttattggtctatattccacgaatggatcataaaatggatcagtaaaataaccaaacataataaaaaatgaattaaactcttaattgttcatttaaaataaattaaaacatttatcaattgaaattttcttaaattaaatgaccgatcaattagttattaaaatatctttatcgtacgactttttgtatggtttatttcgaaagtgccaaagaagaacgaaatttttaattttgcaaaaacgttttaattaaattcaaattaaataataaattaagaaatgtttaaggatggatattcaaaatattttattgaagcggccatacccgattggatacatccagctccatttcgaacctggaaattaagcaatcgcgggccatatcagtactaggctgggagacttcctgggaacgtatggtgctgcttcctttttaatttatttttacattaatatgaaattatattttttaaagaaattattaaatataaatgttttatttatttatttattattaataaaattatttaaaaaatttatataaataattaataaaattactttaattttaataatattatatttttaattatattaacatgattattaatgattattaatgattattaatgattattaatgattattaatgattattaatgattattaaattgtttaataaaaaagaataaaaaatttatttaatttacatgtttattttaatatttttattgttgttcttttgtttctttgggttcttccttagtttcttctttaggttcttcctttttctctgtattttctgatttaattgcaggtttttcttcattttttttttttttttcttcaataccacgtcttaaagaccattcattttcaaatgcatcaatttcatcttcacctacattatgccatgtttctttagttgttttcttaccttctttatctacaacttcatcgacttgaacccaacgattaccaattcttttaattttagaaatataagtcttttctccatcattagtttgttcacgaatttcttcgaatttttcattaccattaaagtatctttgtgatgaataagttctataataattttgtggtctataattttcaggctttttaacaatcttttgttgtgtttcttttatttctttcttaagttcttcttctttaggttttccctcttctttacgtttttctcttttttgttctttaggtttatcttgttcaatcatattattaaattcttcatcaaatgtatctgcaaataaagaatttaaacgacgttcaagattattaaagtatctgttcatcgcattaaatggatgataaactcttattggtctatattccacgaatggatcataaaatggatcagtaaaataaccaaacataataaaaaatgaattaaactcttaattgttcatttaaaataaattaaaacatttatcaattgaaattttcttaaattaaatgaccgatcaattagttattaaaatatctttatcgtacgactttttgtatggtttatttcgaaagtgccaaagaagaacagaaatttttaattttgcaaaaaacgttttaattaaattcaaattaaataataaattaagaaatgtttaaggatggatattcaaatattttattgaagcggccatacccgattggatacatccagctccatttcgaacctggaaattaagcaatcgcgggccatatcagtactaggctgggagacttcctgggaacgtatggtgctgcttcctttttaatttatttttacattaatatgaaattatattttttatagaaattattaaatataaatgttttattttatttattattaataaaattatttaaaaatttatataagtaattaataaaattactttaatttttataatattatatttttaaatattttaacatgattattaatgattattaatgattgttaatgattattaatgattattaatgattattaatgattattaagttgtttaataaaataaatataaaatttatttaatttacatgtttatttaataattttattgttgttcttttgtttctttaggttcttccttagtttcttctttaggttcttcctttttctctgtattttctgatttaattgcaggtttttcttcatttttactaccaatagtttcaataccacgtcttaaagaccattcattttcaaatgcatcaatttcatcttcacctacattatgccatgtttctttagttgttttcttgccttctttatctacaacttcatcgacttgaacccaacgattaccaattcttttaattttagaaatataagtcttttctccatcattagtttgttcacgaatttcttcgaattttttcattaccattaaagtatctttgtgatgaataagttctataataattttgtggtctataattttcaggctttttaacaatcttttgttgtgtttcttttatttctttcttaagttcttcttctttaggtttttcttcttctttaggtttttcttctttttgttctttaggtttatcttgttcaatcatattattaaattcttcatcaaatgtatctgcaaataaagaatttaaacgacgttcaagattattaaagtatctgttcatcgcattaaatggatgataaactcttattggtctatattccacgaatggatcataaaatggatcagtaaaataaccaaacataataaaaaatgaattaaactcttaattgttcatttaaaataaattaaaacatttatcaattgaaattttcttaaattaaatgaccgatcaattagttattaaaatatctttatcgtacgactttttgtatggtttatttcgaaagtgccaaagaagaacgaaatttttaattttgcaaaaacgttttaattaaattcaaattaaataataaattaagaaatgtttaaggatggatattcaaatattttattgaagcggccatacccgattggatacatccagctccatttcgaacctggaaattaagcaatcgcgggccatatcagtactaggctgggagacttcctgggaacgtatggtgctgcttcctttttaatttatttttacattaatatgaaattatatttcattaaatctataaaaaaaaatttaaattattaaatttttatttttgtacaaacattatatctttgatttgtttaaattttattaactattcgtgaatttatttttcttaatttatttaaacttttttttttcgtttttcaataaaaaatttgattttattcatagaatttgtttcattcactttatttactatgttataaagatatccaaaagattgaatttgtgaaaatttttgataataaccccataatttaatttattcttaaaaaatattataagatttcaattgaaataatctaaaataaaataataatttaaaatatttgggtttttacttagcttcgaatatatagcatgtaagggcatcacaattcaagttgaatccgccatttccactgtattgttgacctgagataagatctttgaaggaggaaccaccacaattaacataaatagttgttggcattgtacctgtattaacaacaaagacaatttttgtttgtgtttgagaatcccatttaacattaataagtgctccatctttagttgaaacgctattagagcctctccacattgctggataattttgacgaatgttcattatctttgcagtataatcatgtaagtcttgttcattattattaaatcctgagatgtgtccatcagtacgtgcaacattatcacctgctgtattaccaccacaaccataagattgccagcagtcagcgatgtcaccaacttcatcgccataataaatcgtaattggaccagtgtaagcagctaaacaacctaatgcgatcttataacgcttccaatatgaaggattgcttctatcataaccatatttgttacggattaagttaccaaatctccaaacatcatggtttgtaatgaaaagatttggataaacatctgatgaatatcctttttcacttggtgttttgaatacatttgtaagtgtaccaacaccatagccaccagcaccactttcttcttgtgctataacttgaacaaggttataacgtgatgggaaatcaaatgcagatttaagaccatcttgtgaatatgtttgtgattggatttcgctagcaccactccaatgttcaccaaccatataaccaagtgtaccccattgtttgccttggttcttacgttcattgcagacactttgaactgcttcacgaatttcatgccaatagttatgaccgttttgataaacttgataacattgatcaagacgccaaccatcaatttcatattcacggatccaatatgttgcgacttctttataaaagtctaagcttcctggatatgaaactggattactgcctccttgaggatatttaccacttggtgatcctttgacattacctccatgatgaccgaaaacaccatctaaaaagatatacattccacggtcatgacagcctctgataagattacgaagatcatcattagaaccaaattttgggtcgacattgaaataatcagttgcaaagtaacctgttgattgaagtaatgaaccaccagtaccacctgttgaatcaaatactggtgtaagccaaattgcgttgacattaagacctttgatgtaatcaagagcattaatgatacctttgagattacctctatgactacttggaccatagcctgtgcaataacatgatgatccatcaccttggaatgatgagaccataatttgataaattgtaagtgagttgaaatcagtgtttaatccatttgatgctgttccaactgtagttgtacctattgttgtttgtgctgtagaagttgttttgtggaatgagataaagcctattgttgtgccaacaactaaaccaattccaacgcataaagcagcaatccaataataccttctctttggtttgacttctttttgggattcaatatcctttgaactaagaagaggctcgttttgtatttcctccattaaaaaatgaaatcagatagggtgtgaagtgtttacattcaaaatgagaagaaggaggtagcttctcaaaatgagcggttattttaagcaaaagcaggtgcatcacaattcaaaattcaaattaactcacaatttcaaagctttcaaataaacgttccattttcgcttgttgtggatgattttttgtttcaaaaattttattaacagattaaacacattcgtagttattgaaactgaatacaaagattttttatttctcgttaaaacttaatactgaagaaatttaataattagaattagatcactaattaataaaatattatataaataaagaaaaatttattaataaattatcaccatgaaaacattatatctcttggataaactcaacaggatacatatgctctaaaggttccaaaatgatttgagcatattttgcaatttctttatcctcacttgtttgcaaataatcaaatgtttccaaaacctgtaatctcagctcttccatttcctggatattatcattttcttggaagaagtttagatttggtccagacttatccaaagtataaaaagtaattttcatgataggcctcaaatactcattataagcttctttagcttcatcagcaaaaaagcataacaacatattaataagattatatctcaaaagatggaagaatccttgaataggacaatattcacaaaaagaagcaattgcccaataagcttcttctttaattctaaaagttccggtctctgtcattttgaaaattgcttgaacaatattttcgttttccatatgatatataattgattcttcatcatcatatttttctaattccgcaagttttgcagaaagtctaattccagaaattataactttttcacattcgctcgaaaaagaacagtggatgattggaaagatatcatttaaattaattaatgatgtttttttaattacaactgatattgttttcgctattgctattgataaatcattcatactaagaattaaacttattcgatctattatgggacgactatactgtgtacacattggagtggactttttatacactttccgtaagcctgttaaaaatttgattatgatttcttgatcatctgacgcaaatacattttcaataaaatcattaaattcaacatcttttgaatcctctgcagattcaataggtgggataacagatgtggtagtgtaatcgtaaaaatcatcattaaaactatttgtaatttcaaaaaatatattaacaactatattgagatattgaggtacatcagagaaaaaaatcaaaaagtaaagtgctccttcatcaagaaaagttttcgatcctaaacagcctgagaaatgtattaattttaaaaattgttcaaatgagtttggaatatatttaataagggttttgaagattccgaatgagataagtgatttggcattatgtggaattagatggtctaaaaattgtaatggttcatcaaatgaattggaattaacttgttcattgaaatattgaagaaattttgtaataaaatcattatcaaagattggaagttcatttccaaacttcgtatggagagaattcaaaatggaaggcggatcttgaaaattattgataatattgggaggtacttttgcaaaaggaactatgggttgagatagctctttctcaatgtgtttctttcggtgtatatccatgagacttgcctttcgttggtttgaactttgtttgcaatttttcttgtagttcatcaaaatgtccaaataaaatttttttaaaacgtactaaacaaattttcacgcaagaatacaaatattttaaataaaaacaaaaaatgttcgaatgatcattcagaaaaaaaattattgaaaaatgttcatttttataaagaaaaagacattgtaaggtacctttgggtgattcatatgttaacttaaaaaattaattttgaaaattgggaaattaattcaatgattgaagaaaaacactattttgatgtttaaatacaaaaaggaatcatctcttccataaggccgataatattgtttactatttatttacttgaagattgatccaactaacaaatttttaattcacttaaagaaaaaaatatttttattttaacaactttttattcttctttataatataattaatgtcatctgatttctcaattatccttttttctcttatcaaaaatattccttttctatcacattctggaagaaaattgaagttaattccattttggaacaaaatttcatttttatcagaaaatgataaatcggaaattgatgaaatcgtattttttgtgttacgtttaagaacaatttcagtgtacatatcaatacaattatctcgaacgtcaatttgttttgtcttcaaaaactgaaatacagacttccttcgagagatgagcgtaatttccccattaaaatacatgggatattgcatttgaatatctgggaaaaaaattgaccaataaaaaattgtagaagatgtaaaaagagatatgagatttgtcaaaattttgtctcttcttctgttgaatatgtctgaatttctattgaatatgaatgtaaattcatctttaaatagaaatgctaattcaacatcagcaaaatcttccataacatgtctagcagattttgaaaaaagtttaacaagtcttaaatcagttggaaatttcaaaaaatgatcagagcagaatttttgataatttgtgcaactaacagaaacaactaagtaggtttcgtgaaggaggatttcttctgcttcgaattgtttcacatattcgaaacgagaatttaccatcctgcttaaaaatggtattcagtagcattggaccaccccgaacattcagtgcttatctggtcgatttggaaatgggagaagaatatgcaagtcaacaaacacattatgtaacaattccaacccactacaaatttgaagaaaaaggagttattagacgtgcagcacttgggttactaagtcttgttgaagatcctgaaattgataaaccaatgatgttatcatctcttaaaagctcccgaaaatataaattcctagaggacaactgtgttacccttgaaggaggatatcgtctttgcaggtccacaagatattttcctgttgattcaaataaatattattgggaatttgactttattccatcgcctgaactcgacagtcacgttagatttggaattgctactgtcaaagctgacatggaaacaccagtaggttttgattccgaaggatattctgttcgtgatttaggtggtgcttttcacaaaagacataaaacggggtctcctcctttcccaccaaatagcacagttgggtttggtatattttctaatgaaaatggttttgtacttcaaatgtttattaatggctttgatcaaggaattattttcgaaaacattgatttagagaaacattggattccatcactatctatttataagagtgctacagttcgcgcaaggttttcaaggccattcaaatttgatccaggtcttgattggaaagatgcaattcaagttccaaagccaataacaaattgtcaaatcactgcagatgaactgatatatgtgatgcatcacgcgttgcctggaaatgagaaacaaaaaattttatatactgcttgttcacaagctttgacacctgaatacgaaatgccaatatagttttgtttataatcgaataaataaaagtattacttagaaaattttgttctgtttttagaaataaaaacatcaacagccatattttatttacaaggagatgttaacatgttaaacatgatatgtggctttaatattggagcaaacttaatccgaatattgatgaaagtggtattaaagagtaagaaagagaccaaagcataaagtgtatatatgtccagtactacatctatagttataattatctattggagaactacagttgaaatatgagttcgtgtttttaatatgttttttcattatttaattcactgaattatttgaatcgaataataatataactaatgaacaatatatccatcaatacatgaatgatcagaactatttttagaagtttatcaacatattataattataggtaagaatgatttttttgcaattttaatataaatgtctttaacctataattttttttaaaatatgtggaaaaatgttaatattttgaactatataatctacattttcgttctaaaatattaagatgcaaaaatgtctctgatacttgtatttcgcgcattatggatttttatcaagtcttgctgacattcctatttgccaatgatattagttccaattattaattcacaaaaaattattcaactcagtttctgtttaactttaaatgaaaaaattagaacaactaatttttctgatactatgatacattttttcgatacataaacactttatcagagaatatcattaataatttgataatcaaaattcaaaatataaatataaaaatgtaaatccataattataataaaaattgatgccacgttccattaacatacgtttattttaacgtgcttttaacaaggagttcacttcaatgaggcaaacaacacttaactttatggttgatggtgattcaaagcctaaaaagaaggttgaccctattgagcctgaagaacccattgatgaaggaccaataaattatgataatatatttaattcagttgaagattttaaaaaatgtcttgaaccatcctggcggagggttttatctggtgaattcaccaagccttacttcagtaaactacttcaaacacttcgtcaagataatcgtcaaatgtttcctcccaagccagatattctcaatgccttcaaatattgtcccttcaacaatgttaaagttgtaattgttggacaagatccatatcatgaagaaaatcaagcgcatggactttctttttcagtacgtaaaggcgtgcctattcctaaaagccttcaaaacatatacaaagagctatcagatgagtatggggatgaattcacgcgaccaaaccatggatgtttagagagttgggccaagcaaggagtattactcctcaacgcaacgctaactgtcgctgcgcatgatgcaaactcgcacagtaagtatgggtggtccaacttcacaaatgcagcaattcaagctgtaaacgaaaaatcaaacggggttgtgttcatcgcatggggaggaaatgcaaagagcgtttgtaagtgcgtaaataagaaaaaacattgtttacttgaatctggacatccttcaccattatcagtgaaatactttttggggtgcggccacttcaaggcagccaacaagtggctgctagatcatggaaaagcgcctataaggtggaactctgtgaatgatgagtaaatattcgaatttgtcttttaacttagtttttaactatgtcgcgctggatgtttagatatgaattttgagaacactgcagtagatgaaaatataaaattcacatgatttcctttattattaatctgaaaaaatatttaatattcaattaatgcaataaattgaccaaatttttttgaaaaattgatgtattttgatgatacataatatttgaaattaacttaaagtgtatattgttatgtatatatttatttagaatttcatggaaaagatgttgagaaatttgaattttttgttttaggtgtcagtttttcacggctaatcagtaccattgcgccaaaaatattctcgaagatatatggccacatttttttttaattcatcgacttcgaaaaatacgcaagaatttcctgtttcctctaattttctatagctgaagttcctatcgtttgtaaacggtttccgataatcctatcgcttacacaaatctgacattttgcttatggaaaacgaagccgttgatccaacaaatcccttaacgataggagaaaaatcaggaggcacacctatcgatatggaaatattacatagcttggaaagaattatattcaatttatctgaagaaaatttaatgttatccgttcaacagacgatgaaattatttgacaataacttttcatattcattaaatatagcaataagtaatttagtttattgtgcattttgttctcaaaaaaattcatttgacatgtatttatgttatttgaaatcaattcaaacgaaagaagacgaaataacaaaaacaaaagttaatccaacaattattgaagtttttgtgaattatatatcagaaattgaagtacaagaagcatattatcttattgaaaaatttatcgacttaaatttagcagatgaaaatattgctaataataatcattcactctatttttcacatcgtaatcaagtaacgccaaacaaaaatcgcaataattctaataattttaataacccaagatggaataataatcatttcgatgatgattatgatgatttgattgaagatgaaatctcaagtgatgatgattcagataatagttttgatgattattcatatcataattcatatgaagatccaattgagaaatctttttatgataattatgaagaactttcaaagaatgattttgaacttcataagagatatgttaaagaaggagttaatccaagtgaaatagcaaaaatccttcgaaatgatgaaatagaaaatcttcaagatttaacatcacaaccgaattttgattttaatcagaaaattgagccatcactttatgaaagatgttcatatataaatcaacaagacattttacttattaattatgccgcatttttcggatcagctcaatgttttaaatatttattaatgaatggatccaagttaaaaaacacaggaaaatatgcaattgcaggtggaaatcatgaaataattcatttatgtgaacaaaatcatgcaacttttaaaggttcttatgaaacagcaattaagtttcatcgaaatgaaatcttttattatctatatgaaaatgaattagataaattagataataatgatcaacaaaatccttcaatgttaggaaatagaccaaatattccaatgtttccaaatcgaaggaattttttgaactttaatcatggagttaatatgaatcattattatgcaatgcataatccacatacattaaagcctacaaatgatgaaataaaaccaaaaaacttaaataagtttaataatatatgtattaatagtggaaattatgaaatactttcattcttagaagaagaaggaatgaaaataaatgaaagttcaataattgattcggcaagaataggaaatttattccttttaaagcatttcctttcaaataataataaaataccgaaaaatattttagtggtttctttgaaatctggaaatccagaaatagtaaaatatgttttggaattaaaaggaattgatataaatgttaaaaatattaatttgtttttatataatgtttgatttcatgatttgaagtttgagtttttgatatggaatttatttgttatatttaaaactgctttaattttagctactgaaaaaaatcattataaaatagtgaaagagtttattaaaaaagatgaaacagatataaatgctaaagatgtttattgatattatcagatgtttcttttggtaatttaatgttttatattgttgtttggagttttttggttatatttaaaacagcattaatgattgctgctgaaaataattatattgatatagttaaattacttcttgaacaagaaagaattgatgtaaatgttaaatcgaatatttattgataatgtttaaagtataatttcataaaatgatgtttcataatgttatttggaattgaatcaaatgatttctaacagcattaatgattgcaatcgaaaacttttatgctgaaatagttaaattacttcttgataatggaaaagttgatattaatgcaaaagataatgttgatttgtttcgtttagagcttttttagttattttatggttttaatttaaaatttggtaattattcaaagtatttcaaacagcattaatgattgcaataggaaatggtaatattgatatagttaaattacttcttaatcaaaaaggaattgatgttaatgctaaagataatattaaacatgtttatttagagatcattttgatgattttttatttaaacttaatatttaggaattattcatgttattttatacagctcttttaaaagcaatcgaaaaaggttatatagaaatagttaaattacttatcgaacaagaaggaattgatattaataacaaagacaatgtaaaattataatattacgaattttttcttatgatttaatgtataaagataatatttaaaaattatttggaatatttgtgtcagcttttattttagcagctgaaaaaggtaattttgaaataattaaattgttattagcaaaagaaggaattgatattaatgctaaagatgtttttttgttttaattagattttcttttattgttttaatattcaaaaatcatgtttgaaaattatttaaatcatttagaacagcacttataaatgcatctgaaaaaggtaaaacagaaatagttaaattacttcttgaacaaaaagatattgatgttaatgctaaagacataaattttgtttatttattgtttattttgataatacaatattcaaaaataatatttggaaatcatatataatatttgttacatcacttctgattgcatctaataaaggtcacttagatatagttaaattacttctcgaacaaaaaggtattgatattaatgctaaagatatttataaatcttctttaaagttatttttaacaatttaatatatcaaaataatatttggaatttattcaatttgtttaatacaacactaattaattcatctttatatggtaaaacagaaattgttaaattacttcttgaactagaaggaattgatatcaatgctaaaaatgtttatattttttgtttaatgatattttacaatatgatttggaatttaatttaattgtttaaaacagcacttattttagcaatagaaaaaggtcatatagaaatagttaagttacttcttgagcaaaatggaattgatattaatgttaaagatgattatatattttatttaaagttgtttttaatgatttaattttttgatagaatatttggaatttattcaaattatttaatacaattcttatgattgcatcttcatgtaaacaaaatgatattgttaaattacttattcataaagcaggaattgatatcaatgctaaaaatgtttatgtttttcgtttaatgatattttgcaatttgatttggagtttaattaaaatgtttgaaactgcattaatatatgcaaccgaaaaaggtaatacagaaatagttaaattgcttttagaacaagagggaattgatattaattcgaaatcgaatatatattttatttatatagagtttgattaattaattttatatttcattttaatatttggtaattgatcaaagtatttcaaacagcattaatgattgcaatagaaaatgattatattgaaattgttaaattacttcttaaacaaaaaggaattgatattaatgctaaagataatattaaacatgtttatttagagatcattttgatgattctttatttcaaaatattatttggaatttgttcatattatttaatacatctctaattattgcaactgaaagaggacgtacagaaatagttaaattacttattgaacaagaaggaattgatattaataacaaagataatgtaaatttatgttgtaaagaatttgtttataaaatattttatttcaaaatattacttagaatttacttcaattatttagaacagcatatatgtatgcatctcgttttggtaaatcagaaatagctaaattgttagaaaaatatgcaaacaattctaaataaaatattattaattaaataaatatttttttaaattatataatttcaaaaaaaaagtcacaattaccataataattcttcacattgcaaaagtattttataatgaattttgtttcatttaaaacaatgattcaataacaaacgataaaaaccgttgctgctcttagcgatacaaatgtcgtgggatggtttgctccattataacgatccaacatttatagaaacatcgtgtagaatgccagtccaaacatttaagcacaacaagttagatgtttgtatcaaatttaggcagattggtgatcgaacatcaaaagaagcagttttatttttcccaagcatatatgaaacggaggcatctgcctttcgaattgcacctctttttgagaaggaaaatcttcgattcatatccataaatacgtataatcatgcgcaattcaccgatctcatgcgaacaataagacagctctgcttataccttcacttagagaaggtccatcttgttggctgtgatttaggcggattcatctgccttcaaatccaagcctatccacaatttcccgcaaaaatcgagacgcttacgctcataaactcatacacagagaactcattttttattccacgttccatgtcatcattttcagtcttcggctatcttattgccaaatcgaagttggaggaagagctagagcaatccggcattgggtacgagaccaaatcgtatgcgtttgtacacaaagaaatcgaatacgccgacaaaaagaatgccgcgcaaaagatacaattgcgaatgtcgcaatctctcccgctaaaggtcaacgtcgacaagcaaaggataatgtcaatcgagcctctggaccgaaagctgcaaatcattaccccttttatttcatcgtcgacattctctgattgcaaaatcgcgctgatgaagaagggcggagacttcccgcacttggaggagcccgaggacttgttcacgtacttgctgtgccacatacgcaagttcatgaaccaggacgcagatgcgcagaaccagaaccaggaaaatcaggaaaactgaaacaagtcaacttggttttgctttgaacatttaataaaaagatttgatattcagaaacattatatggaaaatgtgttgtggattggctccaaaattatgatgaaatttcacttctgttcattcattcagtgttgtgtaaatatgattttgcaaaattatttcttgaagtttttcgtttgaacaatttcattttgaattatatgaaagttcttaatgtttatctttgatttgtatctgaatttgaagagaattctacgagtggtacaatgtttatttcaatattatgttaagtgttgatgatgctgttttaatgggatactttaaatgtttatattcttcttctttgttttgtcgtgttgtgctttctttttgacgaattggaatgttatcaaatatttttatgatgtttatatatctgtgtcttgtgaaaatgattgggcgtatttaatatttggatcacttttgtttcatggattttcatctgagttaattctcgtaataatggaaacattggatatcttgaatattatgtttaatttgttgtttgtactaaacagtgttataaatttgcttattgtctttacaacatcgcaaccgaataatacaaaggtgaatgaattggagctgaaacagggaattggctgcaaaagcattttagtttgatgtaaaataaagtattcaaattttcacagttcatcaactttttaaagtcaaactgaacgtatcgtcctataggaccttgaaagtttcagagtttaaatattttacaaaagaagaaattttaattaaaattcacaccaaaaaaaataccattaaaaatcttaattacttttatttgttaaaatttaatcttttttatttttagattaaaatctctttattgtattaaccattgatcttcatcatgttgtattgcattgttaaattcatcattaatatgtatggtttgcttttcatcgtctgatgaagactcagaaaggatttcagtagttttgcttgggattttcttacttcttcgaattgtaaaaattattattccaatgatcaataaaacagctataattgaaccacagataatgcctattaatgcattagttgaaatctttttagttggctgagattgagtttgataatatgtaaacattatcaaagaataatctaggttatagaaagaatactgaataattgtgtattcataatgtattatttctgtagaaatataagagtaacatgtattatataatgtaagtaataaggaatttgttaaatacattgtgtaaacagaatatgattgtgttaaatatatataatatgttaatgtatatgaatataaattagttattattgtgtttgattgagtgaatgtatttgatttcgaaaatgtatttgtaaatgtgtttgtatatgtatttgattgagtgaatgtgtttgtatatgtatttgattgagtgaatgtatgtgttgaccaaggatattgatcacattcatcaattggcgttcctttggatatgttaagttctccaaatgtttcattttgatataaatcggatgtcatgacaaaattagttacaatttcatcaaaagcattatcttcgataattggtgttatataacctaaaaagtaaatacatgtgagattactgcattgtgcaaatgctgaatccccaatagaatttacattttggccaataataattgttcttaatgatgaacaattctgaaatgtattagatccaattgttttcactgaatcaggaattgtgatatttattaatgacaaacagttagaaaatgctgaaattccaataaaatttacattttggccaataataattgttcttaatgatgaacaatattgaaatgcaccagattcaatccttgttaatgaatcaggaattgtgatatttattattgatgaacatttagaaaatgctgaagctccaatagaattcacttttttaccaaagataacattttctaaattaatacattcttcaaaagaatatgctccaattgttgttatattttcacctatataaactatttttaatgttgtccattgtttaaatgccgtgtttccaattttcataagtgaatctgaaatttttatcgtgtcatttgatcttcctaatggataataaacaatttctgtataattcttatcataaagaattccatctttttctgcataatttaaattatctttagatacattaataaaataaagtttagtacaattagcaaaaacattttgttgaatagtataaactgattttggaattgtaataatttgtaatgaaatacatgaaaaaaatgcatattcattaatagaacttacattttctccaatattaatattttctaatttaatacatgaagaaaacgtataactttgaattgatgtaacaaaatttggtatcgttatattgattaatgaagaacatgttgaaaatgcattactttcaatcgtttctacattattaccaatagtaatattaattaatttaacacaattagaaaatgcataacttccaatcgtttctacagattcaccaataaatactgtttcaagacattcacatttttcaaaagcattagattcaattgatataattgcattctcgatatcaacagaaattaaagaaggccatcctgaaaatgagttggaatttattgtatcaattcctccttgaattataagatattttgtattctgttgatatgaatttttagatgcataatcatttgaattaattattgtaaatgttttagtactatcatcatacgttgaaaatatttgttgataaaagaaaacaaataaaaatggtaaaattttaaatttaactttctcttttggaataatttgataaattaaattcaataaacagtttttgagcatcaaaaacaatataaaaaggactgcaagaataaataaaatatttgacaaaattttctggaagaagaaagacaataaatttgaagaattttggttaacatgctgaaaatcagaacaaaatgaaccactgatttttggaagagatataacagattttctagtttcaaataaaatttgaagatagaaatcatgtttagaaaggattttaattctttgaatcaattcaatgttatttaactgaggtatttttaatacattggatacattgcatgacatcgtgaagactagaaacagcatcccaaaaaaaagcattaacaattttttttacataaccgaaacagtttgattcaaaagctgatgttaaaaaattttgacattgaaatttccttcactcaactttcatgtattgaaaagcttttcaatttttttatgacaaccgttcggacttccttcactctgggaagtcacttacttcccaggaaccaagaaaaccaacttttttacatattgaaaaacttcacctattaacggaaaatgtttttggtttttaaaagagtgttcttcaacatccttttttttttttttttttttttgagatgatattggtttaaaacaatcatatcagttcaaaggcgatatcatctctataattagttttggttcatacaaaaataaactatgttgaaaaacagtaactgttgctttctaaataaagtcatttaaaattcatttaataaatgaacaaaattaatacattagtgatttatgatattaatggaatacatagctccttcccggttcaaactatttggttcatcccttggggatgaatcagaatggtcatgttaacatttaactgtttatcaatacgaatccccttgttaatggataatgatcgcgacaaaatactccttggctgtatttttgtatattgagtttgtacaactcattttttcttattatcaacatatttgagtgcaaacaaccagtcagaaaattgtttgatgcttaagtgaagattaaaggtgttttaatgccactttttccgattatattataacctgaatttctttcattttggtgctctttttcaaaaattttaactaagtctccaaactcattttgctacgcagaaaaaacattttggttttaatagattcaaagagagcaaaatatttacaacttcaaatataaatttgatcaatgttattatcttctttgaagtcttttgcaaatggatcttcatcaatatttttcattgacaatacacctgtgtttatattcgtttcaccattttcgtcaaaactttttgatatttgttcaatagaattatgttttttgtttttaattagaattaaaaccacaacaagtaaaataataataataacaattacaaacacagtaacaccaattataatgttataatttggattaccaccaatgtcattatcttctattgtatataacattataaagaaattagaataaaaagaaaaaacagaaggaaatataataattgtatattcataataaataaattctgtgaaaatatatgttttgattgaattaatttttgagaatatataagttaaagtaaaacaattttttagtgaatatgtttgtgtaaatgaaataaaatatgttaaagtgaaagattttgaaaaacttaatgaaaaattggatataaatgattttgattttacaaatgttttcgatttggtgtctgtagttgatttggtgtatgtatttgattgagtgaatgtgtttgtatatgtatttgattgagtgaatgtatgtgttgaccaaggatattgatcacattcatcaattggcgttcctttggatatgttaagttctccaaatgtttcattttgatataaatcggatgtcatgacaaaattagttacaatttcatcaaaagcattatcttcgataattggtgttatataacctaaaaagtaaatacatgtgagattactgcattgtgcaaatgctgaatccccaatagaatttacattttggccaataataattgttcttaatgatgaacaatattgaaatgcaccagattcaatccttgttaatgaatcaggaattgtgatatttattattgatgaacatttagaaaatgctgaagctccaatagaattcacttttttaccaaagataacattttctaaattaatacattcttcaaaagaatatgctccaattgttgttatattttcacctatataaactatttttaatgttgtccattgtttaaatgccgtgtttccaattttcataagtgaatctgaaatttttatcgtgtcatttgatcttcctaatggataataaacaatttctgtataattcttatcataaagaattccatctttttctgcataatttaaattatctttagatacattaataaaataaagtttagtacaattagcaaaaacattttgttgaatagtataaactgattttggaattgtaataatttgtaatgaaatacatgaaaaaaatgcatattcattaatagaacttacattttctccaatattaatattttctaatttaatacatgaagaaaacgtataactttgaattgatgtaacaaaatttggtatcgttatattgattaatgaagaacatgttgaaaatgcattactttcaatcgtttctacattattaccaatagtaatattaattaatttaacacaattagaaaatgcataacttccaatcgtttctacagattcaccaataaatactgtttcaagacattcacatttttcaaaagcattagattcaattgatataattgcattctcgatatcaacagaaattaaagaaggccatcctgaaaatgagttggaatttattgtatcaattcctccttgaattataagatattttgtattctgttgatatgaatttttagatgcataatcatttgaattaattattgtaaatgtttttagtactatcatcatacggtgaaaatatttgttgataaaagaaaacaaataaaaatggtaaaattttaaatttaactttctcttttggaataatttgataaattaaattcaataaacagttttttgagcatcaaaaacaatataaaaaggactgcaagaataaataaaatatttgacaaaattttctggaagaagaaagacaataaatttgaagaattttggttaacatgctgaaaatcagaacaaaatgaaccactgatttttggaagagatataacagattttctagtttcaaataaaatttgaagatagaaaatcatgtttagaaaggattttaattctttgaatcaattcaatgttatttaactgaggtatttttaatacattggatacattgcatgacatcgtgaagactagaaacagcatccaaaaaaaaagcattaacaatttttttacataaccgaaacagtttgattcaaaagtcagaagttcatatgaaatttcaaatcagagaaagcttctcaaattttcaattaatttaattttcaataaacgatgactgtagttgcttcactctgttagaattattaaaataatatgaaattaatcaatgaaatatatgatatcaacatatgacacaaacaacataatgtcaaaataaatattatttcccttataaaacatttaatatttaatcaacataattagaattattcatttttataattgaatatgattatgaaaattttattgatataaatttctcataaaagtaagtaaatccctattgttataatgatatataccttccttgaaatttttggtttcagcattttctgttattgtattggatattgtttttctttatgtttcttatgaagagacccatcattctttgaaagctccatatttcacgaaacttccttctaactttcaactacaacttattttttatggaactctggtacataaattatttttaggaaattgtgagtttccaaatatttcgatggattttaccacaatttattgtacaataacgacaccattttgttcatactaaaacggatatttaaaaaattaaaaaattcatgtgaattatctttattgtatttaatatccatttccttttgcttaattttgaaagttcttgttggccatttccctaatttctctcattttttctatatattcattaatatgattattaataacatcgaatttttcctgatcacctaattgcatccactttgtgaaaacagtgtcataataatccattctatcaaaacaagggaaatatgtttgcattgtttccttcacagggtaaatgaatctaaatccacttgggattcccatttcttcaataaagtctctaattatcacgaagtctgcaaaaacaggttggatccaagggtccaccccaaattcagtaacgtctttcactcgtgattcggttactgaacgatagaactctttttcaatgagctcgatttcaatgcatggatggctttccctcgggtcgcagtctatgattcttgccatacgtaataagtctaagttaagaggatatttcatttcctgatcaagttttgaatccataccacttaaagatggtgaaatgttgatttcaatcaaatgtgcatttaaatctgaatcaagcataatatcaattccatacatctcatatgaagtatgatgatgtggaataacttgtttgtgttttagcttgatttcacacattcctgcaataatagttgcaattgagattctttcgaattctttcatgagcctcgttggatcaattccttgacttctgcaatactgcataaagaagccaatcgaccatttggagttttctattgactcatgaactccatcgcttctaatgaattctttgtcatccttattaagtgaaaagttggtaagatgcatgtgttggtcatcaggagatgagtcgggtttgtattcgtgtgtagcaaaacgtgccattccagcagaatgcatataaattctgagtggttcaattgatgtgactaatatataaagccttatatcaaactttcgcttggctacaagaagtggatttctaatgtagtattgaacaacacctggagaggtgggaatggtatcatgattggttaatagatgaattcctttccctcgagatgaagcagaaggcttaactatccataaagcatgactttcccaaactttgttaagctgttcttgatcacctggtaagaggtaactttcaggataaaaagaagcaaaatcaccaacacgttctcgcagttctgacatacgcatgtttaagttatctttgcggcccataagaaaagcacctgcaaaatgattgatcttttgccaacattgacatttcttgtattcagtcattgtgtattggcgaccccatgatgcattccattgtggggcattatcagtaggcgtgaatcctgcatgacgaaatgtggaacgcgtgaggtttgtgataactttatttacataatacttaattttgtgttttggaatatttcttggttgatctggtgttgggacattaacataactatacccaagtggaattgattgaaataattgtcctagctgatcaataaaagaattttgattcgaattcgttttataaatttggtctgactaactttttggggcgccccacgatatgagtaaagttcgcaaaactttgtgaagttttaaattcatatttcaaaagtttccttgttggtaagattttgaagcaattattcatgttcttcttcttcgcctcttcgtgtaaatgtttttgcaacaattcttttttttggcattttccacaatattatatttccatcatcaccggcagttgcaaaactttcaccgtttggtgaccaagcacaagaacaagtattagcctcatgcccttctagtgtataaagcatttgacatagttcaaggtcaaatatgtgtgacatgggatcaaatccagttgtcaaaatcattggtttatttgggtgaaaacgagcacaacaagctttggcgttatgaacttggataacttgtttttctggagaacggatatcccaaacagaaaggtgatcatcacttgttgctacacacataagagttcccgtatgatcataatcgatactaagaattgaaactcttttattgatcttaaatgatttgctccataaagattcttttggagaattaatatcccaaattgtaataagaccattatcatccccagctgcaaatgtactattaacaggattgcttttgcacgtagttatttgaaagttactggcgtgaaatgtgtttataaaattcaagtcatttgcattccaaagtttaactgttttatcatttgaggcagtaagaatgtgtccgcttgtttttaagatatctattgagtttattctgccagaatgacattttttatgaaaatttgattctgtttggttgagattccatatagaaacttttccatcagttgaagaagcataaattttttctctgtcgtttgagtaaacactacatgttggagtaaaatttttgcattggtatattagtggccgatttgaattattaattctatatgataatattcctaatgaacgtgaagatgctagcagcattgtattatttggactgaattgaagtgatgctatatcttttcttggagcaatgaatcgattcttaaaagttggtttcattttccatagtacgttaatatatttaaacggttaccaaatttttagatgatataataaaaatgaaggttgtgggattgtttatttaaaattatttatgttaaagcgaaacttaccacaagcctattctttgtttgttaagcataaattaatgggccataatcttcgttaatttcctcgatgtcaacaaaagttactggtacttgatcttggtttaccatctcttcagtacagggagaatcacttataaatgtaccttttgtgcaaaacatttgatatgcctctctcgttattctaaaatgagttacaggagggtaaagcaatgcgtcttcatcaaagttatttgtgaaatatttaactgctttagcattcctttttgcattaatttttaaaataaaatgagatgctttatcgtgaaaaatgtattgatttttagaaacaattgtgaaagctcttgttgtaacataatcatcaagtttgtataaatatggatctaattcttggttttgttcttcataatataaaattgttggctcctttattgtatatttcagcttatcaaaacttcttttaaacatatgaaagtaacaccataggttagaaatttctcctgtgtttatgatgctactaaattgttgataaactacaggagaatgaaaataataaaaaattgtgtttgcatcttctgttcttacataatccagcacgttttcagaaatttctttaagtgatacttgaaagaatattttctggaataaaacatccagcctcactgattcttcacctaaaattgtatcaatttcttgataagaacaatattcatattcctcttcttgatcagaattgggtataattaattggaatgttttttcctttatagaagtataatctggatagaatccatatatattatcagattgtaaaccatttctaagtaaatagataaggaaaaacatttaaaaaaataaatagtttagaaagtataaaaagttttaacataaaaatgtatcttacataagaaaaaagcaaataattaaataattttatgatattaaagaagttaaactttatatttgaactttctttactgagtttgaaaataatcatttttggttaaatgtgggaagaatctaaaaagatgatgaatacactcaaaaataataaaaattaacataaagataattttagattttttcataaactctattatataaactccaacaaaatttatgtagataattatcaaagtgaattacattatatttcttatttttttgtattataattttttaattcattttattgacataacaaaacataaattaaaattttcaaaaataaataacaatacaaaacaaattttaataataaaatgttaaagttaaacgtcaacgatcaattttggtggattttccagttttaaaaactcattttccatcattctctgattatttttagtttccagctcaaattttttaacattatttctattgactgattcttttcttgcatttctaatttccaaatccaaatttctttgattcgccaaagattggaatcgaattccatcattctctatctggttatcattctttaacctttttggaaacattttaatctttccgcgaataatatcatcgaatgttgaatcccaatccttatcccaatcctccaaaaattgcttttcattaataattcgaagtcttttactttctaatttcaattgctttaattgttcatttaatgaattgatttctttaatagttttaattctttcttcttcttctctcatatgatatagttgttgaatcgtttccattgtttgttttctttttgctttaagtttttcgatttcttccgattcttttctttgttttaatattttgctttgtaatttggtaagtttgtcttgatcagtttgtaacgaacgtaaaatcattgagttgtaattacatttaatgataggatatgagtctttattaagtggttgaaattgtttatgtgttaataatgttgttggacatttatttataatgttttgcgcttttttaataagttgtttggtgataatcgttcttttggttgaatgaaatgtatttggatcaataagaatttgattaatattgagttcaacccatgcaataacaagaaattcaataaattgtggtgatgaacagataataaaatccatgagttcaagccaatttgtattatataatagttcggaaaataaactcctatacaacggccagataataagcggattgttaagagaatctctaagtttgggattataatataagaatatcgtatcaattcgtgttaaaactttgggtggaggactacaaatatcggatatccattcagaaaatatgtttgtaagtatggtcattgaaacttcaaagcagaacaatagatcaccaccaaagctttgtgcaatttgttgaacaaaaaatggaagccaatcacagcctagaaggggcgcatgccaatggataagagcattggcaattgtaagtgtttttttcccaaatttttgttcatattgattttttgtttgttgaaattgaggacaattaacaagtgttttgaaggctttttcattgaaaggtaattgtaaaatttgtgaccaaagttctttcctgaaattattagggaaacaatgggattgattgagaactttttttagcttccttgaaggaatctcaactttagatccatttttattatagagatataatggtgtacattcaagctgatttaatgcacatttttcgttgaacattttcgcttaacgtacgaaattcaataaatacgtttatttttaaagacgtttattatttccgcataaacttatgaaaataatttgatggaaggatgaaattgtttcctgaaaaattcttcgaacacctcactaataagtcatataaaaaaagaagaattacaataacatccatttgatcattttaatcaaaaaacattatccggcaatagacaaatgatcataacatttttttgtaaaaataatcagtttttaatttaagcaacagcattttgaaattatcgaaaactcaacaaatagacataaaatttctggctgccagtaacaaaaatgtgatcgagtttcttgaagccgtcgggctttgatcgaccagttttgtgaaaaagcacagaaaattcaaagcagttttttatttttaatcgttgtcaaattgacggttgtccatttttcaaacagcttttgagaatacggcaaatcaatttgaatgcttcgtcgtaaaaacgctataaaattataatgctttacacttgtcaaaaagcaatttggaacggcaattgttgttgaaaaatcacttttcagacacaaatttagtgaatggaaaagttcgattcttctttttataatagcttaacaacaattttattaagttaacaaaattttttactatcggtcgggcgtttcgtgtgttgttgtgtacagatatatctgtatttacaaatgaaattaacaatattgaaatattaaacatgaaaatttatttgcattatttttttatttcgtaaatttaaggtagttaagggatacattaagcttaatttaattattgctttgatttgatcataaaatttgattacacagataagcttatctgcgttttaaaacaatttaagcttgccgtgttattatgttttgatttaagcaaaaagtttatgaaaaatggtgataaatcttgtttgaaaggtgaagccaaccgctgcgccaagccaaaggcaagctttttcaattaatcgttaacgaacgttcgttcaaaaatgtcacgaaacagttcaagcactcaaaattcagagcagctctcaaaaacttgattttttgtcactatcatgtttggactcttcctgatcctactcgcaagaccagccaatataaacaaaaaagaaagtaatctcgaacaagccctttttggccaagaaacagaactagaacgcttaacaaaatcaatgaaaaaattcaatctccaattactagctgatggcaacgaaggcggcgaagaaggcggcggcggcgacggcgacgaagaagaaggcggtggcggccagggcggcggcgaggaaattgaaacatcctcaagtgaatcttcatcagaatcctcaagtgagtcctcatcagaatcttcaagtgaatcttcatcagaatcctctagtgaatcttcatcagaatcctctagtgaatcttcatcagaatcctcaagtgaatcatctagtgaatcttcatcagaatcctcaagtgaatcatctagtgaatcttcatcagaatcctcaagtgaatcttcatcagaatcctcaagtgagtcctcatcagaatcctcaagtgaatcttcatcagaatcctcaagtgaatcttcatcagaatcctcaagtgaatcatctagtgaatcttcatcagaatcctcaagtgaatcttcatcagaatcctcaagtgaatcatctagtgaatcttcatcagaatcctcaagtgagtcctcatcagaatcctcaagtgaatcttcatcagaatcctcaagtgaatcttcatcagaatcctcaagtgaatcatctagtgaatcttcatcagaatcctcaagtgaatcttcatctgaatcatctagtgaatcttcatctgaatcctcaagtgaatcatctagtgaatcttcatcagaatcctcaagtgaatcttcatctgaatcttcatcagaatcctcaagtgaatcttcatcagaatcctcaagtgaatcatctagtgaatcttcatcagaatcctcaagtgaatcttcatcagaatcctcaagtgaatcttcatcagaatcctcaagtgaatcttcatctgaatcctcaagtgaatcatctagtgaatcttcatcagaatcctcaagtgaatcttcatctgaatcttcatcagaatcctcaagtgaatcatctagtgaatcttcatcagaatcctcaagtgaatcatctagtgaatcttcatcagaatcctcaagtgaatcttcatctgaatcttcatcagaatcctcaagtgagtcctcatcagaatcctcaagtgaatcttcatctgaatcatctagtgaatcttcatctgaatcctcaagtgaatcatctagtgaatcttcatcagaatcctcaagtgaatcttcatcagaatcctcaagtgaatcatctagtgaatcttcatcagaatcctcaagtgaatcttcatcagaatcctcaagtgaatcttcatcagaatcctcaagtgagtcctcatcagaatcctcaagtgaatcttcatcagaatcctcaagtgaatcttcatcagaatcctcaagtgaatcttcatctgaatcatctagtgaatcttcatctgaatcctcaagtgaatcatctagtgaatcttcatcagaatcctcaagtgaatcttcatcagaatcctcaagtgaatcatctagtgaatcttcatcagaatcctctagtgaatcttcatcagaatcctcaagtgaatcatctagtgaatcttcatcagaatcctcaagtgaatcttcatcagaatcctcaagtgaatcttcatcagaatcctcaagtgagtcctcatcagaatcctcaagtgaatcttcatcagaatcctcaagtgaatcttcatcagaatcctcaagtgaatcatctagtgaatcttcatcagaatcctcaagtgaatcttcatcagaatcctcaagtgaatcttcatcagaatcctcaagtgaatcatctagtgaatcttcatctgaatcatctagtgaatcctcaagtgaatcttcatcagaatcctcaagtgaatcatctagtgaatcttcatcagaatcctcaagtgaatcatctagtgaatcttcatcagaatcctctagtgaatcttcatcagaatcctcaagtgaatcatctagtgaatcttcatcagaatcctcaagtgaatcatctagtgaatcttcatcagaatcctctagtgaatcttcatctgaatcatctagtgaatcatctagtgaatcttcatcagaatcctctagtgaatcttcatctgaatcatctagtgaatcatctagtgaatcttcaagtgaatcagtatcagaatcttcatcagaatcatcatctgagtcctcatctgaatcagtatcagaatcatcaagtgaatcagtatctgaatcttctattgagtcatccagtgagcctgcatcagaatcatccgtcgaatcctcaaccgaatcttcatcttcagttcacaccactgaagaacactcttctgcagttacttctatagttactgagacaacagaagccactgaaggaacagagacacaagaaccagagcccgtcacaagcacagcagtttcatccgaacaagttccatcaacatcagaggaacccgcacaagaaagttctgttacaacagaggcagttgtcggcattgtaatcgccgctgttgtattagttgttgccattgttcttatccttgtatttacatgtaagaagccaaagaatccagaacctgactacttaaatcaatccgacgaagagaatattacattcatttaaacttactaaattccattgattcaataattttattattttttatcacactttgtccagacagatttcacttaacatttcacatcatttactgcttcggatagaagacgacgattccggtgcccgcgcgcagtttgtggttcatcagcaccgtgcggccgctgtttctgttgttggcggagtgcacccagaactcaaagatcttgaagtccccttcgtaacttgacggcatgtcccaatactggctgactttgctgagagaagtgggaacattttcaacaaggttcgagatgccaatgatcttctctttgaacgtctcaagcgcattcagcgaaacaagaacaagaccaaactccgtcttaacctcgttgatgttaagcgttttgtagacgagagagcgctgagagcatattggacctcggtaataatgtttattaaggtttaggtaggcaactcgatctgattcttccaaatcaatgttgaatttggtcgtgataacaaccgaatatggaagacatgactcaagagaaattggtgattcagtgactttgaaatgttctggtttaaaaaatggcacaagaagtgaaaatcgattaccaagtgcttcagcttccttaataaacgatgactctataacaagtgtacgccctgataagatggaataaagaatatgatggaagattcctgattctctaagatctaacatcttgaacttgcattcattgaattccttctctttgttaaggacgatagggaaagtgccaagggtcccaaacgtcaaaaatgggtccaatgtgtgttctttaccataagaaatggctgaactagagacatcactttggaaaagagagtgaatatgatcttcgagttcttgttcatgcgctttaagatctgtgatttgttcaagatctcgaagattattatcaatagtcgtgatttgttctggtgtaataccttcaaatgttttatcttcagacactgtggagcctgtgttaagggaatcaaaaattggtgaaatttcattcatgattgtgattatttgtggactttgttctttgtaggttctatgtaaataatgaagaacttccatacgatggacaatttcgcttttaaaaatgttaagtgccgtttgttgcatatttatgagaaaatctataaaataatttgtgtgatgtaagatttctctaattaacatagatatttggttagcaacaacaatgcataatgttctactaaatccacgtgcttcaatatctggtactgtacaataaaaagcaatataattataacttttatattttgattctataactgttggcttaggacaaactcgaggtatatctggaattgctgaaactgatattactgcccacataaaatcttcttcttgaatatcatttaaatttccaatatgccaatgtatcataggtttatgtccttgaagaaactcatatattgcagagtaatattcagatgatggagggtcatatgaagttataacttttggtgaagaagctgaagatttcattttgatcttcttcttaacgttcccaatatcgaatgaaaagtgacaacttttaggtaacagtaaattaccaatggcacaagttttcattacagaagaggaatataaaacagatatttatgatttatttaaattctttgctcttaagaatacaaccccagaagttattgatattcctgttttaaaaatgctttttgatgcattagacaaacctctatcccaagaacaaataaaaactttttggctcaattcaattaggagtggattagcaggagtaccttatcctgaatttgaaaaatattatctttcagtattcccttatgattcgtcagctttacttaaagaagcttttgatgtatttgataccaaaaaaacaggtaaaataacaattgatgacatgaaagatgttgttacaaaaattcgtggacaagttactaatgaagatcttgatcagtttattgaagttttcgataaatcagatgataaaacaatatcatttgaagaagtacaaaaatcattttgctagcaataaaaatttatttatccaaaaattgtatcgaaaatttttcccgaaatagatgatttccttggttgctctatacccgtttttattgggttaaatgtgacgctttctggtattgtttcgtttgtctgtatatattggcttttagttcttccaagaacacatgttacagccatattatttgaaattaattgtggtccattattaaaagttgaaacaactgtttttgcaatgtcaagtgaagcatatttaagataaatccaattacctggcgtgttatcaacgctgattatgtttccaaatcgtgaaaaaaaccgaagtacttcatttgtatgacctggaatcactccaataacagtaacccatgtaccaacatcagcattttctgtaactggttcgatacctttttgttgttggtatattgaagttgttggaatactggatttatttgcaaaagtaccttcagttaattgtggcgatacatttttatcttcttttggttttgctggagttgctgctgtttttggtctaaaaagtcttgtttctaagaatggttgttgattttcttgttctctcatttaagctacgaccaattaatcatagaatacattaacgtattccggagcaccttgtttacagacatgttatatgaaaaatcgtatttttcttttcacaatttagaaaaaaatatcaaataccaaacattttttatatataaatagttctatgttaatttactttgatttaaagaaaatttcatcatgacaaaagaagttaaaaacgaagctgcaacacctacagcaagtacagacattgcaaaaggaataatatacaccaaaattgttataaaaacttggaaacttcgaactttatgttcgaacaacataattctgatgcataaaaaagcaacaattatagctacaattagatgtactttaatatggtcttcgatccaagattttgttatttctttaatcctagataatgttcttattaaggaacatataccagaaaatgttatataaaccaaaaacgtcgaagcaaaagcatttaaatccggcacagtatcactaaagcacacattaaagaagtattcacaaagaggaaagaacaaaaaaatagaaaacaaaatttctaaaacaaataaaaattttgataaaacaggttctttcttttttgggacatttgatatttgtgatgaagcttcaacatcattttttattgttaaaaataatgctgcctttccaatagcttttgataatataaaagaaagaaagaaaaacaaaaaatcgaaaacaattgaatttgttgaaccgcctctatcggatccggataaaccaaagaaaaagttgatgaaatgaattggaaatatgtaaaaaacatcaactaaaagaattgctgtaatccacatttggaaaccggaaagaattttcaaaaagttatatattactgtaggcaaagctacagctaatacattaccaatgataagagatgtatataaatatttactacaattttcatttggctttttataataacaaataaataagaaagaagaaatacataaaattccaaaagaagttaatcgaattgtatatgaaaatgaatgtggaattctccaaatttcagaaatagatatagatggattagttacactggaattagtaagcgcattataagaaataatagcaacaattataattaaaaaaataaatgaaataatataaagaattaaatagtttttcttaattggaaattcttcgtttgcttgaatgctgttgttatgaattagatttaaatgaaaagaaaacacaatatgagaaccttctttgattggtttagggtcaaatgaagcaacagtaaaattgaattcattaaatattgtgattaaatatgtggaaaaatattgcaacgtaccgttttggattgtagaaaagtggactttttcccatctgttgttttgataaaaacgaagatacgaattttcctttgcaatggatttcatatgttctgcactttctttcaaaattaaataatcacaatgatgatattcatttgattttgttaaattaaatgggatcaattgctgcctttcaccaaagctataatatatttgatattcatgttgagagtcatattgttcatcacaataatgaattcctggaattttttgagaccaaaatggattatccactgtacttactgcgcctacaaaaactttatttgtggcattgtatattggctttcttatagaatataaaaaatgaaaaaagatgcacacaaacataaaaaggtctcatgaaattcagaatgtctgttcgaagttcaaagcatagttaaaagtaaaataatgaaaaatagaaagtatcatatcaatcatgaatcttaggccttaactaaatacaacctgcaagaattaaagaaggctcttttaatcataaatcttttggtttcttttaagtaatttaacaattgttatgattcttatttttatataataattgattatttatctcaattgcatcattattttgtaatgcaaaaaaatccaaaaaataaaatttagaaaatacaaacatatttattggaatttcaaaggttgtcctctgttatttttccatatttttatctgtttcatcaagaatatggctaaaaagaacccagccatcaacggtaacacggatagtaatccaattatcacaccctgttttatatcagattttatgtcactcgttttcccgtcgagagtatttaagtaatatccgacttttatgttcgggtcaaacaattgatttttgcaataacgcccaaatagcgactggccaacaaatgacactttgtttccagcaattaaatttgcttgttctgttgtacacaaactataaacacggatctcagacccttcgtcagcgtttaaaagcctttcacccgaactacatcccattatagcgcattgaagaaaatcaacacttgagtttgtcttttcaacacataatattgagccatatgattctgctacagcaagtaaaaaataacactgttcaattttggtattttctattccagttaataggatacaagttttagatgcagcataaacagttttcatgtcacaattccgtatcgttccataaccgccatcaagacaaaaaccgccgttttgactttgagctgatgtgaaagaaacattaagatagttgatagatgcaaaacatttggatttcttgatgaaacatccatgatttatagactctagtttggcaaaatctgtctgagaaatatcaaaaacggaagaatcttcattatatattgcaccaccagtttttgcatatccttgctcaaatgtcgagtgaataactgtaatgtttcctttgcagtagatagatccaccttttttacctgtgttttgaaaaaataaactatgcttaatatcaagatctgaaagtgaataaatagctccacctttaagatcataattaagacacatcttaaatgtacagtctgtgatttttgcaggaccgacataaatattagtagatcgtgaaacaattgtatcattaaaaaaatttgctttttctaaaataactgctgagcaagaaaacatttggaaagtactttggtataaattgagtttaagtctgtctgttgaaaaaattgctggtcctaaagattttgaaaaaagtgatttttttaagtctaaagaacccaaggaagaagaaaatgaaaatacggctgacatgggttgattaagattggttagtaccaagtgcagcaccgtaatattcattttcttaagatatgaaatgtgatgtgaaatatatatcaattcaaaacaaacaaatgaatttatgcttcagtaacacattaaatcaacaataagcaaaagcaaaataaaatatcaaatatcagttaaaaacaaatgtttattttgtttttgatagtgattgaactctatctataaagtttctatattgctgatctaggttctgttttggcctaaattcgagaaattctttcgataccacacttcctaaaatttttgaaacagatgcatttccaattaatttggtgtatacttcgatgattgacttggaaaggtgaatatcataatcctcgttaagatccatgagagcattgttcaatatttccaaaacaatttttgtctgttgttgattatttgcaataattgagtatccttcatcaatagaaatcaaacattttaagatatatgcagctgcaattcgaattactccattccattgtgctaatgtatttagacatattggcaaaaattcgcttttaattaatgaggaaattatttcagattgctttcctttaacaagacctgcaaaaacaccaatggtagcaccaataaagcgttctgcatcggcgttattggagtttaacttgaaaaatggaaataaataagttggaattcctgataaaacaaatggaagtttggtatcggaattacttgcaacaagttggaaaagtaaaatattattgtaaacattgtttgcatttggaacgttagtttcaccacttgctaaatttggataaaaatttaagatatcagaaagaagtgaaacaacagtcccaggagaaaaccatatcattaaagcaaggtctttaatatttgcgcgtttggcaagtagactttttactgcttgtgagcgagtattttcagaattaatttgtttaatttctgaaacaatctgatcttgactaaaagcttgctgttgagcttgttgaacaactggagtagattgtggtcgcttgatgtttgaagcaatctttgggtagctcattgtgccactttttacataagaattaacgtttttcttgtcagaaagtgacattatatgattcttgtaaaaaacttagttccaaatgcttacgtattaaaaacaacccttacaaataggtgaataaatcaggttagtacaaatacacgagttacccaatgaactgataattatcaaccactatattgctttattactgatcaaattgtcggatgaaaatcatggaaaaaatcaatcaaaaattttaacattaacattgtttacatattgtttataaagattgatttaattgatgaaaacgaagctataaattcaaagaaataacaaaaaaacacacacgccaaaacgacacactaattaaacaattcaaacatgatagaacaacctgccataagtgataatttttttataataataataatttaatatttaccaaacaaaatatttatttttctttttgtaaaaaatggttttggcaaaaaagggaatcttttatatttttttaatttgtttttgacaatcttactaagcgatttaacatggtttaatgttcgctttttttggggcacccctatgtttccggtttgtcccggacatttcatccgtgacaaacctctcaaaaattcttccattaacactttgtttttcttttattattatttattaaaagatgaccaaaaaagtttattcttcaccaataatataaagatttaataaaaaaggaattaaataaaaatataatttttctaaaaattattttaattcacatctaattctggggtaatttcgattcatttcgatattaaatatttttcgtctttcaaatttgtcagtattcaaaattgaacgaaaagttgacttcacttatttatgagcgctcctcaaagaacaggacttctcgaccgtggatgggaagaaacccaaatcaaggttttcacccgttggtgccaaaagtacttatcacaacagaaaattgagttcaatgatatcagaactgatttcagagatggtgtcaagttactccaacttttacaaatcatcggtaaagacccacttccaggcaagtggcatcaagttgtcaagaacaggtatcatcaactcgaaaacgttcaacttgctatcaaatacatcacagaagttaaagaaatcaaacttgtcggtattcacccagaagaaattgttgatggaaacttaaagatcactcttggtcttgcctggtcctgcatcaacaagttccaaatcgaagatatctctgttgaagaaaagacagcccgtgatgcccttcttatctggtgccaaaagaacacacgtgattatgatattagcatcaccaacttcaccacctcatggtcatcaggtcttgcattctgtgcacttatcaaccacttcagaccaaacgaacttgattacgatgctcttaacaaggatgatcatatggctaacgttacagctgccttcgatgcatgccgtcgtattggattaactgtcttcctcgatccagaagatcttgttggctgtgtaccagatgacaaatctgttgttacacaagtttctgaattcttccacttctttgcttctgaatccaagatcacagctatggctgataagatcaagtccacactcaagaaccaaaagcaaattgatgaaatgtcaaacctttatgaacaacaagcacaagcagctcttgatgccatggccaaggaaaaggaatccatcgaatccgatgaatatgaaagaacagttccaggagttcgtgccaagcttggtgatgttatcaagtatgcacatacagcacgtccacaaatcattgaacttcgtggtacagcacttcgtacatgggcatccattgttaccaagtgtaagccaatctcacgtaaggttccagttccaccagaaggcaaagaaccagagacattaaatgccaaattcgaagaattagaaaacgttcaagctaagcgccgtgcagaacttcaagaaatcttgaagcaaatcgaaaaggaaaaggttgactcattcgatcaaatgtgccaagaaatccttaacaaagttgacgaaatcaaccaacgttctaactcacttgaaggcacaattgaagaacaacatgatgtcatcaatggccttattgcagaagcagaagagaagcaaagccatcttccagaattacaaccaccatacaatgaattgatccaattaaacttgaacaacagatccaagttcacaccatatgccatccaaaaggaagtcgatcaattaattgttcaccttaagcatcttttagatcaaaacaaggccgctgcccttcaagcagataatgaacgccgtatcagagaatataatgataaggcacaaaagtatatcgatgtcgcacaagatatcgaaaaggaactcgattcaatcgaaggttcacttccagaacgtcgtgctgcattcatcaagcaacaatccgaaattgctgaaaagcgtgaaaaggttaatgaaatcgatccagatttcgaagacctcgaaaaggatggtttacatcttggtatctccaacacaccagaatacatcaagacacaatacggcaactcactcaagcgtgccatcacagaaactaacaagatcttcgatgaaatggtcaacgaatatgatgcattagccggcaagatcacagaacgtgttcgtgacttaactaaccaagcagaagctgtcaagcaaccagaaaaggttctcgagacacaaaaggcagaatacgaagaactccaaggaaaggctgctgaagttgaagccgaattaccaacacttgatcacccatacagtgaaattgttgaattcaaactcgccgcacgtatcaagacaacaccatcagaagccgcttcacaagttgcccaacttaagaacttacttgataagttacttgaagataacgcagctgctattgttaagcgtgaaaacgaacgccgtatcaaggaatataatgaattggcacaaacatatgttgacaagtcacgtgacttcgctgctacagtcgatgctatcgatggaacacttgttgaacgtcgtacagcatatcttcaaaagcaaaaggaactcaacgagaagcgtgatgacctcgacaacttaacaccacactaccaagcattagaaaaggatggtttacacatgaacatcaacaacacaccaatttcaatctcatcattctatgcacaagttcttgagaagatcacaaacgcattgaacttaatctatgatgaaatggttaagaacttcgatgaaatggcaacagctcttaacgaacgtatcaagaaggtcgaagccgaacataaggctatcgatggcacactccaagagaagaaggagaaacttgccgcagaacttacagaagcacaaggcattcatgacgatgttccacaactcaacgaaccatttgcagaattaacagagttcaagctcaactatcgtcccaagttcacaccaattgatatccaaggttacatcgatcaattgattgctaacatcaaccacgttaaccaaatcaacgacagcgaaatccaagcagaaagcaacaaggcacgtatcgataactacattggcaaagcacaagctgttgtcgacgaagctaaagaactcgaagcatcaatcaacgaaattgatggcactaacgaagagaagcttgagaagctttatgctaaggataaggaagtcaacgagaagcaaaagaagatcgacgagatcacaccaatctaccaagaccttgaaaaggatgacttacaccttaacatcgaaaacacaccatcatcaatcttagcattcttcgataacatgcacgcacacatccacaacttgatccaagaagtggataaggccattgccacagctaagggtctcgaaatctcagaagaacaacttcaagagttcagagatacattctcattcttcgataaggataacactaagtcactcgaaccatacgaacttaaggcttgtctcacagcactcggtgaaaacgtcgaagatgaagaatgcaacgaaatcatcaagaagtacacaggcggtaacacatctatggacttcgataactacgttaagttcatgctcgatagattcactaagcaagaaacagccgaaactactaaggacgcattcaaggcagtcaccaagaacgcacctgttatgactgaggaattaatgaaccaacacttcaccccagaagatgtcgaatacatgaaggctaacatgccacaaactgaagacggatatgactactcacaatgggcagattcagttttcgttgagtaaaaaataagtccaattgatcatatatgattttttttaattagttttttaacaggtacaaaccaaattgcaatgctacgatgacgattgaattaactttgagtgcagcggagtcacttcactttgtcgcattctattcacaggatcaaactgtggcgattattcgcttgctttaaaacaaatttaatgctcatgatcaattcaatcagtgcattacatgttattatatataatgcaaaattaatgttgtcggaaaataaacttaatctcattcagccaaaatatttaaagaggaaataattaacattttcaaaaatattagtaaggagaatgaatgttttattgatgtttcatcgtttttaataatggttttgattaaaaatataattagtttaaaaaaatattttattttaaatatttatcctaaaaataaatgcaaacaaggaatccttatatttgcatttgtttcattttttaatcagacatttgaattttttgacgaaacaacaaaaacacttacaatcacaaattctaatgacttcaatactaaacatagttcagcagaacatgccattaatgaaggtaaaattgctaatattccacaatcagcattttataactacaattcattaatttcagtgaatgttacgagtgaacttaaattgattggtatgcaagcattttttaattgtataaatttaaagtcaattgttttttcataaatagtttagaaaatattgaaaattatgcattttataattgttatttattagaatcatttatttttggtgaaaatgttaaaacaattggtaattcagcatttgaaagatgtatgtcattagttaacatcacaattccatcatcaattacaagtattaaaacaagtgcatttggttcatgtttgaatttagaaattattaatgtttccaaagggaattcgtattattgtaattcaaataattgtcaagttttatatgacataaacctcactgaaatttattgattttcgccaaaaatactgaatgaaacatttaatattccaaacacagttgaaaccattaaatccaattcattttcttattgtttattttgttatattaatattccaaattctgttatatcgattgagtcgaattcatttttatcaagtccaaatcttgaaagtgttatatttggagaaaatgtttaaacaattatgaactgtgcatttcaaaattgtactaaattaaagaatgttactctaccgaaatcagtttcattgttaattaattcatattatgcactagtcttcaatttattaatatatcaatagaaaatgcattttattcaaattatggaaatgatggtattgtttataacaaagaaatcaccgaaattatatgttatccgccagggaaacaagaaataacatatacaataccatcaactgtaacatctattggaaattattcattttattcatgttcatcattaacgaatattcaactcacaaataatattcaaacaattggccgtaatgcattttatttatgttcatcattaacgaatatcacatttccattatcaattacaataattagcagttatgcatttgcgaattgtaattcacttgaaacagttattataggggaaaatgttcaataaattcagaattatgcatttttctcttgtacaaatttgctatgtgtttattattatgggacaaataaaccatcatttggtacatacgttttcgatggaactaatttttccgcagttatgacattagattcatattcaagtgatgaatttaattcatctgaagttttgaatggtacaagtatttttattacgttagaaaacatattcactaaaacaataaaatttattgttgaaaatgataactcaataaatttccaagttataataagtcaaacatttgaattaaaagaaaacgaaattaaacaaatcgaaattcgttataacccaacaactataggtaaaaacgaaatcgcaaatattaaatcagacgaacttggccaatatctttataaagttattggcataggtaaaccaccgccaatacaattgccattaacaatcgaaacaagtataaataaaacttcaattggtataatcgaatttataaatccgttttattttcccgcacaattttctataactttaaataatgaaaaagctaatcaaaatgtttttaatttattatcacggaaaaaattctctttaactaattatggagatacaaatgaaatacaaatttcatttttgccacgttttaatggcgaatttaaatcgaatattattataacatataatgatattcaatgggtgtatccgataattggaatttgtaattcattaaatacgaaagatcaaaaaattatttatggaatgagttatcagaagatacaaaaagaaatttctttatttttaataggcgaaaaagaaaattataaaatttcggaatataaaattattgttcaatatcaaaaaggatttgaatttgtttcgaaatatttaaacatatttccgattaatataataaaaaatgaaaataataacaaatatataaatcttcaaattaaatattatccaaaacgtccaatgaatacattcttaataataatcattaaaaaccctttagaacaaagttggaaatttaatgtgaaacttcaaatagaaagttctgagccattacaaaatataattttggaatgttcgctcgataaaataataaaatataaacctaaaatcgttgatgagttcgatgagaaaactccttttcatgcttacctagtaaatggttcttcatctgagttctctatttcgagttcgaaaggttttatcgaaccttttgttgatgaaatgccttttgatgttttgtttagcccgaaaatttatggtaaagtaatgaaggcacaattaattatcgatactttagaagtgcaatttaaatatgacttaatcgggagaattcctaaatatatgccgccaaaggtttgcggtggaagaattgatttgtctacgccggaatctctgaaaagaaataatgcggtgaaaagaaatatcgttaaggaaaatatagaaaatgcaaagatttcaataccaaaaactgctagatcaccaagaaaaaaatatttttatgcataaatatttgtttttattataaatttgaatgtttgttttcattatttagataaaagccttgatttaatacaaaatgacattaaaataaatttagtatctgttaaagttgaaaatgatttgacacaaggatgaattactcatcagaaatgtgatatacaatgatttaggagtaaaatatgtgatattaattaatattacaacgaattgtaatattggtaattaagaaatggacaagaattaatataatgaacattttcaccaataaaaattgtttcaaaatcattacaataagcaaaagtattattcataatagaaattcaattaggaattgtaaatgttttacttttctcattcggataactaatgattcgtgaatttctttagcatataaaatgccatcattttcataatttgaatattcaaatttttttctaaagttcttgtttcaagtactgtacatttgtaaaatgcattatcaccaatgccattaaaactgtgagtgtttttgtctctgcttcatatgattgctttgtgttaacaaaaaatataatcatcaatatcaaaaatgttttgaatttttatcataaattaaataacttttataaaaatatttaataaaaaaaaaataaggtgaagcatacttgaatccccaaaaattacatgatcataacaaaaattcccgagttttgtttactgggttttgctaataaaaactttttgtatacatatttggtcaatttataaaaacacatccaaactaacgcaataaatatttttaatttttttcaacatcataatgattaccatactttgtgttttttattttctatatcatagcttatattttcaaacaagacaaatgttatagttcatgatatatgcatatatcatcaattttatttttctactccgcatctctagttaataaaaaatgattcttgtaggtgatatgtatatggctatttttaaaaaatcttaaagaataaattttgtgattccttttttatcaaatgatttgtcactttttatcaaattcatgaaaaacaaagggaaaaaaacccaacaaatacaaaaattgaagacgagttaaaaaagctttcatttattaagcaaaaaattattgatttaaagaaagaaaattttaccaaatcattaaattcattaatcaacaaatttaacaaaaacatgccattactttttaacacttttataagtcaaattatatattcattatgtgttataagaattaatgattttgatattgaaatatatttaaatttaattaaaggaattgaagcttttgaaatacattccagaaatttttaatgtgttttcacaatttcttcatgaaaaaaatacacaagaatcgaattactttcttgaatatatgtttgaatattattttcataaaaattacaaagcactaccaaagaataatccggaacttcataagcaattaattagagaaggtcataatccaaaagaaattgcaaaaataattcgaaatgatgatatagaaaaacttcaagaaatatcatctcaaaatgattttgattttgatcaaacaatagaaccatcatattatgaaagatgttcattttttaatcaaaagaatgtgacattaattgattatgcagcatttttttcttcagttaaatgttttaaatatttattaatgattaatgcaaatgtagaaaacacaggtaaatatgcagttgcaggtggaaatgaagaaattattcatttatgtgaacaaaatcattcatcatttaaagatgcatatgaaacagcaattatgtttaatcgaaatgatatctttaaatatttttatgaaaataaaattgataataatttaaaggaattaggaatgaaatgtatttgtaataataattatgatattttttcatttttgtttgaaaatagacttaagtttggggatgttatttctaaaatagtacaaactgagaaattatattttttatatctttttcacccaaatcgcttgcctcataatattttgtttttatgtatgaatgtccgaaatattgagataataaaatatattctaaagtataatattaatgtcaattatagagaaatttgtttttataatttcatatttaaaaataatacttggtaattatttatattatttttgactgcacttctattggcttcttataatggtaatacagatatggttaaattacttcttgaacattaagatattgatgtaaatgctaaattttcattttaatatatctaacattagattaaatgatatttcatttttagatgtaatttttctcaaattctttttatcatatttatttacttcttcaaatgtatatgccattaatgatgaatcttcagataatattgaatattccaaacattcattccaatttttttggtttagtagaattggtacacatcttgatttagtagaacataaatcaagtaatttaaatgctatttcttctttttgtattaaaaatgcagtcatagctaaacctatcaagtcaatttgcccttccatttctaataatttctcatttatttctttgggcgataattttgttctgattaaacaatttgcccaatgcgcagaaataaaacttgtatcaattcccataaaattggcaattcgaagtgcttcgaaatgtaatgaacgattacaatgtctttttaataaatttgggattgttaatgtttttaattctgcataagttataagaatattaaatggttgatgattcattatttcacatatgcgtaaaattgaaatttgttctgcaaattgatcaaaattacgtaattgaataagcttttcactttcttcagatccatcatctttaggtatgggaataattaaatgtaaccttgatatagctaaaagtaatgattgcctttgtttaaacttagtgaagaataaagtagcatcatttaaaccaattaaaccttcttcaatttcatcaattgaaaaatcattaaaaggttcatttgtagctaaataatcaatattattcatacatttaaacaattttaatgcaatacattcttcattccatgaaccaaaatcaaaagttataccaataaaagctctaagtaaaaaaataccttcttttgtaaaaatacgtgcaccatctatttcggtaattatagcaaaatctgatttcatttcccaataaagtgcacgatcagaattacctaacatccaaattttattattttttattagtaaaacagtatcgttaccacaccaaattatctttttcgggataacttcatcaaaatgaatatgaatttttacatcatttagatttttccccagaaagaaataatttgtatctgatctaattaaagcaaattcaagtgaaggagaaaatattatttcatcaacaggatattgaaagaactcagtttcaaatgatttttgcaataatttttcaaattataatttaatttgaataatttcttaattttttcttttcttttatgtgattgatagattgtacatcgcaaactaatatacaatttcagataaactttctgatgcattcagatgctcatcgatgtttaacaccgatagaatcggccatactcagtcaaatctcatcgtgttttgaatactttattcttctttattctgttgaattttgtcaacttttgtgaaaaggtaaatcacacggccatgtcgattcttgagtccttgatcaaaaaatacaaagtaataacaggtgtatatttcctctcaaagccagaacgaagagtttggaatatatttttcctcgttcttttcatcgttttcattttcggcttaataaatttatcaaaaggaacaatgcattctttccaaaggctacttggtttcgggttagaacctcaaaatcctgttaacggcgattcatatcattagctttattatctatcgaattagcaatcaataaactttgattctatcaagcatttacttttctatagcacacaaaacttatgcacccatttaaaattaaaagatatcttatttaaataataaatgtagtgtacttatcataatacaatgttttttataaaaaattgtctcagatattaataacatttattcatatggtgaaaaatacgaaccatcagagtaagcaatcttcgttttttggtcatgagctctttttgcttcttttcttctcaaagatgttaaaaattttgatgtattctctaagttagacattcgaatatcttgcacgtcccttagcttccttctcatttcttcaaggtagaaaggtccagtgttaggacgttcaataggatgatatgaatattcatttggaagtgaaataggttggaaagaagaagaccatttcgcttgagatgctgttgataacaaaatttgattgttttgatctgtcatttgtcggatagaatcaagatcatttcttatttcgcgaagtgactgatattgtttagaaatatcatagttctttgtagttgtctcagatgatgataggtagtattttaaatcattcacatatccggaaattgtttctatttttgataagtcgttttcaccatcattttcaaagatatttgatcgttcattctcaatttcatcaaatttttgtttgattttttcggtttcttctttttggctttctcttttgcactcgagttcaatttgcgcatataaacattggcgtgctcttgcactgttctttttagttgattcttttaatttgtttcttattttattgagttcattaaattgatttgataatgtttcgtgagttaattgagtctgaatactttgcgtacaagaacggatatcttctttaaggcaattgatctttttgattttgtcttctgaattattagttttaattgtttcgattcgattgaagagatcacgaaatttcatgccaaaaggatcaatggtatcaacagctaactgcgaaaatttattttgatcagttgtaaaaataatttcatctcttatcatctgccttattgattctataaacgaataaataatctcatctattgaggaattatcttggagtgaatttttaattgtattcgtaaaatcatttgatactaaatttaatttatgctgaagatattcaataatatttctttcaatagaagactgcaaactaaaatcatctttgtgattatttgattgaatattttgtgaaattgtggtttgaatttgattcacatcagaatcttcatctatttctttgggaatagcttcagaaaaatcactttcatcaagaagtgcatcaatatttaatggctttctttgcggtgtcctacctcgagattggggtaatttcttttttttctttttcttttcagtttttggccttggctttgactcggccatgccttcatcaaacagaccaagatctttcagtcctgcaataaagtcactatcaacttctgaatccattttggatccaaaatcagttagaatttaatttctgaagctcatagaaaacattgaatacatataattatttactatttttatccttaaaaaacaagaacacttcttaatttacatttattctggaatgtaattcatattttatttatgtaggcatgttttccatacattattacaatattaagcgttttgaggataaaacaaatcgttcaacacatttctttcatcatcttcattttcgtcaagccactctctaaatgaactattgtcaagtgcgtgttgtatcatttcatcacgagcaccttcatcaacttcgttaagcaatctttcaaatgcgtttacaatcattttcgtatcgcccaaagaaggaaaatcgaataaataaacaaaaatttctttttggtttaacatttcgaaaatgtccaaagaagactttaagtaaaatataattattaacttaattatttgactttttactgagtatactccttcatcgaacttagatataagtgagaaaaacatattaatgataaactcttcgttaatataaaatggtaattcgtaaataatattattaaatatttcgattgcatttgtaaatcgctttgattcaatcgatgtgtttataaaaatataattaataaagtcaaatgttccaatatcaacaaaatactgaatttgatttttagcattttcgataatgaattgtaacaattgaattatttgtttttgaagttttttatttttatcataaagatgaaagaaacaaactaaaaaattattttccacataaaaatttaaatacatttcattaactaaaatacattcatatgaaagttgaaaaagatcacagatttcatcaggatcaactggaataattcgaaataataatggaatgatttcaataaattcttcatcaaaccgatttaagcgtttcacaattgaacatgcaagtttcgttatgcgattataaatttcgaaatcatttgtttgtaaaatgccagccactttttgaatgtatggggattcaatgaatttgagaccaagatgttcggccgatagaactaaaagtcgcgttaatttaattgatggatgcgaagggaaagtctcaatgcaaaattgaaacaaaccttgttccatcgaaaaatcagccatttctgatgggtatgataatattcgataaagtaagcgaaaacatgttttggaaatgtcatacttgtctgagaaagaattctttataaccataataataaaatcttgtggaaataaaacttgaaaatcatcaaggatactacttaagtctgctgctgatttaagaatatcgctggatttagaactattcataaataattgataatttaaattaacccttttcaaaagatcttcatctgttagactttgggattgtgtgttcttccatttttcttttttcattaaaattttaagttccaatttgtatccagggttcatgtcggtgcaatgctgccataaaaaattataataaatatttttggcaatatttttttcactcaaatttcctgtgttaaagattcgaaaattgaatctgatatataaataaaattttacaaatttgaactccgatatcgttcatcggttaggatatgtggttttcatccacgggagcggggttcgactccccgtatcggaataaattttttcatgattattttttacaaaatttttacattgtctgagtaaaaataattttgggaaaaaatctttaatcatcaatgttggataaacatactccaacttagaacaaagagtaatactttgaactcagttgatattgacataatgttaatcatgattttcatttcattttaataatgttcttagaagaagaaagaaattcatagagtacagtttaattcaaataaatggaatttattgatatttatcaagtattcagtgagcgaaaaaaaaattggattcaacagaaatgtgatataaaataatcaatgtccaaatttttatccagaggaaacaaggaattttcaaatgaaaatttttccaaagcaattgagtactatgatctttcttcaaagaaaggtaataagcccagaatattatctgattctcttttaaatcaatcaatttcagcttcttttttagatcttccaaaattagcaagaaactactttgcagaagcacttgaagttcctgttcgaaatgaagctattcaaacatcacaaaaagaaatgaatgaagttccaataagacaaatttcacaatctttttcagacgatgatcttggtttttttgaagaaattgaagaatcctctttttttaagaatataaattcagtcaatgattcttttgatattgatagatggtcaccaacaattttttccaaaaggtgtttcatttattctcaaatcggtgattacaaaaatgcacatcaagaagcacagatcatgactactgttgatccaatgtctcctattttttgggaaatccgagctgaatgtgcatggctcattaaggacataaaatcccttgaggaatcggtaaagaactgcaaaaaattgggagcgagtccaaaccttcatatggccaagtattattggcttaaaaaagaatatgatcttgctgataaatacctaaatgcagcagtagaaaatcatgaaagtgcagctgtagttaaccgctccaagttcaatcttttaaggggacgcgtaatgagtgttgtaaaagatactccaaattcaccaatatcaatcttcactcaaaaaatcttaccaacaaaggtcaacctccaaattctcagccaatgtccttttcttaattatgttctatattcgttttatcgttctttctctgttcctttatcctctcttaaaccctcaatgttcatagaaattccagtacaaaaagcttgggtccatggaactccaacactgtcacagccttctcttaattcttctgtcgaagacattcctcaatgtttttgcctaaagatcaaagatatggagaccgttaagcacattcacgaaagcggccgtttattcggccgtttaattgataaggattcaattaatgaaagagcaacaatatgttatggacttgcgaccttagaagtatcaaaatgtatttccagttatcttaatagcacagataaaccaagtaatattcccgggttttctaatgtcattacaattataatgaattggttacgtcttattgaccctacaattcctgttttcataagaaaccaaattgtgaatactccgttatatattcatgtacaaaaaaaaggaatttcaactgaactttattcttataatcaacgtttatttgagaagcttaaaaatggaatatctcactctacctcaaaggaaatttatgttcatatctcctctgctcaaactatcgatgaactttggagtatttttaagtcagatattaaatatccaattcccaattcacctgcatcaattttcttatcttcacataacaacactttagactttgggcttgttgtcgaagaaggaaatgaaagtagaatacatgcaaatgatgaagttataactttatggtataatctaatgaacacagcgcgtgctggaaaagttggacaaaatgtatttgagttcatacgtacctggatgagagcttcaccacttacgaattactctcatgttgcaggttccattttgctttttgcacttttgcattcaatttttggggtaaccccagaagagaacgttatgaaaccgtttgatttgcaaatcgaagcacttctttcccaaaatttagagaagtttatcgaatatttaaagggaaatgatatgaagcttcatgttgatagttcagttgatcagaatttacctgatatagcaaaattaatgccaaatcttcacatgagaattcaaatgctacttgatatcccagaacactctcagacaaataatgagaacgaaaccaatgaagaaaaagaaaatagttaacaatcttaagatcacgaaaaattacaaattttctaaatcgaagaaaattaatccaaaacttgaatgcaattcattcatgtttacatttcctttattttgaaccgtatcatatttgtaaataatatcttattaataagaacaattattttttgagaaacaaagtttattctttgaagtcactttcaaaacgagaaaaagttcggtccattgttttgaggaggtcctgaagttgaagcacttaaatggttctgattattattttggaagttattaaacgttcccctttgaggtgtactttttgctaaatttctgaaatccgagtaagggtcataagggttcggttggttatccagttgcaaaggcatttgatttggctgttgtaaagttgtgaaaggcatatttgaattttgaggggggcctccaaacgtattttggttgaaagggtcgaactgatttgattggtttatatttgatgttgttggctggaacacatcgaagttattattcggaggacttccaaacgattggaatgtgttttgctgctggtttgaggaactacggaacatgtcatatgatacttgttgtgacttattgtcttgtttcggtggcgatgaagtttgctgattaaataattcgagcgatattatgttactgttgtcttgcttaggctttggcgtgcttggctcgaacagctcaatctttgctttgctgtcttgcgctgtggctggcgatggcgatgtctcaaataagtcaatgattatgttatcttgctgcggcttggacgcactcggcttgtcaaagagctcaaactgcgacttgttgtcctgcttgggtggctctgccttaacttgtttgctctgttcgaagatgtcgaattgcgaattgtctttcttagcttgttctggctttggtttgttctgttcgaatatctcaaatgacgccttgttgtcctgctttggaggctccgctttcttttgcttattctgttcgaatatttcgaatgaagctttgttgtcctgctttggaggctctgtctgcttcgctttattctgttcgaagatttcgaactgtgaattatctttcttagcttgttctgtttgcttttgcttgttctgctcaaatatctcaaattgcgaattatcctttttagcttgctctgcctttggtttgttctgttcgaatatttcgaatgaagctttgttgtcctgtttaggtggctccgctttcttttgcttattctgttcgaatatttcgaatgaagctttgttgtcctgctttggaggctctgtctgcttcgctttattctgttcgaagatttcgaattgcgaattatctttcttagtttgttctgtttgcttttgtttgttctgctcaaatatctcaaattgcgaattgtctttcttagtttgctctgtttgcttcgctttattctgttcgaagatttcgaattgcgaattgtcttccttttgtttctgcgcttcttgcttcttctcttccactttttcttctttgttttctttcgttactttttcttctttcggtttcggcttctcctgtctaaatgggtcagcgaatgcaaactggtcttccttcggctgcttgcgcgctggctgcgtgaactgatcgaatgtgtttgatattggcgatgaagggccaaacgcattcatttggttattactaaatgaaccgattggactgccgaacggatcgccgctcatcatttgattattactgctgaatgagccgatgcttgggctttggctattagcgaacggatcgctcatatttggagtgtcgaatgagccgatgctttgcgattggttattgttattaaatgaactcgtgcttgcgctttggctattagtagcgaatggatcagtgattggcggagtgtcgaatgatccaacagttggcgattcattcattgattgattactattcatatttgaagtatcgaatgatttaatgtttgcgttttggttattattaaatgaatcatttgcagtttgtttattatcatttgattctgttgaagttggatgtgaattattgaataattcgaatgaatttgacttgtaatctgattcattttgtgcaaatgaacttgattcagttattgtattattttgattattttgcttaaatatatcgaaaggatttacatcgcctttatttactactaaagactttgatttattaattgttttgttttgttcatttttattaaatatttcgaattgatctgatttatcttctgatgtaatcttttgttcaacgaatgaattagaagttgaaattttattttgttcatttttattaaatatttcgaattgatctgatttatcttctgatgtaatcttttgttcaacaaatgaattagaagttgaaattttattttgttcattttgtttaaatatttcaaattgatctgttgttatatcatttttattactttttgcataagaacttgatctattaactgatttattttgttcattttgtttaaatatttcaaatgaattcgattctgattcatcatttttatcattaacaaatgaatttgatttattaattgttttttgttgttcattttgttgaaatatttcgaatgaatttgaacttgagtttttattacttgcaacaaatgaattcgatttgttaataaatcctttattttgattattatttggtttaaatggatccgaaatatttttattagatttaaatggatcaggaaatgtttgattatcattagcaaatgaatcagatacatttgcattggatttaaatggatcaacaaatgatttattagcgaaaggatcagggaaattagcattagcaaatggatcagggaaattattattactattattagcaaatggatcaggtaaattagtattattcgattgatatggatcagttgagttataatttgattggaatggatcaatgaatgtaagattttcttgtttaaatggatcgacgtaattacgattaaattgttcgaacaaatcgacattattattgttattattattaaatgtattattatcattttgttttataggtgaattatcaagttgattttgttctacaatagtaatattatcttgtttaaatgtatcagtaaatccaatattaaattgtacaaatggatcaatgatttgttgttgatcatttttattctgtttatcaaataaatcgaataatttgttttcactttcatttgattgtgatacatcactttgttgttgattcattgagttaaagaattcatttgtatcttgttcattttgatctaatgatttactacgtttatattcagtatcattaaattcattagaacttctttgtttaaataattcgaacggatcattttgttcattattaatagtattatctttaaattgatctgatttccttcgcttaaaactatcttcatcttttcgaacaatttctgttggtgttattggtggtttaactgttgatgttattggatgtttaacagtagaacttcgagctctaattttttgtttgttatataattcattttgatccaaatcacgtttaagggtttcattttgtgcaaataatttgttttcgatacttttttgttggttatcaataatttcattatttttaggagaagaatcaatttcaacagaaacttcttgtgatttataaatattttgttgttgttgttgttgttgtacaatttcttgtttaacaggtataggtttagttttaattttacgtacaactttcttaacaactttcggcttttgttgaatagtattatttttaattgattcaagcatatcttttaattgcatgaaagcggattctaattcttcttgtaaaggtataaatgtcggattatctaaaacccattttccatgaacttttaatcctttcttattaatctttatgaataaatcaaatgcattaattaatttttgtgtcattttatccttatttttaattttggatttatcagttaaaaatgtttgaatgattttagatggaccttcattaacagtagctaataaagatccatgtaaaatcctttggatttgtaaataatcctcactttctaatgacttttgtaataattcgattcttactttaatttgatgataagctacacgtataggttcataatcaattatatgaattccatctttttgaactgggaatcgttgtaatacatttggtaattcataatcagtatttaagataactcttcgtacccattgtgtagttaatgtaccatgagtttgatcagaatctttaacaaatggtgtatcgaaataaaattgtgtaattttattaatttctttgtttttataaggctcgacaaatgtaatttgtaaatataatttattcggttgaagtttttcttgattcataaataagttctcagtaattaattcaactttatcattaccataaagttctttatatatcgaaattaatgattctgagaattgatatacatgtgttaatcttttttctcgatatatataagttttaccattatcattattaaattcttctccataaaatgtaactctaaagaagcgatcagtattagcatcagtatcagaagatttaaaattagagatatctttaaataataaagaatatgtcgaaaatattttcgataattctaaataagatcgttcattctcaaataatggccaataaatatctaataatataattggtaatatatatgttaaacctttttgacataaatcaaagattttctcaagatttgataataaatgaaacttttggatttgttctgaatcaaataattcgattatatttaataccgatttaatagcttcattaggcattgctaaattattaactaatgaactacatttagaaaatgctaaacatggatgttctaattcgaaaatatttggtaaattaccattaaatgttaaatattctatgattatagcactttgtaatacaattgtaaatgctgattcaactggtttatctttcttttctaaataattcgataatgattttaatattatgatcatatcattaggtgaatatataaataaaaatgatctttctaataataattctgatttcgattcaattgtaagtttgttgttgtttaatagttttgtatttgttattaacttcttaaaaatatcacaaaagattaatatgtcatcttcatctgtatcattttgtattaattttgttaattctattaaattatttgatgataaattagaattcggtaataaaaataatatatgtgttaatactccatatattaaatatttatttttacaagtttcaaatatatcaaatatcacttgtttaatttcattcgaaaaactattattctctgataaatatattaaatatgtttgtaatatttctattaatgaacatttctttaaatataataaatctttaaatgatgatttaattatcatcgaaaatgtttcacacataacttttaatgtttcattattacatttaagatttaatatatcataatataattcaattgtattattaacattattattcgttgaattctttaaataattcttcataaaaactgataataaataatatgtttcattacatattgataaaaaatcaatttggatcggggtttgatcaaagtttaattctaaatcttttaattcttttaatgtatctgcatgattagacttacgtaatattaatgtatgtgatttcttacgaaagttttgtggtaatgtatccaatttcttttcaggtacattttctttcttttgattttcatttttattatattctttaataattctttgtaatattttccttaatattatatataaattcttctcttgtgaaacttcggtttctttatatgttataggatcagtattaaataatataaataatataaagaaaacttcacttaattggatatcattagcttggaaattatccggatttatagaatatattgaagattctaatgtagttgatatagttataagcatttctttaggataaaatctaaataattttaataatataataaatattttcggattaattttattttgatatgatttaataataatttctaaaacaattttttggaaatctacaaaatattttaatgaaaaatagaaaaacttcggttgaaatacttttgtaatgaaatgtgtcgaaattgcgttttcaaagaagttatcttgaaattgtttattttgatgttgaaatatttggaatgatatttcataataaccaacttcaaaaagataataaataaattccgataaatattccagtaaatttaattgttggttttcagtatttgttattaacttacaccaatttatcataaaattattaatttctttcaaatcgaaattcttttcatctgataaaattaataatttaataataagtctaaagaatcctctaatacaaaatattatagattttaatgaaccatttgaagattccaaaaaattatttaattttatcagaattttttgatggaaatctttatataattcataatcgccatgaaatgcaaaataatgtatatataataaaaagtatatttcaaattgtgatgacccaatgacaggaactaatatattttgtaatgatacaaataaatgaattacatttttcgttgttaagttattaattccattaattaatatatcaaagataaacattaaattatcaattaatattggaactggtatagtttctaataattgttgatcacctaaacttttaactattgtataaatcgctttaaatttctcaaagttttcatcagatgaaactaaattagatataatttccgtactaaatgttatcgacgctttcgattcttgattagtactttctaatattattggtgttgtatgtttaccatcacctagaaatgatttacttgaagagattttatatgtcgatttaccaattaaattaatttgatttaacttatgattaatattatatatagtaaaacataattgcattgtgtctttaattggatatggtaaattaatgataaaaatgtcttggaaatttggacttgtttcatcataccaacatgtagtataactataatttacatatttggaagaatcaaatttagattgaatacaatctaatgcctcatcattattacggatttcaaatttgataattaaacttttggatttaagttgatgactcttgtctgtaatggtttcaatcttaagtgccatttgatgaaataccgaaaaaaatggaaaatgatttgttaaatgtaaacgacgtaaaacattgaattcagtgttaacgttctccattgtgacggttattctgaattgtttcggttttttatgtgtgatttcttcaatataaaacgtgacaaattcttccttaagtggcttttggaataaagatggatttggaaatgtgattttggaatcttttcgaagtaaagatgaaaattcatgttctgttattgcaaatatactaaaagcatctttatgcgcttctgttgatttagataatttggcttgagctatcttcttgtttttttctgtgctatcaagataatatttaatgacattttccccattatgtattgatgttggatgacaaaaagcaattatcatactgacattatttgttacagatgctggatcaagatggaaagtaatgtttgatgatgatgaagtttcttcatcaaaaaattgttgacattgtttgggataaaaatgccatggttgagaaatataagttcgtgtcttgttgtcataaagatatgcaatacatgtaatgggttcaataagctcgaattgaaaatcaacttgaacttgaagattaattttctttaaaaatgatgactcaacattcggtggtgggaaagaatctgatcccttgatttctgtattgtctgttgatttaagttgaggcataattatttttaaagaatcatcaagatatttatcaaccttcgactcgtctggaaacaaagattggggcgtgcgttgaacctccatttcatggatttctgaacaaaagatattgccaattggatctgattgtatttcattagttgaaaattctggaatttgaaacggattttgaatacccttcttgacactgacactattttttatccatggtatatctttttgttgattttcatttatttcttcttctatttgaggttcacacataattttgatcgtttatcacccaaaatataaaaatgtcaaaaaaaaaatctgtgaaaatctttgtctgccacatattccctatcaaaactgattcaccgaaaaattacatttaacattttttattattttatagaattcatcagccaatttattcaaataaaaatgattttttgaaaacattaacttatatgtatttgagattctcaattatgtatttcattttttaatgaattggatatttatatgttttttactaatgacaaatattgtaaactttgccaaaaatataccattccctctctgtatacaatgacaggtaatcttttattatgtattataatgcctattttagttgggatatagttttcatcatatagttttattttaaagaaaaaaaattgaaatgttttagagttagcaaaatataaacacatgtttaaacatttgctcaattgctgattacaatgatttaaaatatttgtatacaaaatttatatgtaaaatagttggtatgtttgggaaaccatggaattttaaattgaaaaaagcacttttgcggtaaagtacaattttaaaaagtgtcaacattttttcacttggcggttttacgttgaactttaaccgtctgactttctttaaaaattaaatccaaaaaactgttgtaatgcaacttttgtgtgaattttcttttcagcagcggttttggattttggaatgataaatgtccaaatcttgaccattgtattgctcaaaaaccaaatttgcagttcaccacagcctcaattaaacctaatgttttacaaatataaatttaatcaattttataatttatttaatgatgattttcagatcaatatccttcttaagatcattaaattttcctacactcctcataaaaatttgtttaatcattttgaaaatttactatttcaccataatcattgcatttcagaaatcaaaactaattcgtatatgaatttattatcgaatgagttcaatactaatttttcaatcccaaattacaaacttatacgtaaacattttaatgataaattcttttatcttaataatttcgagtttagtttcttaataattggacagtcttttttaatttattatattatttttaatttgctgagatcattaaaaaaatttggtatccataagttagaatcttattatacaccgaaacgaacatttggtttaatttttttcatttttctctttattgtgcattcatacgaaacgtcacttattataacatcttcaaatgaattcactgaagaagcaaaaaatacaacgacacatgttacaatagaaggaagtataacttctataccagatgctttccaagaatggcctttgctaatttatgctcaaattggagattcagtagaaacaattggaaaaaatgcattccaaaattgttataacttaagtaatgtaatctttgggaatggagtgaaaaatattttagataatgcattttattcatgttcttcattagataatattacattaccaacatcagttcaatcaattggaatgtctgcttttgcttcatgtacaagtgttaaattttttgctgtttctaatgaaaatcaatattatactattcttgataatggtgtgctttatgataaaaatcaacaaaaattagttcgttatcctgttggaaatattaatgaaaaatatgaaattccaaacacagtaacagaaattgatcactattcattttattcatgtgtttcattgaacacaattgttattggtgaaaatgttaatgctattggttcacgcgcatttcaatactgcactaatctctattgcattatttatcgtggtacaaaaattaaaacttcttattcaagctcctttggtaatgtacctgcaaaatatgtttataccttagatacttatgaaggaacaaatttttgtggtattaatgtaattaaaggagctacagaagaacagtgcactgttccaacaaatacattcattgtatcaaaaacattcactaattcaaatatattttctaacttaaattcatttaatagatcaaatacatttactcagtctaatacatatactatatcaaattcattcaccaaatctaacacatttactaagtcaaatacattttcgcattcatatattgcttcttgttcgtcagatataagtataactcattctttcattttaactgctttttcatatatttatgaatctttttctttatattcatttataacaaattcttttttgctctcaataattgattcttcgcaaacatatattaatacatatattatttattatgattatactgttgtattatatacttcttactatatcttttattcagatttttatacattaatgaatcaaaacaatattttagtgaatgataatacaaagcaaaatataatcatcggtatatgcgttgcaattgtaattgtattgattatttcaatagtcatcataataattatacataaacataataaaaaacaaaacagtaatagcaatgattatgaaaatgaaaataatttgaaaacattgaaagaagaagaaaattcagcattaggaaacttttctacaggattgtcaattgcaaattctgaggaagatccgtttgcaaaggatttcaaagaagataatatcattatgaattttagcaatatataaacattgtaaaatatctttctcctggtcctttcataattacacattaacaaattattattaattatgtaaacacgaaataaaaggtgtgtagatggtgatgatctttgataaaacgaaggatatacatacaaagaagaaaatgcaaatatttaaagggattatatatacaagaatagctgttaagtgcattaaagaatttcgtttgattgttgctattataaaaatgttattttacaatttttatcatttattttgtcttaaattatttatttttagactttagattgttctttatttttctttttaaaaaataaaaaaaacgacacgaaccagattcgaactgatgagggataaacccatagggactcaaatcctacgccttaaccactcggccatcgtgcctgacgattccttccaaaaatggaagcaacgaattacttactttaacaggatagtttcaacccgcataaaaatagggtaaccctgtagacacgatcaaaacggattcaaaacattcctatcgtatttgtgcaaaaaagaaagaaaagaaaaaaaaaacaaatggaagaaatatcaaatgaaagtattcaacaaatccttgacgaaaattctaaacttcttgcagttataatgaaatgtcaaaatgaaggaagaattatggactcaattctttatcaaacacgacttcaattaaatcttgtccaacttgcatctattgcagataatagacctcatccatcagttggaccacaagcagtcaaagaaataattacatcatctacagaagcgacagaagaaaagttaaagttatcaaagtttattcaaacgattcgaagagttggacttcgtgatttagaattaatttcaacactcactgatatacctattaaagaagttcgaacactttcgacaacatatatcgaatttttaaaacgtcaaaacaggaatcatgaagcagaagaatatgaagaagaactttcatcaagtatgatgtcacaagatattcaaagttcaaacgtataaaaaaaaaaaaaaaaaatcactattattattattattttttgataaataaattaaaacatagatttatttttattttattatattttatttatgtttaataacttgaatagaaatttctgcatctccaattatttttgattcttctgaaagacaaagaacatgaaaaattgctttctgtccttgaatatcttttactttaccttgaattaaaaaatgtttaccaagtgataaaggtgctttatgttgacaaacaactttagaagtaactgttgaataatcctttggaagaaatgaatttacatatttacatgtttcatcattcatttgactaatcattcctggtgttgataaaatatcatctcctgctttttgtgttcgatttgtagaaagattaaaagtaacttctttattactttgaaattctgactctaattttaataattctcttaaattgatatctttagttgaaatccaatgacgtgaaatattttttgttgatgaaattaacatttttaaataagaaacaattcctatcgttatggtttacttctgtttaacggtttttattatttttcatgaataaacaacaaacacaaataccttgtcgaaaaattaaaaataaagaagatattaacatatggaaagaaacacctgcttattatgatattaaaagaactttttatcaacttttaaattctgttcaaagtaagtctcgaaaaccaaaagaaaaatcgaggaatattattattcaagaacttctagaaatattttcacgattaaaacaatatttaaatgaaacagaaattatcacacaaaaatccatttttcgtaataaaggattttgtcaatggttatttaaagtcaaagaaaatgcacatgaattattttcaagggttacgaataatgaagaagtaatatattattttacagaatcatttggtaatcttcaccgtgttgattttggtacaggtcatgaatttaattttttagcatttattacaattttaaataaaatttatcttttaagtgaagaagattcaaagtttatagtgtttaatatcttttgggaatattggaaccttatttatcaagttattaataaatttcaagttgcaccagcaggttcacatggagcatggggcattaatgattatcttattcttccatttgtatttggttcgtcacaacttattggtaattcagaaatcacgccaagtaatattaatgaagaaaatatttcaacacattataaagaagaattttgttattgtatgagtatttcacatttacaccattgtaaatatgggaattttgaaacatcatcacgaatgttaaattcattaagatatgtaccaaattttgaaacattacgagaaggaatggttaaactttattttgatgaagtcgtgaataatttttttgttgttcaacaatttggatttggagaacttttaaaatgggaaagcaaagaaaataatgaagaaaattttattaaataatgtattttaataaaaatattttttttaatttcaatttttcaatttatctttttgttgtaatatgaaaagtggcaatgtaaataaatcaatgaaaccgttattttaaaacatcgaaaatttacggttatcgattcaattttctattgatttgacaggcaaaatgcggtttgaggctcataacaaaaatgattttcttccttttttcgctcttatttgattctaaacattgtaagaggaaatgtctttcgctatttgcaggttctccatctaagaaaaggatgtgtctaggaacatgcacaaacggttttatcgaaaaagaaaagattcaatttggtcaacgtaaaatgaaaaaagaagttagccaatgtctatcgaaatgtagtcataatgttaattcatccacagactttaaaaaatggcttaaatgtcgtaaaagttgtgtaacgattccaaattcagatcaatatgattatttttcaccagatcaatgtgtttcagagtgtgatcaacattggaagggtacagaccatcatcaaccgtgtcaagaacacatgttcattgtttcaacaaaactttgtcaattcgaagccaaccaaagcagatccaaggcgtgttcaaatctttaccatttggtaatctaccttgtttttaataaatctttgttttcaacgaaacaatttccaaaatggtcaaatcaacattttttttcataacaaaaccgcaataaagttatgaaaatgcgacacttgtacggttataaaattttatgatttaaaatttttattttttcttcgaagatttctgaaattatttataaacacttgggatctatgctctaacaacgccataaaaaatttgttaattgattatttaacaaataataaatattaattcatattcatttctaatttaaattattttttatcatgatttatatcattaaagaattttactcaaagaacccttcggttatggagtagattatgcatgatatttactttatacaaagagttttttattcattagcaggctttcaaagccataagttccaagtgaaacaacacatcaacacccaaaatcccattaaattcagaccaccaactggcctataattagaacttgtgattaaatatgaaaatcatctcatttgattatcatttgagaaacaaacgcttgagagcttggcttaccttaagcaacagtttaaattgaatttaattgaagataaaatgaaagatgatgtcaatcatatcaaatttaattttcattccaacgggcattcaatgtcgcttagttttgctggtgtgttcaacgtctttaaaggaattttgcttgatatgaaaaatatcataatcttcaaagttttacaataacatcatcctgatgttacaacctaagtgtatcaaatcagttgaactgttcattgatatctttcttgaacgagaagcaagtacgagaaagtccgcgaaacgatcggattaattgaaaagcaatcacttcacatgctataaactttcaaatacaaccggtcaacgcttaaatttctgttaaatttaacacaaatcccaaaaaattttttgtgtaacacattcagtttttcaatgccagacggatacaattatttttcaaataccagcactgtcaaattacccaacatgtcaaatcaattttcacaatcttattcagattgataacatgagttatattattatttatttttcccaatcgcttgtgaatattatttctcgcttttgaaatttaaatcaatgtttttactgagatatttctgtttaatttgattgctataactagttcgattaacaattcaaaaagattactttttctatgcaagtggtttaacaattcaaaattttgtacagttttgagttcattttttccatgctcttccttcttctcggaattgctcaagcaaggtttgaccaattgactgttggttccccagaccaatgttatgaaattagcattttgcctgatcgcttcaaggacatttatgatgaattctgcaaagacattccagttgaacttgaagagttctgttctaactacaaggttctcaagaattcatattctaaagttcactttagctgcactgctccaggtcttgaatataaggttggtacttttatcgatactgacatttgctatatccacatgttttcccaggtttccgaacttaacttcactggaatcgcagaaactccacgtatctatgttgcacttgatcaaacaggaagtggaaggattccaattcaagttaaaccacaagatatttccgacttaattccaagcatcattttccaaaatgatgttttcatcaatggtacattaattgctgatgatatcacattcttaggccgtagatacggtactgttgaagctgaccacatatactctgtaaatcaagatgacctcaatggcagcatatcatccaaaaacacatatctttatgatatggtttcacctttacccaatggtgaatgtcatcttattttacgagaaaacaacatcactgttccaaccagccgctggagaccaatggtatttaatgctgatgttcaattccaattcagtccatatatcactgaagataaagtcattgaaattgaactttatgagaatgttacccagccaactgatctcactatcttattagatcaacctacaatcgcttactatacaatgctcttcagggaatatttttacaccaatttaccatggtacctacttgaagatgcacataaagcacgagtgaaattcaatttcactggagattgggcaagcacaagcggattcgagttaaggctcaaatatccaccacacatagaggaaaagattgacttctcgagcattccatcaaacattcaagtcgttagggaaagcaatgatgatacatacttcgaagaaattagcatcggaggattgtcgactggcgtaattgtcgcaattgttgttgttgtcgttgttgttgtagctgtcgtagtattcttgattatcttctgtttatgctgcaagaaaggcggtaagtcttcttcgtaaaccataggaatatataactttatcattttaatatgtaacaaaaaagatttgaaataagaaatacttcattaaacactttttggagagtaaacataacacatttctatgattcagatccacatttatagcaattggtataagtttcaataactacagaacatacaagtcggcttttcctaaattaaataaggtattatttatatttaatggatgttgaaaaatttcgctgttagggatggggaatttgagtatttctatagttttaaaagtactctatcgtccaagtatcgaaagtgccaatgccgataggtccgacacatttttgtgaaattacgtttaacttgagaatacagttaattaactgtatgatgtatatcattgaaattttctgaacaaaatctttccttatcaaatcaacagaaatcacaagcggtaatattcggaaaaagaagaatgatcttgttcactgcgctctgccttgctttcgaatcaaattatgttacgaacccttcatttgaatcagggctatcaaattgggggtttgattacagcacatgtaaagtaacatctgaagtatcacattctggaaatagttcaatttattgtcatgatacatcaggagagaggaatgcacttgcataccaatttaaatccaaaggatcattaccaagtggattttattataaactttcagcatggattcgaatgaaggactgcacatcaagattattagtttatgctgaaggccaatggaatgcatacacaattggtctctatatttataatgataaaaatcgttcatgttcaaaaaatgataatcaactctataattgtgatgatgattggtattatattgaaggcaccacactagaaccattagaatccacacaaccatgcgttattggatttggtcttcgtgacaaaggcactggcgaattttggattgacgacatcacatttacacctgttatgacgaccacattactcaacagtgccgatgttacatgttggcgtcaagaagcgtatcgagacaagaccaatgtaattgttgatctagcagtcaaaaacacgcattgggagaatggcgatgatttagcattcgatgttgacttcattaaccaagaaacagggaaaacagagttaacacttcatgaatttacgatcaaacgtaacatcgaaaacatttatgctaactttgaattagatccaacacttttaacaccaggttattataatgttagtgttacattatataatcttttgtttaatattactgagaaaactcaaacatacattcacatcttatctgaaaaacgtgattatgccatttatattgatgataagatgcgtactattgatcatgggaaagtcttctttccacttggcgtatactatgattattgcgattattccgaagatatcattcgtgactatattgcatctgatgacagtccatttaatttagttataggcggcggacgtagtaaagcagcgatggatcgtgtatataacattacaaatggtaaaatccgtgttatagacttaggcacatcaaataaagttgcgtatagtaatgttacacaacgtaaagaaatcgcaaaacaacttgctgattatgcgagaacagtcaaagattcgccaggtttatttgcatattatcatcaagatgagccaacgtcacaagtagttccatcaatgcatgagaatgttatagcattacgtgaagcagatcctgatcatcctgtttatactgcagttaatcgacgattagagttacattatattaaagaaggcttagattgttacggaagtgatatttatcccgtgcaacattacgacgatttccatgcagtgtatacagtgacttatcaaggacggaatagtgttataaataatagagcgaattggggaattccacaattctttagttggaaaattattgatgaaaaacaatttcctaatgaattacctccaacttatgaccagttacgtcaaatgacatatcaaatgattgtcggcggcgcaaatggaattatatattatgactttagtgcgacaatgtgtgggccacaacagccatggcaagatgaatgggagaagttaaagaaagtcgcaaatgaactaatgaatgattacgtgccaattatattatctgggaatgacgttgatccaggttatgcacagccaacgtatgaaaaggaacttaatgttggaagggaatgcgctgtacggttctttaattatgatggatatgattacgttttggcagtgaacatttggcaatataatgcaaaggaatgcactttctttaagccaaatactacttcaaaagttaaaatagtgtctggcgaatcagaagtgaaagaacagacagagacaacattgactttgagtatgcccccaatggacgttacttggctgagaattacaaatgaagcatttaatggaaaaagtggattatcaacaacttcaaagatagtaattgctgtggttgtggttgtagtggtcattgtcgttgtcgttgttggtgttttgatatatctcaagaagagaaaccaaaaagaaatctcttcttcggtttaaataaatctcgttgactctttgtttatgtttttgatgaataccaaaatcattaattgaaacattgttaataaataaaataaatgttaaaatatgtatttcatgccaaaatcattataatgatacaattgtttttttagatataaactgaaatttttttctgtttaatgaaattataataaattgttatgaaaatttgtttaaggaataggtaaaatatgttatttaatgttgaaatatttgaagaaaatttacaaaatcgcagcatttcacatcataataaaccatacaattattcaatagctctgctcgactccaaacgaccaaatggataaaacaaatcttcttagaaaacgacatacctttcgaagttttaagcaaaaaatcaatgccattaatgcggatattacgaacaatttcgaattaaagcgggattcaccgagaggcggcgatttcggcacatatttctacgatgagttacaaaacagtatgaggggttatcttgatccagagtacgcgattttcaccagggatttacttcccatatctcgatcacttccaataattcttcataacaaagaaaaattatttaattattttattgattttctgaagaaacctcacgaggaaattaaaggttgtcttgaagatgtaatgaagttaattacccaactttcgcgtgatttaagatcagatttttatccatatttcccaacaattttcaagttattatcagaacaatttgatgctctaatgccaacagcttcggcagaattcgttgacgcctttttccaatgcgtttgtttcctattaaattttcttaaaaagtcattaatcaatgatcttgacaatgtcattatgatgttctatgaattcttcttagtacataaacgcgaattcgtcagaagacttggagctgaatcgttagcttatcttcttcgacaagcgccaaataaaattgattctcataaatcattagttgaatctggtcgaatattcatccaggataaaacgccagaagaagccgaagtttttgagaaatctcttggtcttgttctctgtgctgaaattaagaattttagtcaatcacttcgatcaaatgcaaccaaactcattgatcccttattttataataacgacgacttcattattaatgcgttttcatatgcgcaagagaaactttcgggtcatgtccgtgaacaatttgcaattccatatttagaagtattatcggctaagttgccgaccgttaactcggacatgtgctgtaaagtattcaatttctggatggagaaatctgaatttaacatttgtcatatttcattaaaagtattaccagaattaattggtcatacggacagtaatttgttatgtgaatttctatgtaacttagacaaatattcactcgaagacggtacaagtgaattgatttctaattctgtaatttatttgattgaatcagaaaatgttgaagaacatatagaacatttaaaagaatgtcgccgaattgtatatttaacgcaagagaatatattgaaatatatcactgagaactttaatcgtttgttaatgcatcttaaagttatccttgaatggatacatccgacgcaatatttaatctcaaatgagttaatacaatgtgttaaagataatttcgatgttaatcaagaactaatgatcgaattatcgaattatattaatgacaaaagtatatatgaaaagatcaaaaatataaataacttaacaattaatgagcgtaaagtattatattcattaatgggtaaatatgaaccagacttattaacagaacagcctccatatttaataacgttattaaaagatccggaaaacattaacgaagagtttttagatcttttatattcattaactattatttctataactaaatcaccaaattggttaaataagaaagatgaaatattgaatgaattatataatatatttaactttaatatcgattctcatgaaatccaacaattatcatcaaagattttatatgcattcattcaagatgataataaaactttcgatttattatcaccaaaagaacttttaattagagctgcaaacgctgtctttaattgtgaacatacattagaaagttataaaattggcgaaagttatatttctagattaacatcatcaataactaaattagcaaatgatatggataaaacttttaatctttcattaggattttctaatcaaaattatttacgttttcgaacacttgatgaagatttaatagttgaaatcattaaattcgatcagaattatgcaattgaaattattgatattttatataatagatatccatggaatgattgtagttttttagctgaaactttattaaaatctttagctaaagtttcatatgttaatgagaaattagtttcattaatttatctatttgctaatgataataataaggattataagaaattggaattattaataaattcgatttcatcattaactaaaaaagatgaattctctgagaaagcagaagaagctataatggaattattaaaatcgacaaatattaatattcgaaaagcagcttttaatttgttatatcaatcgaatatattaaagaataaagatattaaacaacaattaaaacaaaaaattaaagcacaacttgattcatttcttgaaactcgaattaatactgatttaatatcaaatttccatgtgtttatagaagaagaattaacatttgaacgtaaatttgttgtatcagttggaattaatatgtcgattggaataatcactgaatatttaacagagaaaagaaaagataaaaagcgttatgaacaaaacgcacaaattataatgcaagcaatgtcatatctaaatgattatgaaatagaaccattaattaaagcatttctaaaagagaaaccaaaagcatcagaaatacgtaacttcccaaaatttgcaatacctatgataacacgtttaactaatcatttaataccttatttagatcaaatatcaaatttattattattggcattaaaacaagcaccgaaaccacaaattaataaggaattaaagaaatcattaaatgcattatcaatctttttcgatagttttgaagcacaagaagattatgctaatgaaatattaaagtatatgaattcgataatgaaatataataatatatttggaattcgattattattatcaataagtaaatcaacaccaaaagtatatgaaaatcattatgaaatagttaatgatttaatagaattagttaaattaatgaatgctgatacaatcgatcaaatctttttaatatttgctaatataattcaatatataccagattcacatgaagaaattataaatacttttctaaatattgtggataatatgaaattatttaaacgtgatcgaatatggaaaccatttataatatttttagggaatatgaaagaatgtaatcaatcgaatatatataatgatttaattattaaattcgtattaaattatcaacatattgaaatgattgatattattcaaggattagaatttgatgataaacaatttgaaggattatgttcattaatagcttatcctttatcaactgaatttcgtaataatttcattccaataattagtgaatatttggatgaatattctgaatcatttatacaattaaatcaaaatgattttaatcaaaaatcattaatatataattcattagatactgttggaaagttttcatatatatttgcattacaatcatttgctgatatccaaattaatgatttccaattacgttcttcagcgataggatttttatctagattaatatcaaattcatcaatagaattaattaatgattttatattaccagcaattaaattccatttaaagaaaaaacattcacatataccaccgaaagaagttttgttcatattaaattcaattgtgaaaacttttccagatgttttaccttcaattacaaaaatatcaaatcaatcattcttcttaactttaggtagtggtgatataaatgtacgaattgaatctataaaacaacttagtaatttcatagaacaatttgatgattgggatattaatgaatttagtacaattttgtttccatttttatgtcaaatttatatgactccagaaattgaagtcgcatttaaaagtgtatgtaaatatactaataaagaatcaattaaatcattattaaagaaattattaaaagaaattaaatatggaactacattaacattattaattgcattatgtaatagtaatatatttactcctgaagattgtattcaaccattattaaatgctattgatgataaaaagattcaatctaaaattaaacttcgattaatacctgcaatattaaatatatcaaagacaccagaaattgtacaaaatttaattaaatcaatttctaataaaatttatagtaagaaagtagaaagtcgaaaaattgctcaagaatctttaactgctttaatagaatgtatggaaccaaatgatttttatgttctatttcaagctcttagaaatagattaaaagaaaatggtcaaataccatttttatatgtatcattaaataatatgataattcatactaaacataaagaatcatttgattcattcattggattattaacagaaactttattaaaggatatatttgaatatgaatcaattttaagaattaaacaaaatttcatcgatgctaaaaaatgtttatcatttgaatcatttcaatatttagcatcaaatataaactttcggaattctgttaatgaatttcttgatataattataaaacaatttaataaattacattcattagaacaagctaaaggagctaaaaaattaataatatcattatgtaaaggatttgttgagaatgaatcagttgatgctaaaatacttgtcgatgtaatcaataaatttttagatatttctgataatcaacaaaataaatctgaagaaaatattgaaagtaatacattagataatgttaaatatggaatgaaatatcatgatgatatattcatcgaaaaacctgaaagaagtgaaacagaaaatgcaaatgatatagtgaaaagacttggatcacatttcttaatatcattatttggtgtacatttattattaatctttttcgaacaagaattatttgatgtagaagatgaaaatcaagttaaattacttgaacaacttttgttaaaactttgggcatttacacaaaaaactaatgatactgaaacattaataatatctttaaagatattacaacattatattaacttatcttcattcttaactttgttacctgatattataacatttttaactaaatcgatttcgaaattatctaatgcgactgatgcttatggtcaagaaatctttaatttattacaaacaatattagaaaagttcccaacaatggaattcccaatacaatttacttgtgctcttgtatctttttgtaatacacaattagatatacatgaatcttgtgatcgaatatttggcgttttgttaatattaatggatcgaagaaatgatatacctgaaatttatgatactgctgaaatatcatttgatttaatgattagagcattatctgcagatgtacgcaaatattctgctaaattatgttcaaagtttttatctaaatatgaattatcaaaacaacaatttcggaatcgattacaatttgttttaggtaatttatcatcaccgaaagttaatgcacgtaaaacattaataacatttttgaaatatttcattaatgaaacatctgaagataaatatgatgaatatatcgaattaatatttacacattgtggtgtacgaattgcaaatgaaacagatgaaaatgtcatcaaaaaattaaataaattcattggattattattaaataaaattccaaataatcgattcttatcattatggaatttaatgatacgttggacttcaactacagggaaacaagtacgaactggattattattattagctacaactgtttcttcatgtcctgatgcgatgtctaatttaattaatgaattacaatcaatcattgatatacatattaaaaatgataatattaaagtgaaaactgctgcaattaacttacatcggaatattgttatgagttatcctgataatgaaaatataaaacttttatcgatttcagttattaatgatttaataattggaaaaagtactgcgaaaattggttgcgaattattgttttggtatctttctacttttaatgatttcgaacctgatgaaaattcattgttaaatacttcaaatattttattggattcattaattaattggaatggtacaattaaagaagctgcggattcattacatttgattttaataagaattaacgaagaaaattgtgttaacttcttaagagataattttgaaaaatattatgaaaacgaaaatgaaaatttggcacttgtattaatgagagttttcgttgcaactattttagaaatcgattatgaaaataatgatgtttcatattatataataaaatatataacattgaaagtaaagaatatgaaagataatgaaaaggcggcagataaagcgatggaattaatgcgtaataaattatcgcctgaactatttactgaagtatataataagataatggaagaagaattagaaagaaaacgtaaagaaaaacttgaactcgaaatagaggctcaattggatccagaagaatacagaagaagaatgaaagaaaagaaagaaaagcaaatcacagaccaaaggaagaaggcatacttcgaaagtggtggattcttgacaccttatgggcctgatggtaaagaagtagagaaagttcctttggcacctgaatttagggattaaatatgtaataaaatataataaatataaaattttatagaattcttgtttgggcatcaaaaatgatgcggttaagaaaacgtttaccatttaattgaaaaagtgtaatacttggccgggaggttattaacgttcgttttgatgagcactttttaactatgccctcataaatattcggctgttgtgtaatccattgatttaatttcaaattttttcaattattaattcattgtagacttatgaaaagttggattctgagtgttctattgaatttcttcagaaaattttatagttctttatttggtcgggtgaccgttaatttggaaccctcagcgttttcattgtttttggccgttaatttatacaaaatcttcaaaaatctggttgaaaaaaaattgatttaattatataacactgattttcttcaaaaaatgatttagtgatttagtggatatttattgtcctaaagtcaaataaaactaattctaaatgtttgtagaaatctttaaagacaaaatattttctaaaaaaacggtttattgatcaattaaagctcagaaaatagaaaatcttttactcacaatcaaaatttttggtattgaaaataatccttaaaacgatttttaaattaaaattatatcacatttacaaacggatgtgctccttttttgtaaatgatttcgatagtattggcgtggaatatggtgatgacgagtgttgggatactgggacatcacctacagaaatagatattcaatggcttaaagatactattcatgacctttgtaacaaatcaaatcaaccagagttattcccagaaatttgccaagagcttgtaaaaagaaattttattccccaagatgacctttcagaaataggagatcatagcaaagataaatttccgattaattgtggatctttatcacaagtctatgataccttagaagtgataggtgaaggagggtatggaaaagttttaaaaatccataatttggtcgatcaacaaatatatgcattaaaaatcatcaacctggagccttacgaagtggaaacagctgttcacgaggttcaatgccttgctcatcttaattttccaaacgttctcagatattatagctcatggcttgaagaaagtgaaactgttggacttttatcgctttgcatacagacagagttcatcgatgggatttcactttcttcatacttaagcactcgaaaatttgttgatttaccaacatcgcataaaattcttgttgatattatcaatgcccttgaatccatacacagcgctggagtagttcatagggatttcaggccatccaatataatgattcgaactgatggatcaattgttgtaattgatttcggaatatcatcagttcgaagattgccttttgaacgtcacagtgaatcaccacctcttccagtgacaacacaaggtagaattggttctctgacagttcgtccattagagcaattttcgttaaatgttggtcagaattcttcctacactatgaggaaggttggaaccccactatactcatcgccacaacagttgaacggaaagaaaagctgtaaggaagatgatatttacagttttggaattgttatgtttgaaatactatatggattcaaaacagaaacagaaaaggctaaggtaatacaacaactccgaaataaggccgttcttccagagaaattttcgaaggatttccctgaagagagtaagatgataatcaagctcaccgaccataacccgaagaacagaatgtcggcaaaggacgtccttcagtcaaatcttttttccacttggaaaaatgaagccaaaaaattgtaaatcatttcgaaatagacttttttaaataaaaataaaactttcagtattaggggtgtcccttattttcaatgtatgatggggtgctcctctcccactgaaaagcaaaagttgataaacttctgaaatttcaaattaaaaaacgtttttaacacttttttatgatttcttattattattatcaaatattatctcataactgtaaaaaccgaacaaagttgttacagtcgaaaactgcttttcatgaaaaagtttcgaatcatcgcagcagaatacggattatcaaaaattgacgaagatctatttgcagttgatttcaaagaagataatcatgtacaaaatatttaaattaaaatacattaaaaaatttataaaatatataaaattcaaacatatatcaagttctaattataggccagttggtggtctgaatttaatgggattttgggtgttgatgtgttgtttcacttggaacttatggctttgaaagcctgctaatgaataaaaaactctttgtataaagtaaatatcatgcataatctactccataaccaaagggttctttgagtaaaattctttaatgatataaatcatgataaaaaaataatttaaattagaaatgaatatgaattaatatttattatttgttaaataatcaattaacaaattttttatggcgttgttagagcatagatcccaagtgtttataaataatttcagaaatcttcgaagaaaaaataaaaatttaaatcacaaaattttataaccgtaaaagtgtcgcattttcataactttattgcggttttgttatgaaaaaaaatgttgatttgaccattttggaaattgtttcgttgaaaacaaagatttattaaaaacaaggtagattaccaaatggtaaagatttgaacacgccttggatctgctttggttggcttcgaattgacaaagttttgttgaaacattgaacattgttcttgacacggttgatgatggtctgtacccttccaatgttgatcacactctgaaacacattgatctggtgaaaaataatcatattgatctgaatttggaatcgttacacaacttttacgacatttaagccattttttaaagtctgtggatgaattaacgttatgactacatttcgatagacattggctaacttcttttttcattttacgttgaccaaattgaatcttttctttttcgataaaaccgtttgtgcatgttcctagacacatccttttcttagatggagaacctgcaaatagcgaaagacatttcctcttacaatgttgagaatcaaataagagcgaaaaaaggaagaaaatcattttttgttatgagcctcaaaccgcattttgcctgtcaaatcaatagaaaattgaatcgataaccgtaaattttcgatgttttaaaataacggtttcattgatttatttacattgccacttttcatattacaacaaaaagataaactgaaaaattgaaattaaaaaaaatatttttattaaaatacattatttaataaaattttcttcattattttctttgctttcccattttaaaagttctccaaatccaaattgttgaacaacaaaaaaattattcacgacttcatcaaaataaagtttaaccattccttctcgtaatgtttcaaaatttggtacatatcttaatgaatttaacattcgtgatgatgtttcaaaattcccatatttacaatgatgtaaatgtgaaatactcatacaataacaaaattcttctttataatgtgttgaaatagtttcttcattaatattacttggcgtgatttctgaattaccaataagttgtgacgaaccaaatacaaatggaagaataagataatcattaatgccccatgctccatgtgaacctgctggtgcaacttgaaatttattaataacttgataaataaggttccaatattcccaaaagatattaaacactataaactttgaatcttcttcacttaaaagataaattttatttaaaattgtaataaatgctaaaaaaattaaattcatgacctgtaccaaaatcaacacggtgaagattaccaaatgattctgtaaaataatatattacttcttcattattcgtaacccttgaaaataattcatgtgcattttctttgactttaaataaccattgacaaaatcctttattacgaaaaatggatttttgtgtgataatttctgtttcatttaaatattgttttaatcgtgaaaatatttctagaagttcttgaataataatattcctcgatttttcttttggttttcgagacttacttttgaacagaatttaaaagttgataaaaagttcttttaatatcataataagcaggtgtttctttccatatgttaatatcttctttatttttaatttttcgacaaggtatttgtgtttgttgtttattcatgaaaaataataaaaaccgttaaacagaagtaaaccataacgataggaattgtttcttatttaaaaatgttaatttcatcaacaaaaaatatttcacgtcattggatttcaactaaagatatcaatttaagagaattattaaaattagagtcagaatttcaaagtaataaagaagttacttttaatctttctacaaatcgaacacaaaaagcaggagatgatattttatcaacaccaggaatgattagtcaaatgaatgatgaaacatgtaaatatgtaaattcatttcttccaaaggattattcaacagttacttctaaagttgtttgtcaacataaagcacctttatcacttggtaaacatttttttaattcaaggtaaagtaaaaagatattcaaggacagaaagcaatttttcatgttctttgtctttcagaagaatcaaaaataattggagatgcagaaatttctattcaagttattaaacataaataaaatataataaaataaaaataaatctatgttttaatttatttatcaaaaaataataataataatagtgatttttgatttcaatttttatacgtttgaactttgaatatcttgtgacatcatacttgatgaaagttcttcttcatattcttctgcttcatgattcctgttttgacgttttaaaaattcgatatatgttgtcgaaagtgttcgaacttctttaataggtatatcagtgagtgttgaaattaattctaaatcacgaagtccaactcttcgaatcgtttgaataaactttgataactttaacttttcttctgtcgcttctgtagatgatgtaattatttctttgactgcttgtggtccaactgatggatgaggtctattatctgcaatagatgcaagttggacaagatttaattgaagtcgtgtttgataaagaattgagtccataattcttccttcattttgacatttcattataactgcaagaagtttagaattttcgtcaaggatttgttgaatactttcatttgatatttcttccatttgttttttttttcttttttttttttgcacaaatacgataggaatgttttgaatccgttttgatcgtgaatgtctcaaatttttgtagtttataaatcgaaaagtaaatatttactaaaatccttaattttttctaactttaaagtcttgaatcaatttcaaaattctttttgccttgtccacttccttaccaattttattcgttttttcattttccgaattctttaatttcaagttaacgttttcctcttcaatttctttttgctttaaacgttcttctgtacttttcacatcgatttcaatcaatttcaattgctgcactttttctttgtattcgcctttcaaaattgaattcttttctttttctttgttcaatttttcctcttcgctaattagctgcagccgtaaattgttgatttgctcgttgtttaatgaagtggctttaaaccttttattaaaggttatgggaagtgatggatctgcgggaggaatattggtttcgttcttttcattataaattggaactggaacttgaatctgtgatcgttgatttagagggctttgacgattgttaagtggattgtttcgattttgataaagaaatgctggtgcacctggaacaggtttaaaagaatttaatggtgatgctcgagttgatggtaatgtattgctgccatgttgacgcgtacgggaaaaatcgcttggtttgatataatttatttcgcctttaaagattttgttgatagtttgggataattgaattattggaattcgtgatgaaaaagtttgcttaaaatcattactttgatcaaaataagtttcgcaaatattaacaaatgttatgagagaaggagattctataaaaagattgatatctttgtcaagttgattccgatcaaaattttcaatcgaagtattgagttgtatatattgggtgacttctacacgaaataattgaacttgcttatcaagaagttcttttgctttaagtaactgatcttttgtgatattattgtaaattgatagcttgattatatcttgcttttggacaggattgtcgcatgctgcaacacgggtgcaggtatcttctgaaatcttggataaatcttgaaagatttctttggattctggaattttatcaaatcctatttcattgatataatttctcattgactctaataatgatattaattcaccgtgcttgtctggttgtttttcttgtaattttttgaaatattcttctacatcatcgctcatttcctgataaatggtactcgggaatgtaaacttattaaaaagtttaactggaactagtcaaaaattttattgcgcggtttttttattaatggattctgatccttactgacaaagcaaggctcattcttcttttactaaaaactcgaatttcttttgatccatttcttctataagtgatcagtgcataaaagatttagatattttaatatgaacacacctgaagaagaaaccaacgaagaatcatttaaataattaaaaattttttataaaatgtcaaatcttccataagttagatattttattctcttgagtttaactttttttttacgaattctttccatttattaatgttataaagtttcaaataatgaattctatttagagaatgaatataatgtaattttgttaatattttcatcttgtgtaattcatgatgtattatatttgttttaagcagagccatcgaaaccattgatatccatgcatttgtatgaacaatattgtaaaggaaaaaagtttttgattttattttttttttcatgagtataagacatattataaatgttttacaaatagaacattaatatctaaagcaaagacgaaataaatgatgaaaaacaattattcaaaatttctttaatagaaatggaaacacaaacattaaattttgctcaaagttattttaaattaattacgaaaatatttattgatacgcaaaagtaaaaacataaaaatcttctgcaaatgatttcattcagttggtactttatcatctgcgagaatcagcacaccattttccaagtcaatactaaatggcttatgttcatctgtttgtatagacaactctgggtatggaagtaatccttgttgtagtccaatgaattcgaatgatattctttgtgaaccatttggtcttaatacatcagttttaattacatgtgttccatatggcaataactttgtttcgcttttacattccgcgttaattaagaatgatctgtcttcattcgacgtattgtgaacatcaaatttgactgaaaaaggcgttagcaactttttcaattggggcggcccaataattgaaacagccaaagggagtttcacttggctttgtttgtttaggtcgaatgtgctgagttccaatgtgcaatttgactgaaatccagtgctccatttcacataaagatgttcgatctctttgaggtcattgttgttctcacccctttgaagctcaagaccataaacagctgaaacttgtgatgaaggaaggagaatttcggcaacttgaacttcagattcatcaactacatagttttctgttgggaatacctcaatagaaacattccgcataacatatttggtgttgttgcataaaattacttcgagaagaactccttctcgacgtacttttgttgttttgagatgatatgaaaaagatggagaaacatcaatcttgaaattgcctttaatattgtggcttttgctttcagttgtgcaagaaccagatatatcaaaatgaaatgatccatcagtatttgataaaaattggataggaacaaatagttgtgtaaaggatccatgttgttcaatatgaacaggagtattagtatcggtgcgtgtgagcttaacattgtttgaatcacgaggtttgatatccattgtaatttttgtaatgacagagtttgaatctttgcgtttgattctggcgagaaggaaagatgtaactcctgagtaaattgagtttggattaggaaatatctcccatgttgaaaaagtatttttaatttcattttgtgattcaaagttaaccaaatgacctggaaattgaaacgaacatgttggggctggtaatgaatataaatctaacgttaaatgcttgccaagaggaatactttggcagcgagacatttcaatttattttagggcaccccaaaaatttttttatttaattaaggaaaatgttttcagggtaagtcgaattcatatttaatgaaagagtaataaaacataaaactgtctcttattaaattcaattttttatttatgcacataacactttcgcaataatgatttaatcactttcagagaatttgatttttaaaatggagtactgccaaaattacatttcagagtttttggagagatacaaaggaaaaaaggaaaatcttatttaatgtttaggaagccatccagaagtcttccatctatggtcgttcgcaactctcacgtaagctgcctttgcctcttcgagagaatatggggatgtgttggagaaatcaattcgaggatcacttgataagatttctgaaaacaagttaattaacatactctcgatttcgtacactggtttccatgactccattgtcaaaaggtcattgcaaatactgcctccaacggtaactcttcctttatggaataagaatcttggtctgacaactctaacgaaaggaggtacttctggatagtttggcgggaaagaaacttcaaattcgatgtaatcacgtcctgtcttcttcttatacttttggatatcatcgtaaattggtgtcttcttctcaaagccaaaaagatggacagtccaaacaaagaggttgttttggattggttcagcagtgaaaccattgacttttggatctgatcttaaaatcatgttataatcttcgataagacgaattgcagcagaaccctttggattgaacctttccatgagggtttctctgatctcttcttccttagtctttaccttcggttcaggtgcagatgcaacaacttgtgaaatatcaatgtcatctgggagctcaaactcaacatcatcatcaccttcatcgatgacgcactcttgatcgaagtcttcttcataattttctgggaattgttcttcttctccaaaatcgtcagacattttaatgcactttttctctttttgaacataatgttccattgtaaaaataatgtattcaaaaattgagaagagagtttggcaaaaattcaaaccatcatcaacatttgaaattgtttcatatttccctaaaaatttatctcattttcatatggaagtaaaaatcaaaacgtcataactattttagtatggaattacattcgaaacaaaatttttactaaagaatgccaaagaaagtggccgtttaatttttgttaataaaaattttaaacgtacatatcaaaaatctttggttggatggataaaatccaccaaattgatcaattagtcaaaaaagcaattgataattcatttaacacagaagcatttttggaaatttcagataaaattcgaaggttacttgcgccaactaatccttatccaggcattttagaaaaaatcgaaattaaccttataaacaaaattatttgtatcctagaaaagttttcatccatagttttttgtgataaatataaatatattaatagtaattcacatacatttcgagctcttgatgcttgtttattagctcaattagggaaaattattatatactgcaaagtgcaaataccagaatttgatattaatgaagttattgaaaagttcgatacatgtttaagattttcatccaaaaattcagaaaaaagcaaatcaattacagaatcagaaatttttaacatgtgtgcgtatttatttaaatacaaaaaatatgaaaatgtatatagtattttaaaattaattgaaattactcaaagtaattacaaacaaagattgtatcaaaagattatttctcttattataaagtcactggttggtatgaaaaggtgtgatgacgatgaaatttttaaatggttaaatctgattcacccagaacaaatgacagattgcttattttcaataattgtcaattacccaccacagagagtagatatgatgattccttttttagaaagatgtattgataaaaaatcaataattccatattttgtattaaatggttattttgggtcatatcctgaatttaaaccttatgaaattttttttcctgctttaattccaccgaatatagtctgttttaatgaaaatatatttaatgaatatatgttatgttatcaattatttgaatcaagctcattttataaatgtgcaatgtattccattgaagttttaagtaaacttccaaagagtaaaatccctccatcaggtttaatgatgatatttttcttacattattggatttcatatagttttgacgcgtgcggcttttgtacacgtgccaaatattatatcttacaaatgcaaaaaatcttttcacattatccattttcattacaaattatatcatctttaagtttaaaaatccatcttaatcttaatgacatcgaaagtttcaaaccaataaatacaacaaataaatatttttataattattataattatgattggatatcaacacaatatttatatgaagcaataaaattatcttttgtcaatgataatttaaatgcgttaaaatattatgagaaaatattccaaagtaacaacgatataattaaaagaatatcatttcattattatataacacaaaaaagagttaacaatgaaaatgttaacattgaaacattcgaaagtttttgtaagcaatataaagatacatattcattatataattatcataaatcaatcgaacttcttaaatatgaagacttagataaaatttggagtttaacagaaacttcaacaactccaaatcaaatcatcttaaatcttttaaatgaagccgaaaaatatgcgcatggttattccatattattacgaaagattaaacaacttaaggcattaattatcgggcgttctaatcaaagtgaaactgcttggttaataacaacttcattatcgacaacatttgataattttttgaaaaaacaaaatcaaatacaattcaagccgaaatatccgatattatctatagcttattttaatatcataagtttaaatcgttgtttattaatatcattatattatccgaattcaaaacctttagtcattcgtttacttgttagttcaaatattgaagaaattctcgagaaaattgatatcgctgaaaagaatcttgaaatcccattaaacattgattccaaaaattggtgggaaacgcaaaagaaaaaagagaaaatatttattcaacaacttcaagaatttcaagacaaagttttaggtgtttggagtgggttattaatgccgtatgaatactccattaagataagtttgatacaatcgatttgtttatcatatttgcaaactatttcatgtaaaaagcaacaaaaaatgatacaaatgaaactcgaacaattaattcaattaccaataccaatgaacaatataaaatgtattaaaaaattaccattaatattaatattaggtaaacatattcataaaattccatgggaatcattaccaaatatacgtaacaatggaacaaatatatcacgaattccttcaattaaattattatttttagatcaaaaaatccaaactattaataagaaatcaggttattatgtaattgatccatgtaatgatactaattttaataaagaaactttggaaatatttaagcgaaatttatgggacggaatatttagaaatattccgtctcatgattcattaattaaacaattacaaaataaagatatttatacgtattgcggtcatggaagtggtgcacagttttgcgattatgaaaaattaattaattaccaaattcattcatcaatgtttttgatgggttgtagaagtaatagattagaagataatggtgagtgtgaaccttatggtactccttattattgtattgccgcgggttctaaatcaattgtcggaaatttgtggaacgttttatgcgtagatactgaccgagtgttggtcggaatctttaaacagttcgcaaatcaaaaacataaggatttggacgaggctatagaaaaaggaagaaattgttgcaacaacattatgatgcgaaaagaaaattgattaaaaatatataagaaaattttacatgattttagtaaaaatataaacctttaacaaaaaagtccattttatttgtagcttatcaattaacaataacagttaccttcaaacttgattcttatgatccattttaaattttggatttatttctggattcatcaaaggttttgagtatagtgtactcacactattttcttgaaaaatatgatacttctggaaaacattaatttagaataatattatttattctactcgtttattattcttttaaagtgaagagaatcgaatatttaacatgatggaattttgtcagatagtaagagataaaaaaatctagatgaatcatataaaatttattttccattttgaatgttcctgttaataacaattccaacaataagaacaattatgaacatttaaaaaaaattcatttaaaagatatttacattcgatttatatatttacaataagattgtcttctttaaaatctgaagcaaatggatcttcttcaacatgagatacttttatacctgcactgaaattgttattaatttcttgttcattttgtgaatatttttcatcttcatattcaaaactattaagtttatttatatatttatattttcgaataagaaaaataacaagaaatattaaaattaaaattataacaattccaacacaaacaccaataatgatataattattattgttatgattatctgtattttcattttgttttattatcgtataaaaatcggaataaaattgataataagaagaatatgcaaaaattacatattcataataaataatcgtattaacatatatacgttcagaattaaacattgatattataatagtattcgttgatttagttattattaaatatgtttctgtatttgataatgaaaatgtttgaacataagaatgtgataaaattaaaccttcttgtgttaattctgtgaatgcattactttgagaatatgtatttgattgtgtgaatatattagaatatgtatttgacttagtaaatgtattagaatatgtatttgacttagtaaatgtattagaatatgtatttgattgtgtgaatgttgctgtcgggagtgggttacatccttcaattgtcgtttcgctaatattaagataaccaaatgttttatttacatataatgatgttacaataactgtatctgcttgaatgctttcaaatgcattcgttccaatatttggtgatatctctccacaataatatatacatttgagtttaatgcaattatgaaatgcagagtcaccaattgtttgaacattcccttcaatataaatcgtgattaaatttatacatcgttcaaatgcattgtcacaaatccttgtaactgtttcaggaattgtaatatttattaatttctcacatttataaaatgtagaatatccaatttctggaatatttccataaatttcaacaatttctaaattaatacattctgaaaatgcataattcccaagtgatgtaactgttgttggaatcgtgatgtttttcaaatttgaacattgagaaaatgctcttgaaccaattgtttttaatttgtttccaataataactgtttctaaattattacaattttgaaatgcactatcattaattgtttcaatattatctccaagattaatagtgattaaacttgtacatgaagaaaatgaatattgaccaactgatgtaatcgagtttggaagtattatacttatcatgtttttacaattataaaatgtatgatctccaatttctggaatatttccataaatttcaacaatttctaaattagtacatgaataaaatgcataattcccaagtgatgtaactgatgttggaattgtgatgtttttcaaatttgtacattgataaaatgcttttgaaccaattgtttcaatcgtatcactaagttcaatcgtaagaagtgttccccatgaaaagaatccttccgatggaattgttgaaattcctttcataataataactttttcggtaatatttttataattttcaatatactcaaattcagtttcaacatttatcgtaagtgttttcgtatttttgtcatatgattctgaaaatgtttgaataaaataaagagatattaagaatggaaatatgtttttcgtgatatttattcgaattttatgtttgttattattcttattattctttttattaaaataaattattatgtaatgaagaagaaaaatataattaattataattatatttaaaaaaataaaattatatgtataattataattaaataaacatttaaaattattttatgatgttttaactttccgatgaaagaattgaattttttaatttgtgttattttattgttcaaataaccaaatgattttgtttcatttaatgattgaaatgtttgaaatgatttaattttaattgaaattttatgttttatgaaaatgttaaaaataattgggaaatatctgcttatcatatcaattttatcatattctttagtaaaagtaacaaaagacataaaaatttgttttaatttatcattttcatcatgtaaaaataatttatttgagacacattcaaaataattagtcgtcattgagatagttaaatcgattaagatgagaaaaaacatgagaaagaaaggctttctgaaacctccaaatttggaggtttgaattcaaattcacaaattttgttacaaattttttatttgtaaacattagaaaaaagtgcttttatccaacacatcttattctatgattaaataattgtacatacttttttattacttaaatgacgaaacagcaaactgcttcttcatattcgcatttggtttgataattattgaaccacaaaacaaagaaaatttgaaacaattttattgatttttgactttgttgaaggcttttcctaatttaatatatctactatgctttcatatatatatatgcctttggatgtcaaaagcttttttacacgtgattttcttatgagatttgtaaaagtataaatatttagaaacattattatataggaaaatatctttgtctaaactttgattttgctcatatgtttttgaaaaaggaggatggttaagttcattagtgtctatactttgagcttctgtcaaatcaactggcggaaaatcgatcgtaggctcatattcaacatcatctaaaatatattctttatcaatgacatattcatatcctttatattctttgtttggtggtgcgtgttttatatgatctatgggttctattatattttgtcctttacatttggactcaagaccttgagcacattctgtttcagaatgcttcattaaatttgactcatcgcaatatctaagtgattttttaaaaaaatgcaaaagtttgaaacataaaatatttggagcataatttttattataaatattaatattttatcaaatatgttactaaaaaatgttgtaaataattttcatagttaaaaattcaaatacattttattttaacataaataatttacatttttttccttaaaaatcagaataattaaaattatattcaaattcaaacattaaatacatcaacgcatgcgttaatgctaaataattatttaaatgataatttttaaataaatcaaagttcagatatattaacaattttttttgatatatttaaagaattctttcattatttgattagaatttgactgtctgcaaataattatttaaataatttcattaactgaagtaattattttaaaaatattataaaatcattttttactaatgaattggtaattaatgtgataattgatatgtataataaaaacatttaatgaaggtaaaaaataatattttaaagtgattgatgagcagtgtaacatttgaagataaataatgaaattatttatcaaagtaattcgcatttattatatttattgatttcatagccattgatctgtttcttcaagaatgttttctttgcatgttttgtcaatttcgttcgtgttcacttctctgcttccttcaagttctttattcgattctttgtttattcttgtcttcgttttatgtgtaaataaaaagataataattccaacaataagaaggaagatgaatacggctgtgcatgtgactgatataataatcgttttggatatacttcccgatgtaatttcttcttgtgtttctgaataaattataaaattagaataataactgacgtacgtcaatatttgatatatcgtaaatatataactgatgaatttcgttggcgtataataaatacttgatgagaaatatgaaacagtaaatgtattaataattgatacatcaataatactcaatgattgtgaaagtgataatgtgaaaattattgaaaaagaataacttgaatcattatttataaatgtattcaactgtgaatatgtatttgattgtgaaaatgtattagaaaatgtatttgacttagtaaatgtattagaatatgtatttgacttagtaaatgtattagaatatgtatttgattgtgtgaatgttgctgtcgggagtgggttacatccttcaattgtcgtttcgctaatattaagataaccaaatgttttatttacatataatgatgttacaataactgtatctgcttgaatgctttcaaatgcattcgttccaatatttggtgatatctctccacaataatatatacatttgagtttaatgcaattatgaaatgcagagtcaccaattgtttgaacattcccttcaatataaatcgtgattaaatttatacatcgttcaaatgcattgtcacaaatccttgtaactgtttcaggaattgtaatatttattaatttctcacatttataaaatgtagaatatccaatttctggaatatttccataaatttcaacaatttctaaattaatacattctgaaaatgcataattcccaagtgatgtaactgttgttggaatcgtgatgtttttcaaatatgaacattgagaaaatgctcttgaaccaattgtttttaatttgtttccaataataactgtttctaaattattacaaacttgaaatgcattatccttaattgtttcaatattatctccaagattaatagtgtttaaacttgtacatgaataaaatgaagaagaaccaactgatgtaatcgaatttggaagtattatacttatcatgtttttacaattataaaatgtatgatctccaatttctgtaatatttccataaatttcaacaatttctaaattagtacattctgaaaatgcttcattcccaagtgatgtagttgttgttggaatcgtgatgtttttcaaatatgaacattgagaaaatgcaaattcttcaattgtttctaatttgtttccaataataactgtttctaaattattacaattttgaaatgcactatcattaattgtttcaatattatctccaagattaatagtgattaaacttgtacatgaagaaaatgaatattgaccaactgatgtaatcgagtttggaagtattatacttatcatggctttacaattataaaatgtatattctccaatctctggaatatttccataaatttcaacaatttctaaattaatacattctgaaaatgcataattcccaagtgatgtaactgatgttggaatcgtgatgtttttcaaatttgtacattgataaaatgcttttgaaccaattgtttcaatcgtatcactaagttcaatcgtaagaagtgttccccatgaaaagaatccttccgatggaattgttgaaattcctttcataataataacttttttcggtaatatttttataattttcaatatactcaaattcagtttcaacatttatcgtaagtgttttcgtatttttgtcatatgattctgaaaatgtttgaataaaataaagagatattaagaatggaaatatgttttgcgtgatatttattcgaattttatgtttgttattatttttatttttctttttatatatataaaatattatgaaatgaagaagaaaaatataattaattataattatatttaataaattaaaattatatgtataattataattaaataaacatttaaaattattgataattttatgatgttttaactttccgatgaaagaattgaattttttaatttgtgttattttattgttcaaataaccaaatgattttgtttcatttaatgattgaaatgtttgaaatgatttaattttaattgaaattttatgttttatgaaaatgtttaaaaataattgggaaatatctgcttatcatatcaattttatcatattctttagtaaaagtaacaaaagacataaaaatttgttttaatttatcattttcatcatgtaaaaataatttatttgagacacattcaaaataattagtcgtcattgagatagttaaatcgattaagatgagaaaaaacatgagaaagaaatagctttttgctgatatatttgtaaaaggtttggaagaaaactggtgttaaacgatcaatacaactttttgataacgttacttttgtgttgctaacaaaaaacaactgaaatttgttggtcatgcaaattctccgagcgtttctcctattcaatttccgagtaaatcattcaaaaagcaatagctgagcaaatttttgtatgtatggaacagttgaagtttgtttggacacattcaaatcatttgtgcaataaacatggttgaggatgggcttttcagataaataaacggtcgaaaattatacgttaagacaacaatttaatcgcaaagctttcccctgatagaaaaaattatttcattaaacaaagctcttgctttatctaatctatctttctatatcctttgtatgttgtgattatgctttgttaataatttttatttttatttatgtttttttttgaattcagccaaatcccatttacagtaaaatttcattatattaaaatataatgaataaaaaaatttaaggaataaaaaaaatgaatgcaaaagcttgtactgtcactgcattttaggttggaccccttttcaggggaatttccatccaaaattcaatcaaaccgttccaactaaagcaaagtgactgtaaaacgagaggtgctgcctttaattaaggaaaataatataggggttgcagaagaaggcattcagtatttcctgccgatttctcgtaaattgtacataaggtacttaccatcctggaataaattccagaattttgcaccgcccaaaaaaaactcattttatgacgacggtttggcctctcaaaatgttattttacaaccggatatcaactgtttcattaaatttaaacatcaaaagtttgcagttcttcatcgaaaaatctaataagcaaaaaacaaaagtatttttatgcatttactttgtttctttccttggaaaaaagaagtatgatcaataaaaaatttcaagatgaatgaaaaatttaggaaagaaaagcatattcaaatatgaattttatctttcaatcaagctgaaacttaaaataactaatttgttatcatctatattttccttgccaagttcataacacgactaaggcgaccgttaatttaaaattgcttccaatggaatctgaggtattccctcgtgattattccagtgctgaatattgggaatcgaggtacaaagaagaatcaggaacatttgattggtattttgggtggaatgatgtttttcaaaaaaatctgttttcattaaacatcaaagggccaattcttgtagttggttgtggcaattctttgatatcatataaccttgaaaaatttggcatctatcctgttatttcaacagacatctctcatacatgcgttcaaaaaatgcaaaaagaatttaatggatgttatttgcctatggatgtatgtgatcttcagttcaaggataatttgtttccatgtgtaattgacaaaggaacattagatgccatcttatgtacacatgattttgagttgcctatgtcgaaaatgatgcttgagatctctcgtgtattagctcctaatggagtttttattgagataacatttggtaaaacagctgaaaagttaaacattttagattctcctgatttattgaattggacactagaaaaaaagattgatattgttagtggaaagggcactgcaaatatgtttgttttcaggaaatttaaagaagttgtaatagttgatgataatggaaatgaatatttttcaaaagattggaatgttaaaatgtgaaccataaagcaatgcaatattatgtaaacaattatattatatttatttactcaattttttaataataaaaaattagacataaaatacggaccgtttaatttttgtcacttttctattctttaacggttttgtcaaaacaaaaatgagctctaaacacaaatcaaagaagcacgagcatgataaggataaggaaaaggataaagaaaaggacagaaaaaagggagaaggcgaaagtagacgccatcatgaacatggacgtgatcgtgaaagagatcgcgatggtgaaaaacgtgaacattccaagagagatcgcgatggtaaagaacgagttaaaaaagaaaagaagattgatcgttcggtaatacctccatgggcaagagaaccaatcaatcctgcagatgatcgtttttacgaagattttgaacatgaaatcactcttccagaagagcttctatctattgatccaacgcatccaatgatgggcggaaaataaatttcatcttaattttgaattaaagttaatttccatttttttttaagcatttttgttatacgatttttaatcaatttgaaatagacaatttaaaaattttatgtaaaatttttcattgtttttaactattttaattacaataaaattttatttattctttttcttttcaagaatttctttcttttttctatttatttccgctaaactcactacaatgcccacacttacttcccgcatctgttttgcttttctttcatcgcatccgccgattaacttttttactatttcttgtgccattagaaccaacgaattctttgagaacgaaactctttcttcaagttcccaaacttcttgttgtttcttagcgatttgtccgatgagatctttcgactctaaaaacatttgtgcagagtctttacgaggcgcagtcttcgaggaatgcacaacaatgcctcgtcgcttgttgatctcgttttggagcgcccaaattttttgatgcacttttttctcaattactcgtttcgatgattccgaatcttcaagcttacgatcatactcagcaattttggattgaagctcttcaattcttttcaggtgtatagtttttttttcttcaatttcttgttcaagagatgagatcttacgtaaaactgttttaagatcatctgtacttggactattttgttgagaagcagtggcaacttttatggcttcgcgaagttgattggtctctgattctaatttttgcattatttcgcgtgattcatcaacactcgcaagttctgtcttttgttggatacgtagattagataactgttgttgaagttgctctccagttcttcccaaagatttagtttttttgccaagttcattgacttgtgtatctagaaatgcacgtctaacaatttgttgtttaacatcatctataagctgggcaacttccgttgcgatagggtgaagttcagttggaattgtatttatatcaggcattgtatttgattcatataaattatgtgcttgcaaaaattttgatatttttacaaactttaattgttctgtgagttgttctctttctttcattgattgacttattttgacacgaatttgaagattttcattccgaaaattttcggcaacttgttgagggcttaagttacttctcttctttgctgcttctatctgttcaagtagattgtaattttttgtttttaattctaaaagttgagcttgaagtgtctggaaatcttctattgttacagacatgttttaagagaatcctatcgttttgaggtacaccccgttatttacaaaagtgacggtatagaaatgaagaagaaattttgcattataatcgatatcgacatctagtaattcagttagaattaaaagggagatttatgtttctaagatgttaatgaatgcggatcaaatataccattgttttgctattttgcagaaacagtttttgttctaatcagttcctatagaaaaatttcagaaaaaaaccaaattttcaatgaacctcaaactttgtttggtttacgttttttaatgcgccgaaacttctttcgattgttccgcaggttcacggatgaatcttcagatgcaattgacgaattcggggcgatggtatctatgaatcctgttgatgtgcaacaatgtttttcattttatcagcaaaatttttctaatcttgatccaaatcaaaggtttcccattaaattagaaaatgcaatgctcactttattaaactcgtttattccatatacagttacacgacttgaagaaaaagcgcaaattacggatgaattaaaatttatttcaacaaccttaaaatttggggaatatgacaaaaaattctccaatctcattagtcaattttgtgttcagcttcttaaagttaactttcatgatgaaaattgcctcaattttatgcaaacagcattaaaaaatgacagcgttttaacgacatttgtttcacccatttatttatcagatatatttatttattgttttgatgtcaaagacaattattattcagatttaatacttgatacaattcaatcatttcaattcaaagtcacatccaaagaaaatttagaagcatttattgacgcctttcgtaggggatctgttttaaacgtatattctgctttaaaattcatcttttgtgtcactcgatcctttcatcctaattatttcattaatgagttctttccaataatatccaacaaaatctatgatcttgaatcgttagacttttttgaatattatctccaaactaacaacaaagctacatgggacttcttatgtcgctcatgttcaccatcaaaacttaacgaaaactttttaaattcaatgatttcacttttgaaccaattcaaagagaatccgttaattctcaatttccctatcggcgattttatcacaaacggaatcaacttaacgttctccacacaagaagagttattagaaataattctaaaatttactgataagaaacgactacaatttttgaagcaatgtattacaagtcaatttcattccaaaatcatttatgaaatttctaaaagtttaaatgattatgatacaattgcacagttttgtatatttgatattccaataaatgaattaaaacaaaaattagaaactgacaaagattattgtaatttattatattatatttccacgaatttaaaatcagaaaaagttataaacttaattccaatattactcaaactttcagacttaaacatctgtaaaaagtcattaaagaaaatattaaagcaaataaatccggagaaatatatcaaaatcatcaagaaatcatttaaacaaagtattattacaacagatgtctttcaaatcttaaccaaaatatcgaaagaaaatgaaaaatttgtttcattaatattaacttcctcgaaaaccataaaatatttatttagttcattccaaaacattaacgatttaacatttctaatcactataattcaaaatggaccatatgaaatcattgatgaatatattaatgaacattttaatgaaacgattttaaccaaattaaatgagaaacaattatataacttaatgatggggttaccatttgattctgaatcgattggaatattacgaattccatcattattaaaacatgtgaaaattaatgaattgttaacaccattcgatcgatatgtttatggtaaatatggaatgaaatacatcgaaaatgataatggaattgatgaatatttaatacaatacattgacgaaaacaaaaaatttgttgatatcgtaaataacacaaaattaatgttaaaaatgactgatttgaatcaatcgtttttgccaatatatcaatgccattttaatatgccgaattctttcgcaagtttcgaaggtaatgtttcgatttcgttttggttttatattaatcatttgatcggaaaaactttaatacttcaaacttctttcggtgagatatcatatgattgtgatggattaacaatattcgatttaataacaatacaatgtaatatgaaaacttggaatatgttaacattaattatggcaaatcaaaatgtgaagtgttacttgaactcaaaaagtgcaattgaattttcaataccgaaattgaattactcaatgcaattcggaagtaaaacattcaataattcaatatggtacttaaactcggaggttatctcaacaaatgaaatgtttacaccagacgaaatcagaaatttgtatttgaaaggtttacctaacgtccggaacgataaatataaaattgcaaaaattaatccgaaaaatggatttaaatttgtggattataatggaattggtaattatttatatgatgaagagtttatctttttgttgttaattggttgtcaaacgaaagaagaatttaatgatttatttgaaagttgttttaatttatatttaaagtcattaattaaaacggaatatttctattcatcaattcgatatataatgatacgaaaaaaagattttgtaacaactgatttaatcttaaaattatttattaataactttaattgtaatgattatattaatgtcttcagtgactatcaaattattacatcgattaacttcaattattcgtttttcttaaagttatttaagttaaataataactcgttaacatttttaatggatgttttaattgattgttatatcttctttgatattaataatgacttaaaacaaataattttagatataacaaaattaatgattaaaaatcatccaagtatattagaaaaattaattttatatttatctaatttcgaagataataatttatttgaaattatattaaaaaatttaaaacttttggatttcgaccgtttactatcgttctcggccgttttaactgaaaagtattcaattgcatttatcaaaaagttgacgaagaattcaatcagattgaataactacaattacaaaagtttaaaattaaataaatcgatttttattaaattaatacatgaaattgatatttggtgttgtttattatcatttttaactaatagttatgaaatgaatttagataatttcatcacacaaacatcaaaaaataataagattctaaaactcattttagatgttttagcgacgtttatcggaattgaaataaaagaaaaggcaaaagaaatgttatcatttaaaatattggaaattattttctcgattacttcatcagataaaattcttttgtgtacaaaacaaattttacgactttccgttttaggtcttgataattatccttatcaagtaataccttttaatgataatgataaaatagaacaacaaattaagtcgcagaaagaagaatataaatttaatttatcattacttcaatccttacaactcaaaaatttcgattttattaatgaatttaaagaaaataatgatgttaaagaagatgacaataatgaagaattggatattcctgatgaaatatttgaatcgaaatcaatttcattaattactaattttaatgtgaaaatattcgtctccgaattagtcgaatcattgttcatcaaaaaattgttttatgtttttacgatttttggcgcaaatgtaccatttaaagtttcattaaaaatgcacaagaaaataattttggcatttttcgacctgaaaccgaatttgacagaagatgtaatgaactctttgtttgagttcttgattttaaggattaatgaaggttggtgggaatctaaaaaagaattaaaggaattgctgctaaagtcagtgaatttgatgacgataacaaaatcaaaagtgtcaaagttattcatatttataattctgacaaaaattgactcacaaaaagttttcatttcaatgttttctcaaaaaattttcttgaattttttagcgaatgataaaacattctttttaaatatacaatatttcatttgtaaattaaataaaataaaaaaacaattaaaagatttaatggttcaaaaattaatttgtttcaaaatagaatttgtaaaccatttaaaaagtgatacattaaatcaatggtttacaaataacgatgaattgaaaaacgcatttgaagaatataatcaaaatattaaaaaattatgtatgaattcattacaattattacatcaaaaacgaatagaagttacaaaatatccaaaagtatcagcaattaatgaaaatgataaaattataattttaaatgcattaaaacaaaaacttttttatcgattaaatttaacaaattgggaaatagaaaagtctatttctaggttatttaaacttaaagcgcaatataattatatgttaaatccatcagaaaaatttatggttgtctcttctccgaaccctttatcagtgccacagaaattacttccgttggtatataacttcaattatcccgaaggcaaatttattggtaaaattcatactccgaaatcattacattcatataaatttaacacaaaattaaacgagctaaacgaagaaaagtcagctgcgctttgtttaaatggttggttcttacctccgtatgtatcaaattgtttgaaggaagtaatcaacgcgcaaattgaaaacgttacattgaataactgctattatttgccaacaaccgaaattttggagtccgtttatttcatgagcagcgacactttttacgtgttgttaaacgcgacggttgacgataacgaacgtttaattttgaatgaaaacgattcaacaatgatttgtcaatttgcagctttcgaattaccgatttatggatattatggaaattctacattattttgtcatcatccattgttatatttcaaatattctgatataatattaataattcctcggagatatgcatataaaaacgtttcaattgacatatatttaaataacggaattagccatacgatcattttcaagtcaaaaagtgatagaaggaactttgtttcaaaagtgaaaattaaggagtttacaatccctcaaaacttcggaatttcttatgctcagaaattattgtattcgtccattgaaaaagtttcgaagaaatggtccaaccgtcaaatctcaacgtttaattatttattatatttaaatgtcgtaagtggtcgatcattccgtgatctttcacaatacccaatcttcccatgggtcctgggtgactttgattcagatacgccaaagtcatcacgaaatttatcaaagccaatgggtgcacaaactgaagatcgagccaaacgttttattgacaatttcaatgagatgaactatcattatggtacccattattcccactcagcagcggttttacattacatgctccgcatcgaacctttttctctttacgaagttcacctccataacggtctcgaccaccgcgaccgtttattctgcaacatttcagaaagttggaaaagtgccagcgatttcaatcagtcagatgtcaaggaacttattccgcagttttattgtttcccaaatatgtttgaatataataacgtggttgatttgaaatgccgtacagatgggttaccattaaatactgtcattttaccaaaatgggcaaaacaatcagcagtcaaattcatatatgaaatgcggaaagcacttgagcaatcaaatgaaatacatctatggattaacttgatattcggatatcaacaaagtgggaaagaagcgattgagtcattaaatgtgtttcagccattatcatattacgaaaagttcaaaagtacggaatatgatgaaagcgaaatgaaagctgttattgacactgttaataattttggtcaatgtccgatgcaattatttaatgttcaacatattccacgacaattaattgaagtcatagatattcataattgtgaattaaatatcacaaaactaattactctaaatccgatcccaaattatattagaattaatggcgatgagataatttgctccaatttcgatttgttcgaatattcgacggattatttatacgccgctaaattaattaaccgcaaattcatttcaatcgattcaattagcggtggtttcattcaaaaaataccggttttcactttcggtaaacttcacaaattggcgttctcaagtcagcactttttggtatgcgcttcttcatttaagaagcttcttttgttcgatgcatcaaccggttatttcatcaggagcaaagaacttcctgatacaattaaacagattcagtttgatgaggtttataatatcatatttgttataactgaaaatcaaatcttcgcatttcgccttgaccttaaagaaatagcatcagcaacttacgagatacctttcaattgtatctctgcaactagttcgtcacaatggtatcgatatccatttgttatcgcgggacataatgacggtagttgctatatatggcgcataagcttcatgtctgacgtccctacttttgaaagcttgttcgttttcaaggttcaagattcttcaatatcaattatcaaaagtttcgactccgataaggctatactcgcaatgtgcgctaatggacagttattcctcgcttcagctgcaatggtaagacataagttacttcgttcaaaatatttttgcgaatgtccatgttgtggtacgaaatcgccagcaagtctcttttgctgttctgtgtgtggtctgtactgttgcaagagctgtaggataagtagaatgccaaatatatgctcgagatgcgcaaaattccaaggcgatcttattgaagagtcaagtgattcatcaaataggaaaataagaagagaaagcgtatactcagatagcattggcaatgaagtgtaagtaaatatataaaatcatgaaatagttttagtgctcactcaatttgtttgtgatatttcttgaagtttttctgtttcatcattccgaattatatttgcaattggatttggattatgtccttctttaatatgttttttatgaagttcaaaatcattttttgaaagttcttcataattttcttttatttgaagtttaaacatacagattttttaagtgattgggtttattaaaaaaacaagatgtacaaaatataaaatatatattttatgatttaatgaaatcaaattcatttcaagcattttttcaaaaataaaatttgattcttgtgagtctatattaagaaaaaaatttctaaatgttttaatcaattcaaaattttttcatttaattcattttgcttattttctatcttttgaataaaattaaaatatatatttaaatctttcatttgtgaaagaattgataaatatattattctactaagaatcacctttgaataaaatataatatcattattatctgttaaatttatgtttttactaatacaatctcgaatgttattttcactcaaatcaaaaataatttcttcatgtgatttcaaaacttgcaatgataaaatgatcgattatttatttatccatttatttttgctagtgtttgtcctcattaaactgatattaaatttacataaaatatataatataatttattcattgtattacattttattcatttaatcgacttcttccacgcgtggtcctgatgaatgtccactatttgctgatgctccacttcctccctgcatgttcgcgcctggcattccgccttgtgcgccgcctgccgcatgttgataagctgcttgcataattggcatcagtttgccttcgagttccttctgtttcgcttcgattgtagcgacgtctgcgtcttggttagactccatccatgcgagcgtgtcattgatttccttgttgattgtatccttatctgattgtgacaatgcgttagcgaactgctcttgatttaatgagttgcgtacgccgaagcagtatccttcgagtgcgttcttcgcttccactttcttacgtatttcttcatcttgtgctttgtacttctctgcgtctgcaaccattttgtcgatatctgcttgtgaaagacgtcctttctcattcttaatcgtgatcttcttcacgttacctgtcgacttatcttgtgccgaaacgttcataataccatccgcgttaacatcgaatgtaacttcaatctgtggtacgccgcgtggtgctggcggaatgcctgttaaatcgaatgtaccgagtaagttgttgtcgcatgttcgcgaacgttctccttcataaactttgattgtaactgcgggctgattatctgagaatgttgtgaagacatttgacttcttcgctggaattgttgtgttacgtggaatgagcactgtcatcattccgccagctgtttcgatacccaatgaaagtggtgcaacatctaacaacaaaatatctttcactgtgtctgatgtatcacctttgataattgctgcttggactgctgcaccgtatgcaactgcttcatcaggatcaacaccacggcatggctgcttgccattaaagaagtcttgtagcaattgctgaacacgtggaatacgtgacgaacctccaactaaaactatatcagtgacatctgacttcgacatgtttgcatcccttaaaacttgtgcgacagggttcattgttgacctgaaaagttcatcatttaagttctcgaacattgcacgtgagatgttatccataaagtcgtggccttcatataatgaatcacaaacaattgatgcggatgtggctgtggataatgttcgcttagctcgttcgcatgctgttcgtaatgtacgtaatgcacgtggcgattgccttaagtcacatttgaacttcttttggaatcgatctgcaaagtaattaaccatacgattatcaaagtcttcaccgccaagatgtgtatcgcctgctgtggcacgcacttcgaacatgccgccatcgatatcaagtaatgaaacatcaaatgtaccgccgccaagatcaaatattaaaacatgacgctctttatcggatttctcgttaagaccaaatgcaattgcggcggctgttggctcattgataatacgtaatacatttaatcctgcaataacacctgcatcttttgtggcttgacgttgaccatcgttgaaatatgctggaactgtaatgactgcatctttgactttgtctgtaagttgactttctgcaatttctttcattttacctaaaaccatagctgagatttcttctggataaaattgttttgtttcacctttccattggacttgaattctcggacgatctgcttcgccacgtacaactttaaatggccaatgttgcatatctttttgaacaactggatcactaaatttacgtccaatcatacgcttggcatcaaatactgtgtttgttggattcatggctgcttggttctttgcagcatcaccaacaagtctttcgtcttctgtaaatgcaacataagatggtgttgtacgattacccatatcatttgctataatatcaacacgattgtgtctgaaaacaccaacgcaactgtatgttgtacctaaatcaatacctatagctgacataataaaaaaatgatcttatgaaggcattttttatttgagcatttattgattcaaattatgtattcgaccatttaaagtattcaaaaaattagaaggacgtttaacacggactgccccaagaagtaatcaatcttgtaataaaactttcatgattatgttttaatttggattatattttatgtgaaattaactatattataatgaatttataaaaataacttacttttaaaaaaatcattttcatacttaaacaaaaattacttgaatacatgcaatggcaataacaagcaggcttgaataccaatttgaagcatcccaataaacgttcacaatgataacaaattcaataaaatataatacttgaaaattgtatgaaaacgtttggtaataacggtcgaatgactatttaaaattttgaattatttttaatcgttcgagctttcttctggtttatgaattcctatttcccacccaacaatgatttacacaaagtttttctagaacggcctaattccttcgactttagagggaaaaaggaaagaatagaaaagcaccagcattatcaaaatgattattatttttcagaaataagtcaaaaagatattaacctagcccttgaagcaataaaaaatagttctaatgcaatagaaataatgcctgctccgaaacaagagttaaatccagatcaatattgggattaaatgttttttccaaaagcattcgtattgtactaaccctactattttcatgtatgcaaacatcagcgatgattaagtttcattatttatcactttttattttgtatgagtaaatgtattatttttaattttttaaaaaacaagtttcatatgtttctaagttaatgtataattgatatgcttagaatagaagtgatgatttagaagatctgagcttaataaattttacacaaagatgtaatttcatcaactgtgttgttaataaaatgacaatactttcaaaattatctcattattgaaatatagcttgtttctatatgctaaattaaaataatttaactaagactataataatttaatgaaaatttaaaagcaattttttattttttcttgttggtaaaagggaatcttttttaatgaaataattacataaacttaattttgattgaagtcatcatcaaatggatcatcttgagccatattgtaaagaggattatgatgttcaatttgtacttgattttctggtacaaactcacttaccatttcagcttgtggatgtgacttagaaaatatgattagcaatgtgattaatgtaattactaatgcaataacagcagcagcaatgagtgaatatatcattattgattttttggttgactttcccttatcttttacttgccaattctcagaaataaatgattttggacttttcttatcattagaagtagaattttttgtaggaagagaatgaggaattggtgaattacttatatttaatgatctaggtattcgtgtattatttgaagtagatatggtggaaatattctcttcattcaatgtaatatacatagacttggtattaattaagttttgagcttgaatatataaagatgaaatctcaccaacattctcggcaccgtctattgcagcaacatgtacatatactcctgtttgaatttgatcatctgaaagtgggataacaggtccagttacacaatttattaaatcatcaaatgatggttttgcattatttgaaattgcatatttatatttttgcacccctgtaattgcatgaacatcgacagcatttgattgtgcaataaatatatcatttgcttcaaaataagcttcaaccatatacttatagtttgatcccaaatcagtggatttaatttttacaaattttgtccctagatcaaaatttagggaattaatgataggtgatgcgagatctcgtgatgaatgttcgattagattattatcagttgtcctttgttttaaataataaattgtgtttgcaattatttttctttcgtcttcagttgagttacaattgctatgcccggtttgaatcattgcagtgttattttttgttgtaagataaaatcctaatatatcccctatttcgttataatagattctatcattaaatgtaaaccagacatcacctgaagctgcttgatctgtagagtgagtaaaaggaatacttaatctatccccgatatcgccaatttcatatggataatctgttaataatcctttcttttgtattgaaatgttcttaccttcatcatgaaaataccttaatataatctttttaccagtttttggatcaatataataatcatcagcttgtagtattttgattccgaataaatctctgattgccactaaactttcagctttttttttatagaaatcatcagaaattatatcatgtccaactaacactccatatccttttttaatatattgactaataattcctttggctgtttctgtcttaatggaatatattccattggcatcccatgttccaaaaaccactacatcatatttataaataaaatttggatctttttccacattatcttcaaaatcattaatagaaataggttcaacaaatattaattgttttccggtttcatggtcaattccataaggatcaaattccattaattcatcgcctttttttactgtaccaccttccatccaaacttttaatgctgctgacataggtaaattatatggttttgcattattaccgaaagtaaatgtagcattgtaagttagataacctagcacatctccagagttagattttactcctttatatgaattttcaaagcttggatatacatttaatacatttacagggtttccatgttgatatgtgcttatttgtttccattctgaccatttaccatttgaattctgactcttttggaatagcttataatacactttatgttttgatagatctgtccaagtaagatgtgccagtcctttaccatatgtttgtgtgggttcaaatattgcgtttaatttaatattaatagatgatgttaaaacaataagaatcccaagcatattttaaaaaaattgcaaaaataaattaaagtaatgtttttttaaatatgttcataaaaattcttataagaattaattaagttaaaattgaataataaatcttatataatttccgacaacctagaaaaaacgaatagaaaaaaaagcttttttagtttagtatgtttatataattttatattgataacattaaaatattttgagtcaatgaaaagtgttttttctcaatttttgatatataatttgtttctctaaacaattctaagatttagtttaatatatttataaacatgttacctctatatacagattacaataaaacaaattttattttatattttaatgttggagttttattgcaaaaatcaagctatgctttgttcaacttaaaacaaagactataagaaatatcacaatacttcattttacagttcatgtatagcagaattcccaaaattgaagtatcaattcatggttggagattgataagaaagtgtgtcgacaaaacaaaaaaatcgtaatatatatattgctttctttaaaaccaaaggtaaaaagatataataaaacaaatgagaattttatcatcataaattgataatcacttcttcaacatatgaagtttactcacaataatgatcataaaagaaaattctttgtgaggaagcatatataaattctttatgaggaacaatatttaaaaaatatttgtatagttcacattcctccaataaataaaattttcatataaaatatttattaacttatttcaacagaagaagtttattcatcttcaatgttgttattgttgtatttctttttatgacgtataaccaaaacaacaacaacaactgacgcacagatgcacactgcatttgcagccttgttgtttaagcttttagctgagccatgtccattgaatttacacttttaatatttggctaaactctttcatgtactcctttcacgagcagctcgtgtccgcataagtttaactcttgagcgcatctttcgcattttgctttagtttaatgattgagtcaattgattctttgtgatttgcattgttaattctttttccatagttctttttattttattcactaaggtatgtcaatgatttaaaatgttgtcattacttcttatttgatgtatctttaagttcttcatctttagctttggcttcttctataattgaaccataatacttagtaaatacattttcttctgaataaaaatatctttaattggttcttgttcagtaattacgatatttattataaacctaaattttaggacagtaaaagtgacggcagttgtaacggttatggtctttctttcagacccaatgccagctaattttgttccaaaacacaaccgtgagcatgctaaaggctctttcgaacgtggctgccgctgctgccaacgtcgtcgtggtgttatccgtagctatggaattaacatgtgcagaagatgtttccgcgaacgtgctcatctccttggattcaagaaatatgactaaacagaccaattactaggcattccgttcttattattttctgatctttttttattattttatttcatgaaataattcttgatatcaataattcttttttatttctaacaattttatgtttttaaaagcttgctttaaaatacatttttttggaaaacgaattgaattttcaagaaaaacatttgttatctgtaacttataatgttttatttaaacttttctgaattatatcaatattaattttgatgaaattttgctcaaagttttcaaggctgaacttttgggattcttttctgaatcttattctgacatcatctgaatgatcatttagagctctttccaacttttcaacatactcatcgcatgtcaatgccaaataatttgtgtccttaacaatatccataagagggcctgcgcttctattagaaattggaatcaatccagctgccatatattcaacaacacaaataccgaaatgttcatcacgcattgtgtgaagtccaatatctgctttcctaagtaattgtttcagctgttcatatggaacatttggacataattcaactttcagctttttttcgtctatcaccttttgtaaatcattcaataataaacggtctatttcatttctacaaccgccgacgataaccaaatgagctttttcattaattttggaaagcttttccataatttctaactgtaagaaataatttttttcaggacggaattgcccaacactcaaaatgaatcctttttcacgattttctattgggaattctccaaattgtctacaatcacatggaggataaagaattacaggctttttcccatagatagactcaatgtgatttgatgtccatgttgaatttaccattgttatatccatgaacttacttgttaacgaatagaagaaacataatatgcgataataaagaatcttaatatttgttaaaaatgatgactttgcgatttcttgatcattgttgaatgacgtttcattactttttacttttgagagcatgtctgttgaaatgtatggataatgaatataaaaaataacagtacagccaccaaagagtttccaaacaaaggaagcaaatggtgcaccagtagtgtctataacaacacttggaacttctttcattagacacttaaatacatatacaatagaacttaatgcttgcattattaaagtaaatctgggatacctgcctggctttatgaaatcagctgttcctacgtttataaatcgtaagtgagaaggaattaccatatcgaaactcttgaatattttttcttttgcttggtcatatgtacattcttgggaataaattgcaatatctatgtttttatctttaagagaatcaacagcagcccagagaacgcgttctcctcctgcacaatcaagacaatttggatggaagaaaactaccgaatttttcttttttcgacggaaatataaagctgccattatagaaagaataattggaagtaataaaacacatattaatataatcatgtttcaagtatttgtccagaagctaacaaaacaaagatagtcaattacctccttttacaaaaagaaaaatttttccaaatgaaagcacctgcaccaggattattccaatacgaccaaattgttcacagaaatgcacttaagtttgatgatgatttatgttgttcagttacattatctacaaaaaacatctatgtatgtttaacatgtggaaaaccatttagtggcggatcttcaacatctccactaactcaacattttgttgagaaattccacccattagcaatcagaatgagtgatacagaaattgtagttcttccaaattatgatgttttaccagatgttccagaacttcaagacattagatttacagcgcatccagtttacacacaaaaaacaatagctttcatgcatgaaaagatgaaaaatggcggagaaattattccaggtgcacttgggttagagacactcaaaccaacacatgcgcaaatttcagtaattcgttttatttcatgtattgatccacttcgtgattattttcttttaaaagattttgatgtaccgatattaaaagaattttcaaccttcttcaagaacttctttaatccatatttttacaagaaacagatttccccttctaagctctttcgctcgcttcctgagattgatgatccattcaatttcctatcggtcattttaaacgagctcaacaacaaatttgggaaaaataatcttttaagtactctatcacgagggcttttaaacattgagaagtatgaagatgcaggccattggaaatcaagcaaacgaaagatttggattcttccacttgaaatcactgattccccattatatcgttctggtctagaaaaagagaaaattattccgcaaacagaattaactgagcttttaatacggtataatggtgttacaattactgagacaccaattggtgatgggaaagtcgaacgtaagaaaatgaaaatgtgtaatgcgccaagttatttaataataagtataaatagaattaagaaaaatgagtttaatcttgagaaaagtaatatgcatgtgatattaccaagagaggcattaaacatgagcgaatatggtattaatggtgagtataaagtgagagctataatttcgcatgaaggaacgccgaatgatgggcaatacttaacatacataaggaataaagacgctggaaattggataaaatgcggaactatagacgtgaatgagacgattgaagatgtcgcatttttgtcgcaagcgtgctttttacttatggagaaaatttaataaatgtttacatctttttgtttattccatttaatctcatttgaaccttcattaataattataataatgaaaatgattttaattttttgaagaaatcaaaattaaaaaacatttattaaagcaaacaaaactgaaattctttattttttttattcatgaatttttttcaagaatataaaatgaagagaattaactgtaaaaaagttataaaacagtattacaatttcaaaaataaaagaataaaagtattttattataggaagaaaacaaaagaaataaaatcaagcattgtttgttaatgcttgctgtatttgatttaatgcattatcgagatcttcaatggaatttgattgtatttcatgaatcatgttagcaggaaagtcttcgataacttcatcaagaattgttctgaaaatttctgcttcgacattttcgcgaattttatcttcactatatccacgggcagcgagtcgcttccaaagtaaatctgattcacaacgaagtacaagcacgaagtcaagattttcaatatcaacaacgtcagaacagtgaaaatcaaatactataccaccttctggatgacttgcaatgatattgttcaattcggcttcgaggaggttttcgtcataaattgtgcaatcgcgctcttcatcttgttcagtccaaagatggttatcacgaattaattgactgattggcacatgaagtaaaccaaacctagatgccaacattgatgaaaatgttgttttgccgacaccaggagttcctgtaacaagaaagtttggttttgttctttgcatggattttacccggccacagaatttgccattattaatttgagtgaaaataaaatgacatttttgaaattttatgcaaaaaaatataaataactcagattctttcaacaatgaaaatgatacaactagttcagatttttcagcagccagcagtgaattaattgactcgtttgtacaaagaaaaaacacaaattcaaaaaatgtaataacaaaaattaatcaacaacaagaccctgaactttggattgagtaccaaaccttaagagatgaaaatgaacagctaaaaaataaattagaaattttgagaaaaaaactccaagaaatcactcaagaaaatgaatcacttctgttgattttggagaagagcttaaagcttcgatatcactataagaaaaaactacagaaatgaaaattatgataatttgcaatcaatataattttacaaaaacaccaatgggatatgacaacttcatcagcacgatgaagaagttcgaatttttcatgattttcataataaataaatctaaagaagatattccatgacataattctttactcttatctctaacgtttcttaaacatattggcaaaataacatttgtgccatttagtaaacaggatcaatattcgaccaattgtttgttgtaaatgaaccaatgctatagctgtaattatcgaaacaataatctcctccatcatcaatttcgatgttgtcttctagcacgaatggtgagtcgttttcggtactctttatgattggaaccataacaggtgattccttttcatacctattattaacagctatccatggtctgagttgatgtggcatgtggtcagctagtgttcttttagatctagactttgaagatgctgaattttcaacgtgtttgcaaattgcatgtaaattttgaatattaatcgaaaaagattcattacaatttgtgcaggttagaagaaaagattttgttccaaggctactatgtaaaacttctgatggagaatttattaaaattccttccattttaataacaaactgtgtatcatcatgttggctgtttgttactccagagcctctagagactataaattttatatttccgcatttgcaggattcttgagtcgctgacattaactgtggttcgtcttcacaaaatcgttctctcaaaattatgctcacaaaattgaatgcatgtgattgtatcggcacaattttgtgaggagaaaaaaaaaaacaaaataatcgctgttgactcaatttgtattaaaatctgtactcgacaaatttgtcatcataaaatgtttaaacacgttcccattaattaaaggcgacataatagtttttatatattcaactaaattgcttatttatttttatcattgttaaacaattcattttgttgagtgcactcaacaagtttcatcatctatttgtttataaatttcctttctttgattacaaatgaaaaacatttatgaatataaattctttaagtataaaaataacagatgaatgacttaaatgatgttgagtttttcgattttcttcttctttactgaaaagtgccataacaggaaatgaatgcaatttgatcgtttagcacgtttgtcatcctctttgctgtcaaatttttttataaatacttagatgattggctggcctatttttcgttttatttcatttccactaacatttcttttcccaggttatcgttcattcattgctgttgtaagtgaaggttcagatgatgattttagatggctctgctattggttggtttgcgcattccttttattaatcgaagctgctgcatctttcttacttaacacaattcctttttattacgaattaaaatgcattttcttactatttttacaatatgataccgcaaaattagcagaagatatatataacaaatttttgggtcctgcaatcaaacactatgaaccagctttggataagttcattgcttcttattctcaacaagccgaaaagatcaaacatactgcaaaatctcaagttgcagacgcagcaattaaatatgcattaaataactaaacaagcacaacttttatgaatgatgtttttatcttataagacaagtgcacatgtgaaatttgattctgtcaataaaaaatttcaatctgaaaagaaaaataaaactatttcaaaatatttgttggtaaaatcattattttacatgttgaacttctgattttaatttcatcttttccccaatcatgtgcaaaaataacaaagcattttacgagaatttatacaaaattttaatatgcgtttcggattgtttaatattattaaaagtaaatccattccgagaaaggtattgatttgaagaatttctgaaaccttgtttgaatttcgctttggtcaagcagataaaataagcaatgtctcaaaacaaagatatacacaagatgctcgttaaagagctcaaagaaaagctaaccgaacttggtgttgaaccatcgacatttgctaaactcaaaaaagctcaattagtcaaattacttgaagagaaactcgcagaggaaacagccgaagaaagcgaagaagaaccagctcctgaaactaacgaagaacctcatgaagaaaataaaggcgacatcccaccatctttacctcctgcatctgatgaaaataaaggcgacatcccaccatctttaccacctgcacctgaagaaaataataacgatattccacctccattacctccaacacctgcagctatttccgaacccgtcaaaataagttcaataatcagtccattccagtcaaaatctcaaaacacatccgaagaaaagaatggcccacccaagggcatgaacttccaatttgatcttgcccatttaacagcacttgatcccaatcattattcccaatccgatgttcaagattccaatcttcttttacaaatggccacttcctctctcaaccaactatttgcgcaactcaattcactcgaacgcgagggagataaccgcgtcaaacttcccaatgatgtcattagtcttccacgatctcagccaattccaaccgagaaagtcatgacgcgttgggaagctttcaagaaagagaaagggctcaagacacaagcgaaagagaaaattgtccaagatgaagccacaggcgaatggcgccttcgctatggctacaaacgcgcgaacgcgccaaaccaagattggctgatcgaagttcctaatggttatgaaggcgatccattcgagaagcgcgagaacaaacgaaaggagagcatcaaagagcaaaagaagagagaacgaaggaacaaaaatagaatcgcaagagcgaagttggacatttcgaacgtgtctgctaaaggaagttatactaaggaaactataagaactgcaattaaggcttcagaacacccaacgtcatcagcgtcaatgaaccaatttaacaagctggagaataagccgccaatattcgaggaaggaagtaagctgccgaagatattcgatagaaataaaggaaaaaagaaaaatggaagaaaatagaactaaataaaagaaaaagtaataaatttattttgtgtatgtttaagctcactcacagatcaaatcttcttatgggtggcaacatgaaacggatgatcaaaataaaatgagcaaaaactctctgcgtgaattatttttttttcttttgtcttatttttattgatttgctgtttgtgtttattctatcgttctctatcgtgctttctattttttggaattagtcgaaaaattttcaaaataattcataagaacaaaaatattataataaaacatttaacaaaaacattattgaagttgaatcattcaatcgagaaactatcacaaaggatagtcaatgataacctttcattcatgtgattcatattctggcgtttcggttgagacaaaacaagtatgtttaaatatttcacatattaaatgtaagaagatattaaatatttatcgtaagattggaatatatggcgaaccagtgacgtactttaataacttttgtatatttaatttattacatcgaataacattttctttaagttttcagattattttgtattatgtttgcaatcttcgatatcaattttaccttctctcgtgatttaattcatttgtattaaacattctgcttttaatattatacaatagaatcatttaggaagcgttcgagttgttatttaacatttttaataaatatgaaattaattacttcttcgatatacatttttattttcgtttgctaaccattttcaacaacttcgaattcattgatagtgaaatttaaataaagatcatctgctgagtttgaagttaaccatttcattgatttaataaacaatcaactcaacttttttattaagaatttgatttaaattgcatttataaagtttcatttcgattaaataaatctccttaaatgtgtcattaaagatatcttcgagtaatgttctataagtcaccatctgtttcaccgctataactaccaaattattaaagaaacattacaagttttgcgataatttccttattcgcgaatctcaatgtataatacatacaatacgaagcgttactcaactcttgtagagttaacaagtcaggtgttaatattgcgtagataatttggtttaaaattttattaaaacatattaaaaattattaaaacatattataaattattcaaatgaatagtttttgcattaacatcaatcccttctttatctaaaagtaattttacgatttctatattattatttctaactgctatatgaagtgctgtttcaaattattaaaacatattttaaattatcaaaacatattacgaatcattaaatcatatttcaaattattaaaacatattttaaattattaaaacatattccaaattattaaaacataatatgttatttgctttttaacttgtatagatggctcaaataaatttgttatgatgtttgatttgagacatgtgatgtgaaacattaatgaagccaccaaatgatccgcatttcctgactccagatggaaaagaaaaattaaaagtgatacttgaagagtcagatgacccaatgagttttattgaatctcttcatcattgcgaacattatgatttttctcaatattcaaaagtttttcaaattggagattttagtggatttgacgcttcaaggatatttgaaaaatatatcgaacagcaacaccaaacaatcaaaaataagataagtacactatatcctgatcaattgaaagagttactcaaacaacttcagcaatattcagatattcctatcttccatgacctcatcaaggatgttcttgcacggatgcgcgaagttcctaagtggtttgaaattccagaatcaatcaaatcagatttatcacctccagatcaactcagagttttttctgatcaacccaaagaatttaagctttggcttgagtccgtttttaatgagagtatgtgtaatttccaagaagttgatgatttctcatatcttcatttattccaacaaatttcagagttctgttttcataagcgacaaatgtatcaaatagttgtcaacttttgcgagaagaaatttttagaaacatatcatcccatctattgtgtgatcaggattcgtctatcgctttacaattcccctctttcccgtatagattctgcgcgtcctctctcgtatttggtcacgaaggccgtcagcggcgattgcgaggtgaatttcactgagattgaaaaggcggcgaccgtttgcggcgcatcatctcaaattgttttgtcacttccgaactttacgatgaaatatcccattaaagattatataaaagcatttggtgttacgccacgagacaaaatgatttggtcgaaacatttgaatactggaaattcagatgcggttgattttatgaaaagaactccttttttcgctcgtatcatagggatatcagtgattcaaggaataaagctgaatggcgatcttttcatcacgttaaaggattgccagcctcaatgcgacgttgcatatttcatgtgcagaagatacaaaaccgaaaacgattcaattttgagagagtgggcctcaaaaagtggatcggtgttcatcgactatttgacactttgtatatcgaagaaaatgaaattaccggatatacaagtgccggaactaacaaaagaacaagaggctatttataacgcctttttgcaaaaatgatttttgcgtttaatttgtttgaaattatatcaataaaaatttttcgaatatattatcaaatacgaaatttattaaaatagtaatgcgacgttttaagaaattatataaaatatgtaatttgtatgttatgtaaatagtttgtgttgcacagtaattttatctgtgaatgtgttcaccagatgcaaagagatttttattatacttaaaagttatttattgatagacttgtagttgaactaaaatcacttaaacatcactatgcgcagtgttcttacataaaaaaatatgtttttcataagcattaaggaatttaaacttctgttttttctggttacgtgtttaacttgcgtgtgcaaattatagctgcgtaatattatgtaaagaatttttttttgatattcttattggcaaaagcttacgatctgttgaatataaatggaaattggcgtatttagaggttacgcacgaagagcaaagataatatgttgaatttttttgagaataagaaaatgtagcgaatttgaacacatttgcctgaaaacattttctagttatggatctacatgatgtttgcatttgcatatattgtaaaatgtcataaaaaatagatatttgtaaacgatatgtttttttaatacatgaaataggtagcactgaactcgaagatagtagtaatgtgatgtgattgccttaaaattgcaagaattattgaatattaacatttttttgatatatgtaaaagtatcattttacatcattcaacaggtcgtataattaagaccgaatcacccgcggcatgcttattatatgcatttttctctaaaacaatccgattccaagtttttgttcaataaagatcgggatttttttaacaaaagtttggatggaatcactcacaaattgtattcaaagttcaatcaatttttgagagcaatttgcggttattggttctggtcattcgaattgaataatgttctttcaacattaattccgcttttctgataaagatattggaaacaaaaagcatttttacacaattgtgacaactcctagaaaattctttaaaaagcctctcaagcgacacagtcacagttgttgagttgttagcttacgaagattttgttattgtctgcacgttattttttgtgtttgtttaaacttctgcattcaaaaagtaaatttttctaggttaattgcatcgtttccgttcaatttttaaactgaaaatacattctggaacggtttttttctgggaattgtcaaattgttcaatcttgccagaacttctgatgctcttaaatcaatcgcctcaaattaccctcacagagatccaagaaatcctcccagagcaccactatcattttacaagggctataggggttggaggctttggctcagtgtttctggtgaggtctgataaatataatcaagatttttgcatcaaaagaataaaacaaaaagagccagcattcgaccaaacaaaaaacgaagcggaaacattaattcgattatgtcacccaaacatcatatcaatgtatgaatttttctttgatgaaacacggacatatttgtacattgtactcgagtattgcaaaggcggctctttaaaagatttggtacaaaaagaaggtccgataaagccaccaaagttatattcatattgttaccaaataatgaatgcattgtttcattgccatgaacaaaacgttgcacatagagacataaagcctgcaaacattcttctcgacagttacggaagaacaaaactcgcagacttcggtctcagtaaaaagtttgaaaaaggagaagttctaaagagttgtgctggttcacgacctttcatggcaccagagattatcaatggccaaaataatgacccatttttggcagacatttggtcgctgggaataacgttttatacaatcgcattcggaaaacttccgtggaaagttcacgacgttgatgaaatggaaaacgctattagcttagggattttcacctttccttcttatgctgagccagggttttgtcagctaattcgatcgatgacagctgtgaacccaaagaaaagagaaccattagcaaaattacttcgatctccaatttttgatagcattaaaaagtataattattcttcactacctcaaacacagagtgaacgttcgtatagaaaatcaacttcatttcttccgtcatctgtatcacataatagaattatcagtaataggattaataacaattcttttttgttgaagaagccagaggtaaagaggacaccagtgataccgaaaatttttccattttaatgtttgaataaatcatgctatatgtttgattgtaatttttccattaaattaaaccttgaaacaagatcgcttagatcaaagaaataatggtcatcaagtattatctaattgtgttgattaattgcaataataattatctattatgatgactaacttcttggattttggaaaaaatctatatcatgaaattaagatctatgtgggcaatataaatcataaaactgatcaagagctgaatgcatcgatcatccgatgctcgatttttgtgtccttctgttgtggttgtccgtgaatttctgtggtaggagggcaaatttgaatgattttaccagcagattttgaaaattgtgagtggtgaactgatataatctaattttgaatttgttgacagaggaatttgagttaatgtcatttttgtttagggctcaaattcaaaccgaaaatgtaaccacacccaattcagttttgctttttcaaagcttttcaatcatgtgggtaaacaataaagaaacttgacccgattataatcgtgtttagtttttataaaatcattttcatgtaaccaagcaaaaaggaacgccctggaagagacaattttggttataaagaagaaaagatttatgtccttcaaatgatcagtaatcagaaataatttttgataatttgatgacttattcaaggattggagttcattatacgaagagtaaaacgctatatatcttttaatgatgtattagttctttactccactagagtttttatccaaacataaaacaaagataatcatgctgttcatctttaagcttgctgcgtctgcagtcggttttaataagtgtaatggaagataagggaatataattatcttaaaatattatttgacttatataagctaaatattactacacacttactggtaaaggattgcggttctgttatttaataaattttgtagaaaagtattgctttaatcccataattataaatataaaaaaaatacaagatttaagaacgttgaacggatcatcaaagttaagagtttcttatgaataagctgttcataaatttaaattttcgtaaatttttgttggtaaaagccatgttcacgcaatagaagattgttttagtcaaatgacccaacgcgttaaaagattttcatctgtttgaatttttactgtttttttttggggttgaccaaattacaatttaatttagatatttgaatacatcgtaaactttttaaagttttcgtttcccaatggccgctcattaacctcgtatctatacatatcgggtttttttatccatgtgaagtaaacggcataaaaattaactttttcaatacggtaccgttggaaacgctgcgaaaagtttggtataccaccaagcgttctaacccaacatatgaacaaaaaattaacaattactgtttcttccaaaggtatgttcatatgttccttttatgtgtaaagcagttatctggttccatctctattcgaactttttaattaaaccactgctaagaataattttttgaaattttcacttctcaagcctttttaaaaagcaaatcaatacaaacattgtaaatgcttgtaacaaattttgttaatttttttcttttgacaagaatccatacttttcatgaaaaaattaacaacttaacagaaatttttactattccataataaacatttagcagcatttctcctgaaaaaaactcattcaacattgtatttgaggcacccttgttttgaacgttaatttactcgttaattgaataaagcattcaactgccattttccaagatgacaaaccctaaagtttggcttaatgtgtttgattaaattctaattttagatcttttaatggcacgaaaaatggaaaaattgtgatagaactttttgcagatagagttccacgaacggcggaaaatttcagaatgttatgcacaggagaaaaaggcgttggaagatccggagcaaaactacactataaaggatgtaaattccataaaatcatacctaattttataattcaatctggtgacttcatatcaaatgatggaagtcaaaatgaaagtatatatggtccacggtttgaagacgaaaactttgcaatcaagcacgaccaaccaggaattgtttcaatggcaaacaatggaagaaatactaatggaagtcaattcttcattactttggtgaaagcgcaatggcttgacaatcactatgttgcatttggtaaggttgtagagggaatggacgttgttgaagcaatacaggctgctggatcaagcaatggtgttcccaaacaaaacattgtaatttctgattgtggtgaagtttgaaataaacaaaatattcacaatgttgttcattgttgtaatggaaataacttatcacttgcttcattaaatccaatttttttttaattaaaatatttttctgcaaatattttcgtataatcatgtttacggaaacacaatgcaacatgctctttagtgtgatttttattataatttttttttttttttgaatttgatttaaatcaagaatttattttgtaatctcataataagaaaaattgatatagaagtagattttctattagtatcaaagcgataacaagaaaaattaattacattacaaaattagaattaattctaataaatacaatttcaaaaaaaaaaaaaaaccttgtttgatatatatataattattcagtaattatgatttactgagcagccttagctttcttttctctcattctgcgacttctggcacgacgagcagcgatttgttgttgaaggttcttttctctttcattttctactttaagtgtgtgaatatgttccattaaaacgcgtttgttacggaattcattacctttagctttgagatataatttgcgatataagtgggaatcgatttcctttttctgtttgaagtccctgagtgtgcgacggagaacgcggatacgacggatccattgccactttgaattaagacgggcattacgtgtaccacggcgcttaccatagcccctatgacgaccaaggcgcttagcaagaacgcgcttggtatggcgagcgctagaatgcatggcaactgggcgacgaacaatgattccatcaccaacaagctttctgatctgttgacgtgagtttgccattgcgatagtggaaatttctgtctcatccatccaaacacggccaacgccacagttgaggactgatgctgctaatctcttctgaagtttgaggcttgacatctttccaaaagggggacttggtcgttcaaaaccgtagtaaccgattgttgacaagtgttgacaaaagcattattgaaacatttttgatctgaaagtacacaattccgactttttgttgaatgtatgtatcgttcataataatgtgttaattttgatcgtttctcaagtatttgataactttatgaaaatttgtttttttctttcgtcacattaccttgcaattatctcgcttttatgtcattgcaaaatgaagaagaaaaaattcattttattttgcaaaaagttttaatgatatcacttaattatattgacaaattccaatttatgtgttctgcgttacataacatttatattccagacaataatccgactcgtggagtagatttttataaatttcagaacaacttccttggagaaaatatagaaatatgtttttatgacacaagtggccaagaattatatgggaaattccgtaaaataatatcagaagacgcaaaggcaataatgcttttatacaactcatcttcacggtatagttttatgcatatttgtgaaacaataaaaaatactccatggtccgatgcaccaaatgttcaaggaagttttttcataattgcaataaattcaacaaatgataaggttgaagttccatcttcagaagggaaaaacttagcaagttcaaacaatatgatttttttagaagcaactccatcatttccgcaaacatgtcgatatgttattgataagattggcgaccaccttgcatcaaagcttctcaaggatgatatatccaatgattttgtaataagtaatgtacaaaatctagaagacaatgataatacatatcaaagaaattcttattgttcaatagaataaaaaatcaaaaaaaaattatgtataaaatgttataagtatcagtaaatatatgtttctttagaaaagaatttttgatatttataagacttgctcaactgaaagaaaaatagaaagttgtttagaaataaaatatctgttttgatgataaggtgtaacattaagtttgtaattaattacttttccatttttcaaaagaatacaacataaagcatttttaaaaagaaatgaattaaatataataaaatttaatatgatactaaacaatccaaattaaatgtttatttgattataatgcttaacatttaaagatttaataaatacaatcttgtaaagaatatcttcattcattccaacgacataaaggaaaaattggtaataactcaaaaaacattatgcatttcagctgaaatcaaagagtgaacgataaaaagcatttataattattaaaactggttgatcgagaaaatttgcattaagtggaatatttcatatttagcatacaatataattcagattgataaataaactcattttgtacaagttagcaataggtattttacgagtagcaaaaaattaatgaaatgtcataagcaaaatcttcactttgcacaactgctgtgatgtattgaaaaaatttgaattgaaaatttccctcaaaatttcgttgaaaatacgttagtccgttgaaacctaccagcaatgaaaggtgttgtgcaatggattgccgatgtggctttacggccagctcgggcgtcctatgatgtcaacaatactgttacagttgttcaatccgcagaaaatcatgtttatagaagaattccagtaacatttaaaaattccaaatcgcttactttatatgggagtctttggcatgacatagacaatgaaaccccaactgtgtgtatgatttttcttcattctcttggtaataatcaatttgaagctttaaatttgattccatttctttgcacgcctgaccttgcaatgttttgttttgatttcactggaagcggcaattcggagggagacttcataccaatcctttgtcatggatttgaagatgtccttgcagcttcaaattttattcgctcagaattccatattactaaaattggtttatggggccgatctttaggggcagccataggtcttaacacagtatctgcatccaataattttttttgttttatatcagattcagctttttcatcaatctatgacattgtatatgaccatgctcgaaagtatgggattccctccttctttatgaagtttattgagccacttcttatccgcgaggctcgaaatgtcattggagatgaagtcgatattaattatccacttcgagatataccatgcgccagagttccactacttatgggccatggcaaatccgatacttttgttcctctagctgagggaaaagcaatttttgacaaatacggatgtcaagaaaaacagttttacattttttgtgggaaacataattctcctcgtccaaggcaatggtacgaaacagctgcacgctttatttatcggcatgccggaattcgatttcccgtaagaaattatgattcggaactaagaaattcttttcttcacgtgggcgatcccgaaagaattatacaggcaataactttaatataattattttgttagtaaataaattagaatataaatttataatttttttgatgtttattgttttcattccttttttaatgtgaattataaatatttttttttatgcaaagtatttaatctttattgatttaatgcatatacaacattgcaatgtctttctttcttatgtactgatttgaaattttattaatttcattaggatgaaattatttatataagttaaataccattaaatgcatcagttccaaattttgcttgaataccaattggtaaagatgaattgcattagtttacaacatttatgaagtcatttagtgcagaataaacaaataaattctaatacatattttttttttaatattacattgaatttattgggaaaaaacttatgcataaacatcttataaaacattttaaataaatatataaatatatatcataaaatcaattttatcaaattttttaaaacaacatataaaatttgtgttccaaaatgtttttactatgctctcgaaaatatttataaggaacatgttacttgatgaacagagcaataattaatgcaatagccaaaaccatatagtaaatctttatgtttgatttgtttccatttggtggtcgtggttgttctggatctatatgttgtggttgttctggatctatatgttgtggttgttctggatctatatattgtggttgttctggatctatatgttgtggttgttctggatctatatattgtggttgttctggatctatctgttgtgtcgtttgatcaaataaagcaaactttgcagcagctccataagatacaacctcttcaaatttcacatcatcaagtacaggcagctctttttcaaaaaagtcttttagcttattccttatttctgctatatttgatgaaccaccagcaaggagaatttcattaacgttctcctttgaaattttggtggtttctaagaatttactaacggtctctataatgccgttgaacatcttttcgcaaacatttttgaattgctcatatttaacagttatatgactaccaaatgactttccttggaaagttgcacgaaagcttgaatcccgctcattactaagagtaattttaacattttcggaattcttctttatgatgtcaatgtctccatcagataaattctgcttctgccttccaaaattatttttgatcaaatctacaattaatgaatctatgacatcgctattgatggttggaaattcttcgctagctaagattttgcagttttcagcattctcatcaacatatacaagggataaattaagtgttattccaaagtcaaaaatcaggacagttttcttatcttggatttttttttgatataagtaagcaagagctacagcaattggactttgtacaacatcaataaacgtaaattcagcttgttctgccatttgttttataagttcaattttatcatctttatatgaagctggaactgctataataacagcattttcataatgactatccttaatcattgactctaagcatttgatgtaaatgtcttttggagtgaatgtttttttttcatcatctatctcaatttcaaaaatctcttcgctaccaatttttcgaacgaaatcagatatcacactatttgagccatattcgtttggaatgccaaaaacatatttataattgtcacctttcttcttcttcttgatcacaacattggtaggctttgtttttttgttaaaatcaacgcttaatacggtgactttgttctcttccttagcataaacactgatacaacttgttgagttacctatatcaattccaagacaatctgagatcattgcaaaaaaaaaaaatgccgttttgaatgtaaaaaataaagatcacaaaacgtttacaattttcagagatttatttaaaatcgattattctttttggcaattataaaaaataatttacttgaattcaagaaaaatctcctcaatcaacttctgcttagttttttatagagcactaaattcaatattttcgtgtaagtatgatctatcaacaattcccaacaaaatttatgtaatcactaacgagcataaattaaatgcacataaaaaacgttttaatagtattataaaattataaaatgtttaataatatatttgatatatttaaaagttaaaaaaagtaattaaaacatattaaaaaaaaatagaaaatttgaaatgtttaatggagtttgtatccaaatttacggagaagttgcatacgtccttccttatcctcagctgtttcaacaccttttggcgcaaaaccatcaattacgcccattacaccacggccttgttctgatttggcaacaacaacctgaagtgggttagctgtagcagcaaaaagtgtaactatttcggggacgttacgaagtgattgtaagacattaattgggaagacatttttcaagaaaattataaatgtgtgtccgcatccaattttttgagcattctttgttgcaagatctactaactcagggtcatttccttctgtgcggatgagacatggaccacttgcttcgcaaaatgcaagaccaaactttattccaggagctgattgaataagtgtttcataaatatcttcaacagtcttaataaagtgtgattgcccaaaaataaggttgagttcttctgggttttcaacttgaactagctcaaatgagacagccatatccaaagtgaaatacggttaaaagtgccatcaaaaccgtttaatatttaatacattttatcacatacagaaaatcctaatttgaaatgaaattagaaaatgatatcatttccgaagataaaatcaaatgacaagtattttcagaatatttatgtcatagattttttttacaattaaaattcgatcaaaatttcaaccttgaatataatttgatttttcttagcttaagcatttatctaatagcaaatatataaagaataatactttaatcagaaaaacatctttatatatattctaagcaatttatttataaaaaaaactaaaattccgcttaatataaaaagtggaaattcaaatctgaaaaagtttccaacgtattacgatacgtatcgtaaaatcgatttttaacgctttacacaaatgtgacacttcattcaggggaataatacttccaaatacacacagttccttcgccgctacaagatgcaaagcatcttagactaggatgatgtgcaataccgaaaattgtgtcttgatgaactttaattccacataattgttcaccagttttttgttcccaaattctaattgtttgatcttttgatcccgaaaataccaaattttcaaaaggtgaaaacgtaacaactaaagggaagtttttgtgtccctccaaagtatgccttaacgttgcaattccatgaagagaccaaattttaattgtattatcttttgaagatgttgcaatatcattattgcacggcgatacagcgatagttagtaatgtttgttggtgggcaggataactcatcatcggttgttcaaatttgttatcatatatcccaatccttccattagcaaacccaacagcataaaatgaaaactttgtagatgttactacacgtgatattattccatttggtgcattatcaccatgttcaagatgtttcactaattcatatgaattgaggtcccaaacgtttatataaccgtcaaaaccggcggttattaacgtattctcctttgaaccgaagatgatggagtttacatccttccgatggccatgaaacgtgtgtaaaaggcctttggttccaatgtcatacaataaaatggtgtagttagggccactaactgcaatatatttatcgttgggtgaaaattgtataacacgtgcataataaggattgattccatcagatggaggaagagatatgctttttatgaggaagccatcttcgggttcgacaataaaaatatttttactatcactaaaagcaagaatagagccatcatttgaaaattgtatggaacagattgtggtttgagtcgtacgaagagtatgcttaagggagactttattgccgaaaaagccattagataatgaataaatttgaggagttatcacaatgctgctaagtttttgttcgctttgagatgatgatggtggtgatgtaggagaatgagatggtgtaggagaaggagatggtacgtgttctttctcatcaaccacttctgtctcttttatctgttttttgcccaaatagttttcaagatcttttctttcatcaacacttaatatgtattttatacgaattttgttgtaaacttcatgaagtctttcgtattcttcatcacactgctgtaatcgaatttcataatttgtgcgtattttttcaagtcgaaaataatcttcttttaaagcattaatattttgttttgcaattgcaatctttctagcaatggaatcaattttttcaaggtcctcatttttgggaaattttactggtattgtttcatttttgtttgggtttgattccatccccaaaaatggtttggagaatattgacactttttgcgaaacctgccaaaatgtttctgatcatgtaaacggctgctatgctcatattgtgctttcaatgcgaacaccaatgtaatttaatgtttaactaacaaaagctttagcgtttgctaaaaaataaaatctagaatatatatttgccgttttaatatttttatagtttcttttgtgtgtgattttagaagaatttgatttttgtacgttaaagtgaaaaatgtttggaaaaggttcttcaatttctttgtgtggcaacagcaacaacaaagttctaaggcttgcacaaaaagcaaatgctgaaacaattttgaacaccaaagcattacttaaaataattcagaataatcaatcatttcctccaaagcacagagttattgtttggagatatattctccaaataccgatgaatgaaaatgcatatatgacattagctcaacaaccaattcattcttcaatttgttcttttccacaacaattaccaataagatttggctcaatttcaaagcgcttcatgcgtactctttcatgtcttgcatattggcatcctccacttgcagaatgtgattggcttccatctcttgttttcccatttctcatgttatttgggcgagattcaatcattgtttttgaagttatagccactgtcatatacaattggtgtcaagaatggatatcatttgtaccaaatcctccagttaaaattctttctcggatttctcgaatttgtcatgattttggtgagactgtatcaccaacacttatatggccagttcttcgcagtttttttggtgaagtttccaccactgattcagcgctaatattactcgataatattctttcatcacgtccatcttttattgagtaccttatttcatcatattttattttacacgttgatcttgttactgaaacaaatgtatattctatcattaaaaaggcaaaacaaatttataaaaaagatattataaataatcctgatacatctgaatttaagccattaccaaaagatttttatccagttttaatagttgtaaagaaatcaaaacgatggaaagaaaaagagttggaaagaattcgtttagaagcagaaactagaaaaagacaaacagaaatcaaaaaagaagttaaaaaagaaacagaacaaattgaaaagcaaagaagaaattggttaaatcaaagattatttttatctgatattgaaacagaacaaatcgaagagtttataagaaaagaaacagaagaaaacaagaaattgaattttggagaaagaaaagatattaatgaaagaaaaaaacaaatagaaaaaagaaaaatcgatcagatatctgaaattgataattggagaaaagaatataaaaaaattaatgaagatgttgataaattagttaaatcacatcaagaaacttggaatgaatggctaaacttaaaagaagaagaagcagaaatagcaaatcaggaaattgataatgaaattaatttaattgatgagatacaaaaaacatccgaaaaagaaaaatcaaattataatgaaaatgttagaaatataaatgaaatagaaaatgatttattggatagaattacacacagaactcaagaacttgaaaatgcaataattgatcatcgtcaatttcttgaagagaaaagaagagaaaatcaactgtttagttgagtaacatataaaaatttaataaatgtttttttttttttttttttcgtataaaaagctttttgtaatcaaagtggccgataagaccgtttatttacatgtatcgttcaaaagtggatttcagatgctatcatcgaaatcctttcgtaattatacacaacaaagaggaaatatatatctgccagttgatttattgattgtgagaaatggagcatcagaaggatcagttatgttgcaaaaaagaaaagctcaaaaagatccagactttgatcaaaaatatcatgaaacattaggaaaagttcacaattcaaaatggcgcttaacaaagttaggaacaatacaatctcgtgctgctggtcgatggatttctgaaaatttcccacattttgatgcttatcttacaagtgaatttgtaagatcacttgaaacagcgtgctgcctcaaccttgatggtgctcactggcttccatcattgtatttacggccacgagattttggtaatttttcaagactcgatcagaatattagtcaagagcaatttaaacgttatatgcttgaacgagctcgtgattcattttattgggctccgccgaatggagaatcaattgcacatctcacgcttcgaacagaaagagttgtttattggcttcgtagacacgtaccagcgcatggttcagccattattgttactcataaggatgttatggagtcttttcgcattcgtatcgaaaagatttccgaaatggattacaaatcaatgatcatggaaccctcacaaaatcacgttcttcattatagctcgatactacattacacaagaaggaatcctaaaacaggagaagttgttccatattatcaatggatgagaatcgttactccatggttaggaaaacattatacgccaaatgaatttgagccaattgtttcaaagcactatggaaatgcagagctccttgcagaggtatcgaacgtcccacgaattttttcagatgagtaagcatttcatcgttcatcaaatttgatgctcttttaggtttttcgaacacgctccaaatcaaagcaaaaactcgcaaaatatacatttttatgtcggaattcccaagaaacttaaaaatattttttacttttaatttttattcatttttttttaataattaatataaaatcatttaatttctggactaaatgcaatattttatatatataaattcttgaattaaattatttttattcgatttgaattcttataaagaatttttgtaaagaaatatctaaaaatatttaataatattaagagatttttaaattaaacaataagctaacacgagttttatgggttttcttgcttttgttttagtttgattttaaagacagaattttctttctcccgatggaagatttgataaaatttcatgattgaaattattgattagactttccaaaacccccaaaaacgttctcttgtgaaaattgatggattattttgtaaacctgttaatttggttaattaggatggacaaggaagtggatgtaatactgaaacctctgaatggaaacgatgtcccagtacattcgaagagatcagatactgttaggtcacttctagaaacggcaggaattgcaataccacccaattcaaaattaatttgcatatcaaaaggtaatcaattgcaacttgatctcactcttggtattcaggggatagaatcaaatgatacaatattcatactatggccaaaaatgaaccaaagaaaacttaaaaggcataaaatcaacgtaaaccttgaattgtatcaaaagatgaaagagttcgaaaggcagcaaaaagaacttttcgaggaagccctacgtgtctttgatctatctttcttacttttcgattactatcgatcttccataagtgcctaccaatcaatgcttaatcaacaagaactatctatctctcaatacgaatgcaattctaatgaacaagatgaaactgttctagaaactacaaattcagtatcatcagaacctttgccaacttgttggcagcaagaagaagactctagctctggtgacgagcagagtatttgggaagaatgtctttttgcaaaacctaattttgaacttgattcatcaaattgatgcaaaccacatttcaagcaagtgaaaattgttgttcttcgttaagaagttaatttgcgccttcacattcttctcaatttcaatattattctctatcaaataaatcaaaatttaatgttcataagctcaacacaataaacatttatcatgcggcaacttattttttccttttttcttctatttcatttaacatcacttcttttatcgaatagaaaatattataattttttttctaaatgaataattttttgtttctttaacataatacaaagttaaaacttgtggctaaccaaaacaataactcgaaaataacttgctgagcaaaacacattttatgtttcttcggcggtttcctcaacataaccgcaataaccgttgtggccggccttttcgaatgtcacaagaggttgtcattcgcgttcgtgtttggggaggagaatcgggtgtcaccgcaaagcttgccccacgtttgggtcctctcggtgttaactctggtcaagttggtcaacaagttgctaaagctacagaagaatataaaggatatcgttgcacagttcaaattactattgttgatcgtcaagcaacaatctcagttgttccatcaacatctacacttatcattcacgctctccaagaacctcatcgtgatcgtaagaagacaaagaatgttaaacacacaggaagccttacacttgataatgttattgatatcgcccgtcaaatgaggcacaagtcaatgtcaaagacacttgcaggaactgttaaagaagttcttggtacatgccaagctatgggagctcaatgtgaaggtcagaatgctaaggctatccaaaagaagatcacatccggcgaaatctcaattccaaacgagtaaaccgatcactaatttaccatcaattttacacattttgtaaatttgcacaatgagtaaaaggttgtttggttaagattgtttcataacattttaggaatcatacattaaattttactatggttatttctaacatgcaatttctttttttttttgactaggcaaatttcatggtcatgaaagccttgaaacacatgaataatattattttgagaaagagataaaaattattgcattatcatgaacttttcaataaaatatcttttgcctgttttgagttcaaagaaaaagaaaaataaaaatttgataaatttctaaaattacacgaaattttatttggttttatggtataataaacaccatggtgcattatatatttaaatctgatagaattttatttggacattttggggaaaaaacataaaaattgagaaaggattgaacggagagagcaaaattttgatttaatattgcttgatttgctacaaaaaatttacaaataaatttgttcatatttaactctaaaaacatgttttcattaagggtcgattgagaagaagttaacggtcatttagaagggtcgttattttcggaactcgttttcaaacataaaggttctagaaaattaaaatcacacaagaccgattttttatttcggctttataatgtcaagcatgagctgtcacagaatatcgaactcttcacatcttttgctcacgatcatccgcatgaaagacgttaatttttttcagttttttatatgggcacttttgtaagttctgcttggttgctatgcaaactaaaaacattttttttctctgaaaaaaatatcacagatactttaaagccacattattccatcatttttcttttttttatattcacatttttaaaattttcgtttgatgcaccaaatttaaatatcaactataaaaacccattttataatttagcaataccacaagtaggctctgacgttgcagatgaaggcttcaaatattcttcaatattaactacagatatcaatgtatgtattaatcgatctgaagttaattcagaaatcaccagagtttttaacaaacgacaagtaattgagaacaaaaatgctccacatgttttaattattggttcaactactgttcttggttctactcttaaaagtattttccaaaaacgaaatcaacgagttctaaccacgaaaggcataaacgaatttgatttttcatccgaagacactccattactatttgaagggattaatataatttcagcttatatcacatatcaaccaccatatgttcgtcacgcacattctgatggatccgaatacaccaacaccatcatccacacgtatattacaggtttatgtgaatttttaagatcccgagaaattccgtttatctttgcaacatcgcaaccattaaacaacgatactattattacagttttattaaatgggggcacagttgttaagcttccaatgctagttgattcattagcatttaaggatttagagaaccccacaatgagagctgttcgcgagtgtcgaaaagttggatattcgaacattgaatatttcagtttcaccaaatatcatagtattgattctatcacagcggcgaaatatgtaattcgagcattatataaaaagccacataaattcataattgttaaaggtcattcagttgccacaataaaagaatcagttaacgctgcacttaaatcattagcattaaccaaatgcgccgtaacctttaaaaaattcccacacaaacttaagccattaggtataactccacaaataattgagacgttaggtaaaaagaaagataatgtcattaaaatgatatcgaaaacttatcgaactttcaacagaaaagaaaaggataaaaattatatgacaatattaactacaggtcgacatgatagttattcgaaaaactttgaagttcgtgctcaaaactttttaaactcgataagttacggactcaaaaatgtaccgttagcgcaagtcgaagtcatatatgtcgattatggtacgccaagaggaaccacattattatttgagttatgtaacatcagcaaatatttaaatgggcatttgcgatttatcgttgttccacctgaagtacataagaatttatcaataaagtttaatcgaaaaggcggattcttcgaattcgttgcgaaaaacattggactacgtcgagctaaaagtaaatttgtgttaacaacaaactccgataatatgttttcgacacatttctttgagctaattgcatcgcatgagtttaactcgatgatgttatatagggcgaatcgatggaatgaacgcgaaaacactttagaagtctataatataacgaaaaaagatttcatcaaaattttgcccgaagtttggaaattggagaaaatggatttggaagaatggacgggattaccgccgaaacaatttagtctgcttaatacgcactttagattcatgtggaaacacttctctgtgaatagcgcttcgggcgattttttgcttctttcttggtacatgtgggaaagaattagagggtttaacgaggtgccgttcaatatgcacaccgactctttgttcgttgcaaaggcaatgaaaatgatacagggaataatggtaatgttcgtaagatccccttttgtccatcagttccacgtaagctttaatttggggacagaggctgtttatgatcacgaaaatgtgataaaggaatactcgtgtataggaacttggagaaattgtacattatattgcgaaaatacaaattggggatttgcagaccataaattcgttgaaattgttgtgtaaataataaatattatgaattataataatgtgatgacaagtgaaactgaaaataaatattatgtttgtatataattgtcttatgctccagaaattgatttaatttcagtgtaattatgatacaaaatgggaataatccagcaacaaattatcttctcaatttatctgtggatcaaaatggattgaattttggttttcgaataagcctaaaactacaacagaatactttaaactctttcattgctacctgaaattctataaatatggcaacacaaatgacatttttttataaggtgactacaaaaaaccctatcggagttgttgttatattaaccgcaaaaagttgttttgaaataaaagtgactttttttagcatcctttactcaaaacatggtggagattgttcaataaaccttaaaaataaatgcatcatattcaatacaacaattatttgaatgatagaacttgatatcggttccgatgatttagtgtttatctcatttttcgcgaaactgagtaaaacccatgtataaaaagttgaatacaatagaccgttaaatccaacagaaaatatcctgagacggttttgacttcaatcgaactcacacaaaaagttgtttgttttttgtcgttaccttgaaatccattcaaatgtcaggtttacacttgtgagcaagtaaatgacatctcctcatgtcacttaatgctacatgtgcttgtcttgttatgcaaaaaaatttcgatgaaaactcacgacgaatcacattgaacaacagtcgttacacgcatttctaatgaaaaattcgtagttatttgttaaagccaaatccatgattaatattgattcacattggcactttcatccttttcctaaattccaacaaacatttttttattcgaaataaatattattttaatttacttactgaaaataaaacagtgaacaactatgtgtatgacaaaagcatccatgtatgttcgcattaatatttttcgtttttactttcttttttaaaatttattttaatcagaaaagcatacatcaaaaaaacgaagttattccgattttattgattatattttttgttaatacaaagcaatcatatgacgaagagacaaaaacactcacaatatctgatttcaatgattattcaaaagattatatgaatgttacagaacgtgttataattattaatgttggcgagattgaaagtaatgcattcagagaatggcctttattaacaacagtaataattggagaaacagttggaaatatcggtaatagagcatttacatcatgtacaaaattagaatatcttcaatttccagataaattaatgagtggaattggaggtggtgcatttgcagaatgtatttcattaaataatattacaattcattgtaataacattggtgataatgcattttatgaatgtacaggacttgaaacgataacattagctgaaggcgtccgaaatattggatcagatgcattcagaggatgtacaaaccttgtgaatatttatataccaagttcagtttattcgattgggaatgcatttttagaatgtacgaaacttcaatttattaatgtttcagaagaaaatattggttattcgaattatgaaaacgatggcgttttatatgataaagaaattacacaaattattagttatccgaatatgaaaagtaaaacatttacaattcctaattcagtcacttctattatgaattatgcttttgcaagttgtaataatttagaaagaatttttattgatgaaaatgttcaatatattaattcatgtgcattttttaattgtacatcacttcaatgtattcattttaatggagaaatttcaccagaaatacaaaatgatgcatttgtcaacatcaacgcgacaacagttatgacaatagtaacatatcaaaatgaaacatttggaaatatgagtattactaagggaacaacacttgacgaatgtctccagccaacacgcacattcacattgacacaatatgatacaatcactaattcatatacatttactgaatcggattcactaactgcatcagttatttattcatcggatgtaactttatttttaacgcattcgttcactttaacacactcattatctattacactttcgattacaatttatagtaaatacataaatacaatttcattgttaacattcgaatcaacttatagttatatatcgacaaatgtcatttattacgattacactgttatatattattcgtcttattatagttattattctgacttttatacattagttgtaactgatgttgcaccaaaagataattcgatatcaaatgaattgttaattggtattatatgcggcgctgttgtgatagttttgataattgtcggaatcgtattttcgatgaattttacttttgttaatactattactttaacttattctttatcgtttataaaaactttatcaaattattatacgtacttaaaatcttattcagttactttcattgaatctgaaactaaatatatttatgtcgatttcatatattataattatacaattatatataatccagaatattttacgtattaatctaatttcttttatatttcttatatcgaagatgtaataataaacactgatgataataatacattaattatcattataattgttgttgttattgtaataattattgtatttataatgataattataatatttatgattaaatatcaaaacaagaagcgaaaacaaaatgaagaagaaatgaatatttcagatgaaaataataataaaattaatgaaatcgatagtacattttcagttggtattaataattcaaatattgaagaagatccatttgcagacgatttaaaagaagaaaaatttgtcagtcagatataaataaacatattttaagaacaaaatattttaatttgtttattaatttaataaatacaaagatttttgttatttagcaaattttatgtttcttttattatatgattattagtataaatccaatttatccaaatcataaacactaaaagtaaatgataaattatatcaaagaaaaaattggaaatttagagatattatggtaaaaatgcattatttttttaaaaatcaaaagaaagatatttcaatttcaaataagtgtttgtcttgagtagttctgcttttatctgtgttaaattaagtttgaacagaaagtaagttattgtgaaaataacaaataatatgtttttatataatttattggtaagtgaaaattattaaatgttttctgttctaaaaaaaaatcatttaattaggaaaataaaataaaaaattagtgttaacgttctcacaggtgaatgaaaattttcaaatataattaaaatttattaaatgtatattattaaatatgttctctatgaatgatataatattataaactaaatttcatcatgctcaatcaatattcaaaaatggaaatccgaattaaaatgtatttaaatggaaaacagacatctatgaagctacctgaattgttaggaagcaggttcctgatctgaaagaggaggatcaataattccactgatgcataaagttgcagaaattgttttttggtctggcgaatacaatggaatcctaaaggcattaggtccgtttagtgggagtttacaaattctaacttttgattttccaaataataacatctcatcgtctgaatctccaaaacaacataattgtatgtacaaataagctgaacttatgtctgcaacagagaaggttattggcattctaaaattaaatattgatcttttctgcattttagtatctgttgtagacagaggaacatctgctccatcataagaaacaacaagccacattctgttgtttggttgaattcgatttggatcaatatctgcatcatgaaaataaagttccattttgtatttcattgagaatgagaaattttgggagaacgttaatattttatcaacaaaaaaaccgatgtaaaagtattatatcaaaaaaaattggcttaaaatgacattttatgtattcttgaattagtcaaaaaaaaatcttaaagtttttatattcattgttgaaaattatgaattgcgaaaataactactttatttaaaattctgtaatgttgcacttatcttagaaagttcttcagatagatcattaatgcctgattgtgtgaaacaaatattaaatgagtcatttgttccattaaagtggcactgaacaattggtgtgattttgcttaatccaaattttgaatcagaaggaagaacagatacccatttgaggtcagtaaggcggttgtcgaatggacacagttgagcgtattgttgttggaggcttgcttgtgtctttttccaatattgatgaagagcttttgaaattaatttttcatttgaaaacattttttcaatttcttgatcaaaagaatttaagtcaagacagtacgccattccttttctgaaaattgttatgagatttgaaacaagtcttgttctgacatgttcgtcaatatcaagaagtgtcaagttaagtgattcttctgttttcttcccaagaactatgtcagctgttgtctgaagaataagaatcaggcgttcttcgtctattgcttccattcctaattggcaaatgtttgatgaaacgatagaacgatacgaagaacgatctaatttcattcaattttcttttctttttacaaatttattatttcttgttttgatttactatatttattatattttatgaaaaatacactatgttagttgttttgaaagaaatgataattatcgcaagctctttattgaatcgtgtctctttttgtaaattaaacacaaaagcaaaactgaaataaaaccattcgtataagtgatttgtgaaaatcatgaattaaaaacaagtatggacgaatttggaataataattgtgtcaacaatgtcttttttaagtattataattgttattttattcttttgggtttatggattatttaagttcccatggtatgcttcaacattcatgattttatcagggtcaattccaatgataatgctaattggtattttaccctatgatatttccaattcctcatttggaaagaaacctaaggaaattagatacttgaatttattattaaatgttctttattggatttcatttatcctttcatggatcattaatcctttcgttatttcatacattagttatagtaatagtatttcattaaagcatagaatttgtttagctatttgggataatcttattttttatggtgttatctttgcaataattatggttggaatattgattttaatagaaacacaccgtttaacatgggcatctattttgcctcttggtatagcattatctaatggatatggtcttatactcctatgtctttgccttggatatgcctttgtttcacttcctagagaaatatggagaaatgccaatccttcatataagtacattcattcattattctatatatccaaagaatttaaagaactttcaaaatatatgactgattgtgaagctattcttgaatgtgttgaaaaagcacgtttggaacttggtgaaggtattggcattatatttcgggaaaaaggtcaaccacgcatcaataaactcaacaaatttaaaagtttggttcccattccggaagatttttatatccaaactcgttttaaaaataaaatgataataagattcaaaaaatttaattggaagaattgttctatttataatcttgaagatttttttgcaataattgataaaacattgttttcattaaaacaatcaacatgctttcttagacattctgctaataatgcattaaaagctttagtaagatatcaaaagcaaaaacacagcatttgtttcatgttacgccttttatctgttatcatagcaattctcaatgttatttgtttatggagtgaaatatgccttatgatcaatccaaaattttctattttttatcaaatatctcatgtagacatgccagaaatagttggcatatttatatcaacgccaatcatattgtatttaattatattaggatgttggagccttatgcatcttaaaatgggttcatactttaagtttattaaaggatcaacaaatttaaatacattaaactgctttgtaaacatattatgcagattaggtcccacaattggttttcattatatgcaacagataggagcaaatgaaagtcagttccagaaggtaatgggagttatggatgttgtagttttcattggggataaatggaacattttttctccaatttttcttattttggtgattttatttttcgtcttgaaaatagacgaaaaggcagtgcttttatgtgggtgtgatgatttatatttcgaatctttatatactgatttaaattcgttggaaataggtgaaaaaatccttgtagaactggaacctgaagctagacatctgatcaacaacgagctaacctataaaaaaattattactaggaagcttccaagtgataattcactattcagcaattaaatgttgaagaagtgattcttaaatatttttcaaataaaatatcagaaaacatgagatatattatttatttttgcaaattaaatacaaagataccttttgtgggatgcgtcattaatgacttcttcacttttctattgcattagttcatttatatataaattactatattccatatattccataataatatttaataaacagattggggctttagcgcatctgggagagcaaacgtcatctgaagatcgtgaggtaccatttttttcaaaatatttttatgaaaatttgccacaatgatgtgaaatcgtcttattgacaatattgaatactttattttcgtttcaccacacaaacattttgcgcactcaatcgacaacgataatttaacgtatccaacaagctaaaactaaaagcttgtccaataatattaactaaaggttatgcgtataataaaatttcactgggctatgctttgcgctttattaatagtattttttataagtgcagtttttaattatcataaaacactaaatgatttcaatctagatatatatcttaacaatgatgataatttcagaccatataaaaaatctacacttacatttataaagccaacagttgtgatgggccagtttccatcttacttagtcaatacttcagatttttcatggaaagtggatgttccaactcctcaaatcgaaattattggacctgaagcagttaatcaatttaatccagtttatgttgatcctagcttttttgatggagctaaatttcatgtaatgcaaaatacttatttcttacctgattgtgtatttcttcaaaacaactcatatgtgcttctttcgcatgcatgtcatccaaggtattgggatggtttatatcaacagccagataaaatcacatataatcttacatattataaaaaagtaatttgtataggccaccagcacacgtcagattatggccattggttcttagaagtgtttccagtttatgttgcattaccacaaaatcttttacatgaaagtataattattgttccagaagaacgcgaatatatctaccaatgtttagaaacgctcggtattaaacgcgagcaagttattgctggccacaatgatgcctttttcgccgatacattttatactgtatcatataaattttgtggcgatttagtaccatactttatagacaacttccgaaagtttttcgtcaagacatttgatttagaccatgttaagccacatcgttttgtaatgtataatcgtaaaaacacaagtcgtagtatcggcaatttcaaggaagtaatggatatggtccacacgaaattcccaaatattccatgggaagaaggcgaaattccaaaaaatattgaagatcaagcaaaatatttcaatgaaattaagttcttcttcggtatccatggatcagctttggccggagcaatttatatgcagccgggaacagctgttgttgaaatgcagatggaacaatggctattgtcatttttgtatttgtcaagatacacaagcaaaattatggtatccggaagagatccaaagatttcgtggagtggactcgagccttgtacattggacctgaattataccgaaacactcattagaagagctttagaaaaactgggggcaatttgaatcaaaacttatgaattgcgatcaataaaaaattgtttgtcaaaagtgtttctatgttgtctattctttaataaagaaaagaatctgattgatcaacattggtgcaccaatatattgaatggtctatgcaaaagtgtctttcctgctattgaatttgttatcgttttgtaatccatttgatgttgatccacattataaaagaacatattaaaataattttaaatgtaatatatagaagttgatttacataaatacacaaaagaaagtattagaaaagattttgattttcgagttcagaaatacttagctcatcagcaggttcattttcgttttcatgatgaccacatggaccaaaccatatatcaccaacaaaagaaacgccgaatttgtctgggaaaatttctgaaattccaatgacaaagcatacaaatgatggaacaccaataacgcaaccaataataaaaaatatgcctctgatagtgatgtcgaacttacctccaagcgacccaacgaaaaacgatatcgcaagcattaatggtactaaactccaatatccaagaataaacccttgattcttgagatcagctttttcggatgtgagggaaataagctctacggtgcttttatttgtgattccacattcgcgaagtgttccattttggaaaagacgattattatatttcacaacaaaatcataaccgatatactctgggttagtcctttgaaacataacaacaagtttcctaatgcttatgttttgttcaacaacaagcttggaaaatgtttgaatccttttgcctgtatgaagtcgatcaggaactgatgctttaatattgagagtcagcgaggtagaaataataggttcgccaccaaaattttctatattttgttgaattaagctttcatatatagtcatcttgataattttttttaatttagatttctctcaaaaagtcgtttttttgaatcatggcacttttccccatctcaagttctaattgacttatatcatacttttggaaataatggttatgaaaatttatgactatgtagagtcgaacttgtggttccggtttttcgtaaaattatgctaaaattgctataatcttgaaagaattctttcaacaacatccaatagaattttaactttttattagaacttatgataaaagtgtcaatgtgaaacaattgaatagaaatcaattcttttctggaaaatatttcttcaaggccccagctagctcataattatacatttcaaatgttccgattttccaatcatgttaagcttatattaagtatttagctgatcacgtatattatcttcatataaacctgattgaattaaaagcgttttatggtacgaagaccctttcttgtctgcaagctgatttaaaaaaaaaaacgataaatcataaaatgaaaaaattagagattcaaaaattgttcttcaaagatttgaatctgtaactcatacatcctctttgaatatctgtgctcagctacattgtaaaaatttcgaaatttaaccaagaaaacaatttcttttttattacacatttatttattcttttttcattaaatagcattagaacctaagttttggtagagggtgctgtttttttttatagtaaaagatgatatttgttagttccaaaattactttcttacttacagagcaaaattgatcccagcgtacataaccgccaacgataattgaatccaattcaaaatattgaaaaaactttttgaaaacaaaattctcaaaaagtgatcactttttgatgtccaaccaagccgcagatccgccacaacaactcgaaccaactaacccaattgtatacagaggggagttagatcctcattataattacattcctgcgcaattatccggaaagacaaagagaaaaacaaaacgcacagagcctaaagtcaaaacacttccagcaattcttgacggagattttccagaatcaaacgaaaactataccaaaatgctccaagatgaaactttattactttctccaagtgaactcggtttcgttccttccggattttgggtatcttcaacagtcacattttgcgacaccgtacacaatttcttccaaaagaaaaacaattccaattgtcgtttcccgcacaaactatataacgcattacaactcgttgaaaaaaaaccagaaatgtatccatacgtaggagtcaaatggcttagcgacgttgtgttcaaggtagacaaatatatctttggaaggcttttagggattacgtcatttgatggcggattattccatagccaaggaaattttccatctcatggctttcacgaaattgtgggtgatgccatccaaaacttctattccaacttaaatttggagggagtagattttgatcgagttcgaattataacacattcaaatggatttgcaaaagacgttgacgaaaacttaattaatcaattaaagtggaacagcaatgaaacgaaagttgtgtaactttcatttttatgaataaatatgatcaatagcattaaattttttttttcaagaattatggtaaaccactatgtaaatgtacgtaagctaatgttaatgacttatttcatgagtgagcaataagcatgagtatgtaatgataaaccttaaacttataaattgaatgtgtaaaatttattgaaatagagcagtgttctagattcaatactgaatgtttgttattaatcattgctgaatgttattttaacaatattatccccactctgaaaaggcaaaatatattttgggaacaaaatgccgtggacaaaatttgtcaaaacatatcaaaagatgataaaaattcatttatttccttgtacgcaaactttttgtagaaaacaataatactcatcttttgctgcctttatgcatgtaggctatatatttggtgaaaaaagaagaataggcattggaaattaggcgatcaaagatattttgccattcaatctgtcaaataatccaatttttgaaagcaagtgatcacacaatattttggcagattcaagatgggaaaaaagtctcaagggaatcgaaagaattctttttccccatctagtggaaacaacattgattatcaaacttttgacaggtcttttcaaagaatccttgaagcttgtataaggaataaccaatcagaagtaaacattggattaccaggaaactctttatgcggcattgtttgtgatacagattatggggaagtaccatttccaaatgtagattttttggagagagatgtcttaaacatcaatcgttcttcatcagaagatgatttaccagggtcagaaacggacaatcgacgtgataaaccaagttaacttcatttttacttcttgtgactgatatggtagattttttttatcaatggaattctttttaaaaacaattttgtggtgtaagcatcctccgcgcaagggcaccaaacactttaatataaatcgatctgaaagaagaacatttgttttgatttttagtgaagaaaaaaataaatgaacgtttagattttcagatgatctcacaagaaccaaatccagcgaatgcttattttcatactgattactttgattggaatattgtaaatgaattaaatccagatgttattgaagcaaaagaagattcaaatcaaatgtccaaaattatctcctcttttttactttgtaagttttcaagctacgatttcaatatcattaaagtccctattgtttttcgtcttctcaaacatctacacgtttgtatttcatatcttttaaagtgtcaaagcattctggatgaaaataacaacgaattaaagaagtccaacaaaaaaatacgatcaaaatatgtcatccttcaaaagcaatttatgcgaatcaaatcagaactcaaacgtgagagaacatctgaaaaatgtccaatctgtaaatgtatattttattctacaaatgaacaagaaaaacatattcaaagatttcacacccaattttttgatgcatggcaacatatatgcaataatgagccattagaagattttcatgatgaagttgaacaacttcagcaacaacttaaaaagcaatttgaattatttacgcaaaaagaaaaagaatttcattcactcaaaaacataattttaactatttctaagcctcaatcgaaagaaatcaaacacaaaacgccaaatttaatacttcaaaaaaatcttttttcatatacaactaaaccacaaatagaaaatgaattcgatcaaatcccaaatcacatacaaaacaaagcgcgtgatttcctacttaaaaggaacagatataaattcgatcaaccagaaacaacagaacaaattgaagaaaggatcaaaaaattcatggataaaagttataataaatacaacaaaaagcaaacaaagaaaacgcaaaacgaaacatcaattaaaataccaaaacgtacttcatctactaagtcaattgcatatgaaatttcttatgctattcctcaaagagatatattttctgaagcggaatattcatatccaaatgaatcaaatgattctgaattaaataatgaatcaatgaaatcagtcgatgataatgtacaatatgaacaaaattcgataaatgaaaattctcagaaaacaaaatcatctgaaaaaactgaagttacagaaaatgataaaaagtcaagcgaagtctccgaaatacctaaaaagaattcgcaaacagtttcggatttgagcgaaagtgtaaaagttaatgaatcgaataaagaaaaagaagacggaagatttgatggattcgcttcgagttcatcaagtgatgatgaacaagaaaaacctaaaacaaacgggaaaatgaattttgatggatttgcgtcaagttcagatgatgaagaaaataacaaatccatcaaatagtttcttgtttatgaataaatattgtttttaagtataaatatatcaataacagtttattcatttacaatgtgtttaattgaatattttggttatatcattaaaaatcagaaaatttcatttctttatcgacagtgcgattaaatattttagaagaagtactcattttttacttacaaacaaaaaatattttcgaattttggtatattttgaaatgatgttatagccattgatcatcttctttaagtgctaattgttgaatatcgttattaattgcgtttgatttctcagattttatgtttttgcttgattcattagtgctgctcatttgtaatttggatttattatgtcggaataaaaatatgaacagtgaaataacaataagaacaattgccacggaaacacaaatgattgcaatcattgagcctttggatattgttttcgaattattactttcgctttgatcattatatatatataaattcgaataataactaatgtatgaatgaaggtaataaattgtataatcgaaaaatataaattctgtttgaatgtatatgacacttgagccaattttagatataacaaatgtgtttaaaatcgatttctgaactaaacttaatgacgcagaaaatgtcaatgaaaatgttatagaacgagtaatgtttgaattaaaaatttgtgactcagtaaatgaattcgatttggtgaatgaattactctgtgtaaatgcatttgatttggtatatgtgttactttgtgtaaatgtatttgattcagaatatgtgttactttgtgtgaatgtttgcgttggtatttctttgatagaatagtgtgttgttaagctcattctccctaatttatcaattgcaactgcatgaatatatgattcttcatttgtaatattactaatggttcctgttgttgtatttttggtttgatttaatgtattggatgtaatatttgttgattcataattatcaataatataaagatattcacttattgttgaatactcaagtgaaacattattagaataatatgttgcattattattttcaaatctaatcactcgatacataatttcatttggatttggggttattaatattgttctattacgataattgttttcatcagtcatcgtaatatttggtgcgtttggttcatttatgtattggagagagttatcatataaaaaattattcgttgttctttggtatacataacaaatcgaattgactatgagttttcgctcttcctctgttatattaaatggattgtgtcctgtttgaatcatagctgtgttattgtatgtagttaaataatagtgcggatttccatatcttgtttcagaatatcccgtaagattccatgcgtaactttctgctgctgtgaaatttccttcgtattgatcttttggaatatcttcagttcgattacttagctccatccaaacatcgccaaacgcagcattttcggctgtgtgtgtaattggtatcgaataatttgattgattgatttcatatggatattgtgtaggtaatccgactttcttaacaaagatttcacctgaccaatgacgccatttgtcatttatagttccatttgaacattttatggtttgtgaacaatttgcagttccgagtttaattccaaatttatcagcaatgcggccaagtccgacttcgttaccatattcagcacccacaacatcgtgaccaagcacgacgccatatccaagatcaatgtactgtgaaacaagttcaaccgcttcatcatttattacgtctttgccattggaatcatgtatgccaaagaatataacatcataatcgaacatgctttttaattccatattttgaaaatcagaaatattaattaatgttacgttaatgaatttgttgttggtatcaggaattttatttaatggattataagaataatttacattgtcataaatgtaccacccaccttccagccaaactttcaaacaggctgatagttgtgttgtaaaatttgtttgatcttcagagaaaaagaattttacatttggaacacctatacttagattggcaggataaacattaagtagactaatattttttgttgtgctagaatcaaacgaacttacaggaagccagttttttccattatctacagatgaataaacaatgaaagttgtattttgagttgagttaaaatcactccaatttaattcagcacgagtaccatcaaagccaacactgagattgattgcaaaattatttgaagtttcagccagagcagaacaaaaaaggaagaaaaacaacagaccaggaaagtgaccacagcacattttgtgaggaacagttgcaacttttgaatataacctgcaaaattcacacaaaattaagattggcattttttgtgcgtgctgtttcccaaactgcgttccagatcattcaaaaaactgtttttcatatatcgcttttactaaatgatatgtgagataaccatcagaaaccatcactgccttttatatactatgggataatttgcaactcaatttccaggtttcaatgagtgagttctttcctatagggatagctatattatattttatttatttatttatattttatatttattttaaaacttacacatttttagttaaattcataaatttaaagtggagtgacaaacttatgctcttcaaaatcgacagcaaatggatcttcatcgatatcatccattttcacaatacttttacaactatcaatttctccatctttataattatgttcctcaacgatttcttcaatactattgtttctatgacgattaatgtaaatgattaccgaaataataacaataattataacaactacagctgctgcaattccaataatgatataaatgttaaattgattttgtttttgatcatttgtttcaaattgattatcataaacatataaataatttgaataaaatttttgaaatgttgtaaattgtataattgtataatcataataaataaatattgtgtttgtatatgtaatttctgaattcataattatatatgtaaatgatgctgaaagaaaactattaacaacacttaaagattgagttataagtattgattctgttactgatcttagaatagaaattgaaaccaatgaatcatatacagtttgcattgtggtttcttcagtttgtattaatgtttgttgatatgttaattgatacgaatttgttaatgtatatgaatttataaatgttaattgaggcgataatgttaatatatttgaaattgtatccgaatttgataatgttaatatcggtgataatgttattgattctgtatttgtatatgtatttgttaatgaaaataagttactgtatgataaaactggtgattgtgtaatagtttgacttagtgtttctaacgctgacaatgtaagatcatttatatatgtatgagtgaatgataatgttggaataactgtttgtacatttgttgtagatggtattaatgataaagaatattttggtgattgtgaagacgttagtgacatttcttggacttccatatatgaattagtgaaagaatctattttaacattagtattagataatgattttgtattagattttgttattgcagatgagaatacatttatatctacttgcgttgttattgatgttggaacatttgttattgacattgtgttcgtttttgtttgagtatttgttagaacttttgtatttgttgtcattaatgttctgataattgaaaagacataagtccctgttaatgttgatgaacttgttggatatgatgcttttgtttctgactgagtgattgacgaaaccattgtttcagaagaagttaatgattttgaatatgttgctgatcttgttagtgttgattcaataagatatacagtgactgatgtaatgagaggaattacaatataattaggctttgctccagaaataattaattgtccaattgtaggacttgtttttgtttcagaatttttttctaacataactttattggaagaaatattttcattaattccaatttttttgtaatatgttggtggaataatagtttgtaaattcaactgatttggtactgatgttgtttgagtttgtgttactgtaagtgatggaattcttgttataattgatgcaacagtagtatatgataatattaatgcatatgaatctgtaggagaagcgactaatgttgttgaccctgtatatgatgtataataaatgacagaaattgtcggtgaaagtgtgctagatagcgatttcgtatttgatgttgtgtatcctacagtgagtgtactagtatatgtatttgtactctttaatgatgaagagtatgtatttgaactacttaaagaactaataaatgatgtcatgatcgattttgataaagtaattgatgacgaatatgtctctgaatttgtatatgtttgagtaattgaggaaacatatgttattaccaaagtttgagaaagtgttgatacatatgatgaactttctaaatttgtatatgaaataacagatacataagattgagttacagatggagattgtgtaaatatatcaatttttgtttgtgtaagtgatgatactaaagtgttactactcacgtatgtatttgaaaatgtgttagagtatgtgtttgacattgtatataaagaaacttgtgtttgaacaaatgtttctgaaggtgaattcattaaagaatatgattccgtgaaatatactgattcagtaagtgtttgagacattacatatgtattagacattgtgtttgtataagatgaaattgtcgtatttgtattaatattcgttttttcatatgtaggaacgatttgataagaataagtaaaacctagtactccaggcttattaagcgatatttgatatgaaaactttaaggaaaataaaagagccaacagtattggggagttgagcttcattgtcacaatgataagttttgaatgagcatattgaaaggtatttttggaagaaattaaatttgagaaaaatcgtaaaaaaattgaatatatatgaccaaaaattgagaagtccctgtagataatttaaatcgaaaaaagtgataattatcggttcaattgaatcattaatatgaaaattatcgcacatcaaaagtgtaataaataaatgacaattcacacatccaccttctttaaaagttaaaaaaatttatttataaaatttactattatcattaaacatagatctatcaacctgttttgagtatatttaaatatttaaattttatcacgcatgcgtgatttttttttatggagaattcatgagctgttgtacataattcccacagggaaaccgaatctggtcatcaaacattttgataacacaaagaatgaagcacaaaataatttcatgagtgcgtagtgaaagtatcataagtcaataagattttcacacgactaatatttttattcatatatattccattataaccattgatcttcttcttttttaactaaattttgaacatcagtatccacatgcgaaatctcttcgggaataatcgccttttcaaacgattctttcgtgttatttgatgatgaaccgggtttacgatgacgaagcaaaaatataacaacaaaaacaattaaaacaaataatacaactgcgcaacaaattatcgcaattaatacttttttggaaatggtgttcgtattaatttgattgtgttgagaaattgtgaagaaaaatgagtaaaaacttatcgatgatgaatagtaaacaatttttgtttccttaaaaatcgtatttaaatgagaatgtgaacttacaactgtatttagaacagaaatactaaaaacacttaatgactgtgtaacagtaagagaatatactaaagacattgtcatgttaaacataagcgaattcgtaaatgtattcgaatgtgagaacgtatttgatttagaatatgtatttgacttagtgaatgtatttgacttagaatatgtattagatttcgaaaatgtatttgatttagaatatgtatttgacttagtgaatgtactcgttggtgttatctccatatataaatgcgatgtttcactcatttcacctacatcgtttacctttgccacatgaatatacacgttatcatttataatattagttatgatttcatcttttgtaaaattacaattagtattattagtaataactgtatacggattcgaatcaataatatatcgatatcccaaagtttttattggcactttaagttcaacaatatgtgatttatgtatattattattattatcaattccttctacataatacttaagtgctgtaatatctgaataattattcctaatcagaactgttctttcggtattatttcgtatgatatatggcttgttaagatttatatatttgatagaattatcatatagaaattgatttgtggttcgctgacataaataataaattgtattcgcaatgagttttctttcttcttctgttggatgttctgttttacttcatcaaagaaataatgatcttgtattgatgactgagaaaaggaataaaaacaacttttgaaaaggatttgacttaagtaattacttgattgaatttttgaatatataaccgtcggctttgatccacccacatttcgaaatgaataaaatataaggaatcacaatttttctcagtgttacactaaattatcgacaagccacatcttggccagttgcatacgattgtattttcaattacccagtaacattaacaattggtgcatcaggaaaaaaagtatcatattcaaatacagatcaatgacatcagtttatgcacatgaatcatcacgcgtgttgattgtaattaatcttgtagacaaatcatccattgagaaagttcttgcttgtcttgaaatgctagattctcctgtcttaaaagaagccgcgtttgtatacagtaaatctgatcacaatgttacttttgaagaagttcatgatttctattaatctctaacaaacatactatggagatggtattggttgagcttttcaatcagttgtagttagtgataatctctaccaaagtgaacccattcatgaaccgacattaattgatgttgaaatcacagataaaacgcataaaaaagggttaactatgcatatatgttacttttcagctctgttttcttaactaataaacttcattttgactttattataaaattataatgtcttcatttaaagatacatgggtctagtttaaagtttattgataattggtgcatttatctttttatcttgtttacaaagtaattgaactattatttctttgttatgttttttatgtgcaatcataagagttgtcatatatattttaagtaatttttatgtattattttgaattttcataatattaatataaattttaggttaaacatcaaaatatttttggaattaatatcaataccttcttgcataagaagtaattcaactatactaacattacctgttgatgatgcaatcataagagttgaataaaatactttaaataacttccaaataatatttatgaacttcaatttctttaaacaaatactaaattaccaggataaatatctttaacatttatatcacatttttaaaacacgaatttctcactattaatatttttgattcaaatgtaaaataagtatttcatcataacaactgaacttcttctttttttaaaatttagaatatcagaatcaacttgcgatcctttttctggaataatttccttttcataaataacaatgttttagtagtgcgttaatttattcaaaacataaaaattatcaaaataatcaattatgataattttcttcttcgatgcattcttcgattgacaaaggctcactatttagcaaacgattttccagtcgtttcaacacgcgctttcctttcactgagtcgaaatcgaaatccaaaaaattttcttgtatcgaatcaatgaaagtcagcaaatcattttccaattccacttgtcttaatgttaaatatggatggtccaacaaatctttaattttcggccttttcttagggtctctaattaaacagcttttcatgacatctaacaatggtactatgtcaggtctatcaacaaaaggaaattcgattttatatttcggatcacatatcgcagatattttttggaacaattcctgctgaggaaatggtggcctattgtacactaattggtataaaatacatccaagtgaccatacatcagctggtcggccttgtctgatacgaccacctttatgtgcatcaattggtcgtttctgtaaggactctggtgacatgtaattaattgtccctacttgatgtgcgcgttcaattgatgtggtatcgtcgtatggtgagatagatttggcaataccaaaatcaataagtttaagtgtaccacctgcaaatagaaaatttgctggttttagatctccgtgaacaacattagctgagtgaacagctgaaacggcttcaagcatttcttgccatatgattcgaaggaagttgggatcaacatcttcgttttcgagacgattctttgctataagtgaagcaagatctatatctccaagctcaagaattatgaagattttaccttcatttatgttgacttcactgtctataagcttaataatacgattggaagtttgaaggatttgaagaagttggatttcattgataaaagaatcaactatgtatttatctgataatgaaatgttgacttctttgactgcataaatctctgagtctagtgaaagaactttgtaaacagtggaactgccacccttacctatttgttttagttttaaatatggtcgattattgatcattagaatattattcggatttaaaagagaattcatctctggatcattatcaactgattgtgcaagatcatgtcctttatcaatggaaaggacacgagtgggtttctgttgaaaaagacctttttcggatccaattggcttgataaaactttgaatagaagaggaaaaagaaacatcagtttcttccatttgttcatatgatgaaaaagaagggttatatgaatattgttttgagtctgtacgtgatttctgtttacttttcatctgattttttaaacgtgcgagaaaaatcgaacaaagtttctgaaattaagcaaaacagtttttataaaaacctcatgaagaccgttaatcaaaagtgacgtttggatcgttttctattcaattatttgcctttggtgaaatcttcctgtataataaactattcaaactccaaaaagtacgatatgaggccgtttgttttatttacggttttgacagtgacggtgtggaagagagaacacaaataaaaaatcaaaacaatagtgccaatgacatgatccaagaatgggaatcaattctttgtcaggattccaaatttacagatttttccgatcttcttaaatatctccatgataatacccatttttgcaaatgccaagcaaactgggggcaaagtcaactacacattttatgcgaagattgcacattaataaaaggcggatgtgtttgtctccaatgttttttaaatggaaaccatgaaggtcattccatttatatttctacaactggcagtggaaattgtgattgtggtgatcaattccaatggaagtcatctggtaattgcattcttcataatcaccaaaatgaatccgagattccctcatcaatatcaaatcttcttcaacaaatttttgattctgctgctttacatcttcccatttttctcaagggggattcaaatgatgccattacgttaattgaatggcttttacgaatctgtgaaattggcgattcatatgtaagtttaattgttacttcattaagcaaagggaacatatacacagatattattgattcctgttttgatgctgatcctaaatctatctattcacttgcagaattatttggctgttgtgttaatgatagtaaatttaagttcacgtttggccatgtatattttaacaatctctataaaatcataaaatatatatatgaaaagatcaaaaacggaaattatgaacataaaaaattggttccattaatgaatttaggttttcatttttcagctgattatttgtttcaatattattctgagcattataaatttgatttttgtaaatgttttttagatacattgaaactatatcaacaaaaacaattatcacttgcacatgataaaaatttatttaaagaatgcatatttaacaaaggtgattttccattttttgattcatttgaaataattttatcaaatgaaacttttaaaaatgaacgccaacgaattttggatggtttaactgatatagttttagatgaaaatgcaattttatatacaaatattaaagaaggttcagaagatttacgttttattttatttaacatttataactttagatttgtgaatgtatttaaaggatttgagaaatgtgaaaatttagaaattaaattttctattataaaattcgaaagttatttcaaatcaatttatattgatgataaaattaatgattcattatttaatggatgttctatttctttatattttcctccgtttttcttattaaagtctttattattacaaccaaaggaaaacattaaaacaattttaaatgataatattaatgatgttgataactttttattactttcttctttaaatgtacaacgtgtattactttcattagatctttatcgccatcaagaagcaacttgttgttacgggttatcaacattcttaaaatatacatttattatgaatacttattccgatttatttgtcttaatgcagatttgtcttggattaactcaaaacaaagaaaaaatgattaatacaattgcacatactattggaatatttgatgaaacagtacaaaaggataaaataatttattttatttttattcattttatttcgactttaatatttgatcgattagagattaatgataataaaactgaaaaattaaatcaaaaattaattacaaaattattattccgacaaaagttatttaattcttttaaagaaatatttcaattcgaaggaataacttatctcaaaaaaattaaaaatcatttggatacaatctcaacttcttctccttcaccaaatggtgtaacatttaaattaaagtcgagaactttatgggatccattagcacctatttatgaatcaaatcaaatattatcgatttattcgaaatatatttcgaaatatccaaatgaattaatgccttttaaaccttttactgaagaaccatttggaatggatttacattcatgtttaaatgcgccaacgcttttagctatcgaatattatattttgttaaataaatattcgcaagaaacaaatcaacttataataaatcttttattaacaacatcgaaattttattcgaaaaaatcaaataaaaatttagaaaatataattatcgtaaaaaatattgaagaattaattacgaaaattccaaatgatttcgaatctttaatgtatcaaaaatatcaactccaaaattattcaccaaaatcatttgtcgatttaataagtgaattaggtccaattggacaaaatgcacttatgcaaatgaatatttcatatgaaataccaaaaacaaatgaaactaaaacaacaaataataaattaaaagatttaaagtcatcaattcttcaatcatttaataacaaaatggaacaatttgaaaaagataataatttcgattttgatgaaagtgattcagcagaagataatgaacaatgttctgcatgtagaactaatgataatgaaattctttgttatccactttatatgtataattcgacaatacctttggaatatgataattatggaacaattgaacaaataaaatgttttactttatgtacacatttagtacataaaaaatgtttacatgatatatgtcccgtcgatagatatttacgtaatatatgtttaccgaaacttgataatcgaaatgatttgaaaaatgaaaatgtatttaaagctgttaatgatttcgaaaaatatttcgttaatacaaatcaaatttttatttcattttgtagtatatttataatttatgagttaagattaagatcgaatttatattgtttagaatcgaagaaatatttaatattaacgcgaaatttctttttaaatttaaaagttattttgttgaaaagttctgagtttaatgtgaaagcaaattcgattttccagaattttgttttggatataataaaatgtgattttcctgagaataaatttaatgaaataatgaataaatatataaatgaacttaatggagaagaattatatttattattaagacgaataagattatttgaatattttgctttaagtaaaaatgaggaaaatattgattggcgaatagaattattaaatgaaaatttatgtaaaagatataatataaaatataatggaaatgaatataacttaaagccttttagtttaacaaaacttccgaaaaactttttgcatttaggtaaagagccatataacttttgtcgtgaaattgagacaagtgaaaaagaatatgtcataagtcttcatgatggaactttaattgatagaccgcaacattatgaaggttcaaaagatgatatgcatcttgtaatgatgttaaattctgcgcattcaagaacaattttggtgtttagacaaagatttcatccagaagttcatttgcttttggtaccatctgtgtacctgaacttattaggtaatgaggatataggtttccaaaatggaactgaattgtttctgtcggaggaaagattaaacacgttaactgatgactttttatcaggggaaataataagacatatacactatgtatcttcatcagcatccattgttaaaccaactaaataaaaatgtcttcagtttgatgtttatgaaataaatcgttatttaaattgttacgtctatgaagatattttaataaaattttaatgattgattttaataacatgtaaaactattttaatcgaaaaggatcattaaattcacaaaataattaaaccatatttatacaaaagaactctatgaattagcatccaacctaaatttagtactaacaccttatcaccttgttgagcatgcaaaaaatagggattgagctctttgaaactaatgatttgttatatgatttatttgaaataaaatgacagaaataattacattgaaacaaaacggttttaaaacgaaaaagtgacagttatatacaaaaaattgtataggttgtttgaattcagcggtttgtagcagctctaaaaggaaaaaatgtttcttgataatgattccttgatccaattaggtgttttatttttaattctagcattttatcacataactgaatttgttttaaactatcttcatcatccaaaagaaacaaatctttcttctttttgcatttcaaaggaatcaatattagcatatactgttggatttattgaatacgcaatagagaaatatttttggggcgagtcaaaatcaaatcttaaatctcctttcttttggattggaatagtacttgtaattattggtttgactatccgttttactgccattataacagcaggaaaatcattcacacacttaattgcatatgaaaaagttgaaggtcatgtattaataacaggtggaatctacaaatatttccgtcatccttcatattttggctttttgatctttgcaccagcaacacaaatgatacttcttaatcctattacaacaattatatttatcattgttacatggtactttttctatgatcgaattccaaatgaggaaaaagctcttctcgaaattttcggtgacagttacaagaaatatcgccacaacactccaacaaggattccattcattaagtaaaagttaaacgagtaaaaaaaattattggtaaatttcatattataagtttatttatatgatatacatttatttaaaacatcatatttttttatgataagtggaaattaatttttgaagaatttcaccgcaaatttttgaaattaatacattttgattattattcgaataattttaataaaatcctaagttttttaattgcataaatgcattattcaattcgctcaatatcaaaacaattcacctttgaataataagttttcattaataataatatatattcaataacgaccaggcctttggtaacaataatggtcatctctgcgtggtgggcttctttctggttctcttcttggaggtcttctatcttgctctgggtatcgataattttctctatggtcataatcataatcaaaattccttggatttgggtaacgatcatcatagtggccatcgcagtaatcgtcgtagtacctatcatctggtggtccttgtctataatattcatctcttggtggataatactctggtggtcttcttggatacatattatttcttggacctctttggaattcttcgtatgaatattcctcataacgtattgattcatacattggaaatctgtcgttccattcggggtttctattttgttgaggatagcgaccgttaacactcctatcacttttttgtctgaatgaattttcctgaaatctttttggcatattttgggcgctttcaaattgattctctttttctaagctatcggaatatagtaaattattcaatgtttcctcgcttcgagttctttgtttcttcgggaatgtaacattagctttcctcacttccatttccattaagtcagcaggaggtgggggaacttttggtttatgctccgaccattgattattaaatgtatcgaatggaccagcaaaagattttacaagttctaatggaggtggtggacacatgttttcagggatatcaacatcttccaaaggcacgtaatgaaatttaagaagacatgacggatctattggtgtatccattttgactttatcgcgcattacattcatcgatttaaaatagccatatatcttcttgttcgcttcttcaacttcattgatgtcgcggaaaggaagaagtggttcgtaccatttcattttatgagggtttattagtggtgcgcccaacttttcgaatgtgagataaactgatgcttcagctacgatgtcgggtggatactgataaaagagtggactaccttgaagatcattaagaaatctaaatgacttttcgcagatttcttttttgaattccaaaaataattgatcactcctggaaatatgccaatgtgttaaattgtctgtaaggtattgaacatttggataaggtaaagggatgtcaaaatgaaaatctagtcgatatataatatcattttctgcttggattaaattttttgttaaaacttgccggaaatctggatccttaatcgaaagcaatttaagactgggaaccaagctaataatgttgctttgcttttgagcagtttctaaatcaataatcattttttgaagagatcgtggtttatcaaatactttagaggcaagatgcaaagaggcaacttgaaagtaaatcaggcttatatcatcttgtcgctggccttgatatgtttttttaaaataaaacattgctgatgctcgagcaggaggacatgaaagctctggtggctgttgtgcaagaaacatttgaagggctattgtgcttttagctatatcttcgggaagttcgtagattttgtgccttcgcttgctggtttctcccattgcactttttaccggtggaaagcacttttttgctaaaaaaataacaacagaaatctcgatttatatgcaaattaaactttgaatatataatgaaccacaaggcataacaatggaataaaataatttaaattgtttaaaatgttttggatttgaaatttaataattcatatttggttacttaaattcaatcttactaagagtttttcaaacaggttttaaactgatttttatttgataataaaagttgtttaaattttaaaatatatttcatttcaagatttgaaaattcaaaaattcgaaaaattaaaaaattaaaaactaaaattacactgcaaaaaataagagaattaaaccacagatttatttttgtggaaacaatgtttgtcgaattccagcttgaattgcttttgaaaattcttctatcttgtaaggtccatttccttctccaatgatatctggtataaggtcaatatcaactccgaaattccttaaagcaccttcaaattgagctcgcgtaattgtccctttgttgaatggatcaagaactgtaaacattgtttttatattatcaggagaaaaacaaatgaatatggcttcatttgaatcacgtgcttttttaatatctgataataactgttcaagaaatgaaactgggtcttcaggctgtgaatatgcaattgctgttgttagtgcttgtactagttgtaaaatccttttttcttttatatattcttttgcactttcttcgttatggatttgattcatcaaaaaaacgtataaaaagtgacacatgaaaaaataaataaaaactcaatttcattaggattttttccttcttaaatttacttcctatgaaatccagatccaccatttaaggcccttatgttctaaaacttcactaaaattttcccctttaatttaacttatttcaattatttatttggattaactctttttaaaacatatttttttatacatcctctaagaatttttaaaataatttacaaaaaacttttgatttgagataatttaacttttaaattatgttaacggccaccaaatattttgccatactttcattttttgaatcaaatatgatcgaatttaaaagtgcattaaccacctcgcatataaaagtgccattttaacgccagaaaaaagaatttcggaggtttacataatagtaacaatttaattttttatgagtacaatcggtgattacaaagtaattaaaattcttggcgaaggttcattctcaaaagtcaagcaagtcgtacatattccgactgggaagcaatatgctttaaagataattgaccaaaatttaatcagagaaaatcaaatggaaacacaattacaacgtgaaattgatgtcatgtcaaagatgagtcatcctggtctcattaaattacatgcagttatgcattcttcaaagtacatatattttgttcttgatctagcacaaggcggtgaacttttcaacaagcttgctcaagatgggccattaccagaagatgctgctcgttcttattttcaacaacttattgatgctcttgattatatgcacaaacataatgctattcatcgtgatctaaagcctgaaaatcttttacttgacaacgaaggtaatttaaagatcgcagattttggtctttccatattttccaataatgaagaccaaatgcttcaaacccgatgcggtacccccaattatgtagctccagaaattctctgtgccgatggctatgatggccggccagttgatatttggagtgcaggtgtcatattgtatgtcatgcttgctgccgccttaccatttgatgctccgacattaccagagcttgcacaagaaatcattaatgtcaaaatcacgtatccatccagctttccgccaggtgctgttgatctgatgaaacacataattgttgccgatcccaaagttcgatacaccattaaacaaatacgaaagcatccatggttcagtgttaattacaatcgtatcaaaggaaaaatcaagaagaactcgaaaattcagtcttcgaatgttactgaaatcaagaaagacaaagagcaacaaaacgaaggcgaaggaattaatgcgtttgagctctttgctaagatgtcatctgttaaaatggatcgattagttaatagcgcagtgcccgtaaatgcttcgacgacattttcttcatcattacctatcgatgagatcaagaacataatcaaagaaacactaatgagcataaatgcacaaataatgccaacgaaggaaaacaaaaacgtactaaaggcttacgtacaaatcgctaaaggttatgtacacattagaatcgaaattacagaggtgcatggaacgaatttaatagagttcaaccgattaaagggaagcaacttcgacttcttaagaatttatagaatgttaaagcagcgattgacttaaaattaaaaattgatttgaataaaatgattttttcgtgaaatatttgcaataaattattaagttatcgaataattattgtggcaaactgataaataatatgatacattttttggaatttcaatcgtatggagaaatgtaaacgcaaagaagaagaaaaaacaaaaaattaaaattaaggtactttacttagtatcccttgtgatatcttaagttctcagaatttcttatttgacatgcctctaaataatctccaaatgtagcctttcctcttttcatgtcttcataaacgcggtgttcataatcaattgctttgttatatcttatataagaattatccgttcgttcaaaacctggatcaggatttcttgttcttgaaaaattcattccatacaaattttcattttcataagtagagttttgtccaaatggttttctatccaatccaaatgttgaatcaacaccaaatggagaatcgttgttgaaataagagtcaaatgaacttgaagcacccatcaaaaaatgaagcttgtatcagctggaaaattttttatatttaaaatcaactttttctgggacaccggacaaaatcactacgtgcaaatggaaaattttaattataaaatttgccaaagatctttgtgcattcaatttctttattaaaaagtgcttttctcaattttacaaccatcgaccgttaatttggtgaaagctgcaattgtctatgcttgtttgaccatctttggcagacgtctttgtggcgtctctgcgatgtgatgaaaactttcgactgaagtcatgatgcaacgtcatagttactctgatcgcaaccttttttgttgtttgctgttttataaatgatattgaataatattcattattgtataattttgaataatatttttattgcatacttggtaaaaataaaataaagtacttctgggaatgaatttcttattatggttatatcttaagtgaactagttttagaaaaatataataacaaattcattaattttaattatgtagtatagcaaattaagagtgccctaataactagcagataatgtttaatattaagagtaaaatatgcaacatgttttactaaaagttttgattcattgtttcgtttttgaaattgaattgcactaaactaaaatttcggcggtcattgtcacttttcccggtatttaatgagaggaaaaatagtaaatccatgggactgtcctccagctcccgatggtgttcataggcttatccacctctcaaatcttcctcctctctgtaacgtttccgatttatctccaattttccaaaattatcaaattgaatattaccatctatttgaaaatcaagctttggttcaatttgctgatccatatctagctcaaaactttttggcaatatatcgcgataaactaacaattcaagattatccaatcaaagtttcaatgtcgccaataactcatttaattttttcggcgggtaccaaaatggccccgtcacctgttatttgtattcaagtaatcaatctccgagtttatttaggcatccaagacatttatgatgaatgttcacattttggcaaagtccttaagatcatttgctttgagaaagctgctgccaattcctttatgcaacccattggacctgagcaaccggttaaatatgctcttgttcagatggcaacaattgaacaagcctcattagtccttgccaacttatccaattccccacgccatcttccatgtttccaattccgtatacaatattccaagaatcatgacattgttatcaaatttaataattctaaaagttatgattttactgatccatatgccaaagcccaatttacacaactccgagaagccactgcaggcgagcgccccttttttgtttttgaacccaatagtgaaatcgattccgtatttgatttttggcgacctgtaattttcgatccaagttttgttcgaactctcacagttagtaactataatgaaaacaccataacctttgataagttgcgaaatctattttgccaatacggcccagttcaacgagttcgattcttttacaaaactcgaaagacttccatcataacattccggaacagcttctatccgcgacttgcaatgacatttttgcaggggtgccccgtagattctacgcatcgattggtcattgaatgtactccgcagcatccgaactttcaggttagggaatataatgaccacagcgggcaggactacggatattatgaggaagacttggatttggatgactacaaagctttgtctttcccatcacagtatgtgatagtgaaaagagtcgacattaaacagatacaattaccacagggagctgaactgttggaggaattgaatttgattaagttccaaaatgtttatgaggcggcaaactttattatgacttgtaatagaatggtaatcggtaaagaaatggtgcaaatggcattcgcacagaaaccaaatggaattaaataaaaattatttgatttgtaattgatcgcaactttgaacaacgcggacaactgttacaatgatatttatcatttaaatgaacaatttttattgttgaaaatatataaaaaaaactcgctgaccgggaatcgaacccggatcacaggaacgacaatcctacatgataaccattacactatcagcgatctgtttttaaatttttttatataatgaaattgataaataatggaattttgcgcttttggaatgaagacgtttattttcaaaccaaagaattgaatcccgccttttatgtaccaatttcgatttagagaaccaataaagctcaacacatcaaatcctgaacctgtatactttagtttagatgggcgttttattggttcaatttttggaaatacaacaatagaagttcgtgattgtctttcattacaaattgtatcaagaatcgaatgtcctgatgttatatctaccttcctttggtctcctgactctaaattaattgctattcttatggataaccagaagtcaatacaagtttactttgttgaaaatttacgtactgacgaagataaccttacaatcccatatatgggattatcaagtggtattattaacatcgaaaaaatgctatggtcacctgattccaaatccattttactttgtggggtatatgcatcacaactttttatcttcgatattggatccaaatcagttcatcgtcttccttctcccaaaaactctgaaacagctttttcattttcaccgattggtaatatgcttgcaattttagttcgtagttcaaatggccatgatgaagcagttgtttttgaccttaacacttatcgccgcaagacaaccattaacttaaacacgcttgatgccaaaaccgtttattggacatctgatggtttgacacttattgtcattgatgagatttcacatcatttactacagatcattaacatgaagactcaacgtgttgtcgactattccgcttatgatgggtatcttggcattacgaatgcgattccatgtcaaaactcaaaaattattgctgtcggcggttatgacggttatgtacgtttacttgtttcaagtgattggaaagttttggccgaattccttcatgaaacgaacatttccggacattctataagtgtttatgtagaggatgattcagaaatgcgttttgttgaacctcctgtacaacttgaaaaaaatgaatttttgagcggaatcacaaatttagaatggtcaaactcgaataagtttttagcaactacaaatgcagaaacgccaaaagctgtgtttatttgggatattgaaacgatttctcttgtgtatgtgcttgtgtttaagaaagatgtagaaatgataaaatggtcaacaaaagaagacattttagccatttcaacaggaagcaactttttagcgctgtggagtcaacaaggaaaagtttggctggtaagggataacaaagtcaatgaagtaaatgcaatacaatggaagcaagatggaagcgaactattggtcattgacaattcatcaaaaaattttgttgttatgtgtaaataaatgttttctttaaaaataggataaaaaggaccattttttgatctgcttaaaaacggaaatactgtggatattaattcatacaattgtcaatcattcatggttatgattatttggctcgaaaccagttctaacttgggtcaatatttgaaaaaggtcatacagaaattgttaaattacttcttgaaaaagaaggaattgatattaatgctaaagatatttatttgttttatttaaaatttatttaaataatttgatatttcaaaataatatttggaaattatttaaattatttaatacagcacttatgtttgcatctcataatggtcatatagaaatcgttaaattacttcttgaacaagaaggaattgatattaatgctaaaaacaaaatttattttaataatttgatatttcaaaataatatttggaaattatttaaattatttgctacagcacttatgggagcatctgaagatggttatacagaaatagttatattacttcttgaacaagaaggaattgatattaatgctaaagatatttatttgttttatttaaaatttatttaaataatttgatatttcaaaataatatttggaaataatttaaattatttcaaacagcacttatgtttgcatctgataatggttatacagaaatatttaaattacttcttgaacaagaaggaattgatattaatgctaaaaatatttatttgttttatttgatgtttattttaataattttttatatcaaaataatatttagaaattatttaaattatttacaactgcacttatgtatgcgtctttaaatggttatacagaaatagttaaattatttcttgaacaagaaggaattgatattaatgctaaaaatatttatttgttttatttgatgtttattttaataattttttatttcaaaataatatttggaaattatttaaattatttcaaacagcacttattagagcatctgaaaaaggtcatacagaaatagttaaattacttcttgaacaaaaaggaattgatattaatgctaaagattttatttgttttaataatttgatatttcaaaataatatttggaaattatttaaattatttgatacagcacttatttgggcatctgtaaaaggatatacagaaatagttgaattacttcttgaacaagaaggaattgatattaatgctaaagatatttatttgttttatttgatatttattttaataatttgatatttcaaaataatatttggaaattatttaaattatttaaaacagcacttatgtatgcatcttaaaaaggtcatacagaaatagttaaattacttcttgaacaagaaggaattgatattaatgctaaagatatttatttgttttgtttaaaatttattttaataattttatatttcaaaattatattagcagaaagaatcttttcagaaattgtttttttaaggatagtattattcacgatatcaataattggaattaatcattaaacagttctgaaagaggactcaacaaatctttcggcttgaataggaacactggagtaaatattctacacatttttcgattgttctttaatgaattactgaaaattctgttgtaaacattcaaaattgaaatgcattgaaaattgccatcttcgaaaaattgttttgttcgccatttgaaattaatggaaatgttctaatctcaaaatttatttttggatgatttatcagtgtgcagtactacgttctctttatgtcttaaatcattatttcaatttggaaattacttcaaatttaaaaaaaaattattacacataatcttaaatttcattttagtttaattcagcccactgttgtgggaatacagatgggaattcagtatcatcgaattcaccaatttcgtcaatttctgtctgtgttggcaagaacaatcccggatcaacagtgcagtacactgcagcagccgccaattctttcacctgtgcgcccacggttaatgttccacttgcaatattctgacttggttctgtatgctttaaaatttcatctgctatttcctctctttcttgttttgtctttaacatttcctttaagtcttgatccatagtaatttcgatatcatcaccttctttttcatatatctgagccttttgtttctctatcatatcatgccaaccggtaaatggttcaacatgaatattatttattatttcatttaattttttcagagaaggggaacttatatactttaaatctgttaaataaattggcgggaactttgacggtttgtcaaatggttcatccgacggtttccagtcaaatacattgaattcttgatcgagaacaactttttgaaagaccggcttggcgccaatttttgaatcctttataaaaccgtaggaatgcttcattaaagattggaaaagtaatgtaatcgattcttgtaaatcaacttctttcttctggttagcttcactagctattatatttaacgcagaataagaaggttcaacttttttgctttcaaggaagaatgaaacaaatgtaaatacaacttttaacattttcacatctccaatttttgtaattgaagcataaaaatctaaaatccgatccatttgtatatcattaccacaagatttataaaatctttggaaaccattttcatcatttttagctaacataattaaagactgttcaacgcctacatcgctcgagaatgttctatctagttcatgagttgaaccagtcgaataaatataaggcgctattgcatacaaagcggtgttgtaaattttatttgaatcgccaaaaacgtttttcactttttctttgagcaaataaataattatttcaaaagtttctttgattgatttatttgtataagttgtattcaaaagtaatgagattaaacatggcaaatttgagacgtttttatattccgaaatgaattgtttacacaaatttatattgtgaattgccgctgaaactaaagaagcatgaacctggaaattacattgtaatatactacaagacgcttgataaattaactctgaaggttctgcatgacttaataacatatataattgttcaagatgattataagcatcttcaaaattatttaactttgtattatttctttcaaacaagtttgcaatgtttctagggtcagacaaagttttaccggaagtgatttcatttaatattgtcgaaattataataattgatttaattattgattttgtcaattcttgagatattggataatttaacgagtaatacatttttaatgccattgaagctatccaagagtcaccacaattcaaaccccattggatcaagaataatgagatatcagataatccggtgaaacagttaattatcgcctcatataaccatggcccgacagtatcgaaacttcttgtgattaattcggttttaggctttgccaagttaattgatgcatttgtagtgagttttgttaacttagtaataatttgtgcacattctgattcgaaatatggataatgtataacacaataagccaaaatataatgtacatttaattgtatagaagaaactccttcatcgataaaactaattattaagtttaatatgaattgcataaacgtactgtattgtattttcgaagttaaaccattattttctttttcatcatcataatcatcgtcaactaaatcgccacaaacttgagctaagaatgcatggaaatcaaataatgtatctaattgttcgatttgtatttgtcgataaaaccaatgtttaacgtttaagtaattaatgaaatgatttattactatttctgtcttttgtgtataagcgtataataacaaatctttacatttatcacttaatgaaggattttcgaagttaatattaatcacatttaataagaattgttcgatagcattttcgaatatcgtcttaagaataatagtaattggatctgataatggtaataaacaatcaagttttaataataattcgataaatgaatgtaatgaaaatcgttgataatattggaaacatccttgataaataccgatttgatcacctttattaatgaatcgttcattccatggtaccattatttcgacaaagaatcgttggattacatgtggattatttaatgccgaatttaatgcttggcgatcattttccaaataattaattttatcttttgttactttatttgatgataatgattttaatcgtattgacttaaatgaacctttaggtaatattgcttgtaatgtcttttgatcttgtctttgtttattagttgttatataatcaatgttttgttgtgttgatttctctaagataaaacattcattaatgaattgttcacttaagaatttaaattcttttgataagatttcattaatttcatatatatcaatatgtacaaatttggataaattcgattgtattatttcacgatgtttcattaacttattcatgaaattaattgtattatctaatccaaatgttattaaaaatgttgtacaactaattatgaatacaaaatcaaatgctacaatacgttgttcaacgatagtactaatcatatatttataagctatagctaataatgaacctaagttttgatatataattgtagtaaaattaatatcatcatcattttctggtaacataattgttgtagatatataatttaagatattatttgttgttatatctatgaattgtgatgcaattccataaaagaaattatattctggtactgacttttcaataaatatttttgttaatacgatgaaataacgtgaatataatgtagatgcaaattcttgatttttagatgctattattattaatccttcattctttaaatattgatcaggtattggagctattttacaccaataaacaaatgctgattgaaatgctttcgaataatttgatttagtcgatgataaattataataaaaaatataattagtttcattagatacactatgattagttaataatttagataattctttacgtggtaatatacctccacaatgatatttttgtttttctgataattctttaaatatttctttaatagctattgcaaaatcatataaagaatttgaataatttgtatcaattttagtttcatctactttaaaattgggacttttttcaatagttttaactttaaagttataatccataaatgaatcataacaacgttgtaagttttgtgaaaatgtatcacctgaagtttgcattactataaatgaattatctaaagaacatttataaaagaaatatgtaaatggtcgaattttcccaattaaaaagtttaatatatattccgataatttaacattagcgcaagataataatgcacaatctgcgatatctttattttcgattttaatatttaataaacaatctaaataaggtgaaggatcatcagattgacttgaagttgctaatattaatgatacaatattaaaatagaaataaggtgaagaagataaatccttattaaacttaattacttgtgataaagcatcgaatacttgatatttataattagcatccattgtagaaccaaatgctgataaataaaatatatataataataattgattactacctccaacatcagataactttaatgattcaactaattctttcttataatcaggtaatattgcatgtatagcattatctcgtgctaaattagatgcaattaagttatcatcagaaaagaaattatagattgatgaattaggtattaatgaagaagttaaaaatgataattctcgtatttgataatatggtgcacagataccaattgatataatttttatataaattgttgtcatttcattattaattggaatcttttcgaaattaattgtttctaaaatacatttaaatgcattaattgttacatataatgattcaaatgttaaattattaatagataacttatataatgatgttaatatttctaagacatattcatgctttaaatgtattgatgcttgtaatatccttaaagctgtataactattttctgttgaaccattcgctacaactttacaaacatgttctaataaatcaaatgaatctaataaatatggtacaagttgtaatacattaattgcaaagtttcgtgaactaactttaacaaatgttggtgtgaaattaggtaaattagttgcattataaggccaattttcttgttcaatatttaatcctttcttccatcgatttaatatggttgaaacaaatgttttaggtcctgttaaattagttttataagatgcgggttttcgacttaataatttatgaatatctaaatctgttttatcatttgatgaacaaatgttttctaattgttttgttaatgataatggaatataaggtgaacaatcttctttaggtatattagaaatttcacttgtacatttctcagtaactatcattgtgaatttcttaatggattctggtgttacataacttgaatattccaaaaattttgattcttttgataatattcgagaaaacactaaaaataatgcggatttgatttcagaatatatttctttatctaataacttctctaataatgtattacaaaacatagtaaaatcattcgaagcaatttgtaatattaaatcaataaataaatcaaatgttttcttggaatataaattacttatgttatttataatgacttgtaacatattatttaatgtttgtgtatctgatttacatacccatttaaagttttcatgtgttttttgtaaaatgggttttggtatataattctgtaaatacattacacgaataaaagcagataatatttgcgtttgattatgtggcccatcaattcgtttcggtattttctttgtgatgaaatctttaaaattaaatttgtccgaatatgtcgacatgaatgaatataactcaaaggaattcttgtcgtcatataatttgctcttttctaatatttggcggaataattcatggctgtgaaagtttggaatttgtttaagcgcttgtccacaaacatttaataagaaacttgctgattctgttcgacatgtacctgaactaaaatatccataaactggattggtgatgttggtaacttcattgatgttcttaaatttatagacaatgtgtgataagagtgcaagaaacaatgatggtttggaattattttgggatgcaaaaatggaaaaggcttcttgtacggagttgaaggactcttctggaatgacattggataagaatgataatgcttttgaccaatgtttggcaagaattaaatatatttcatactcaatatcggaattatgcttgataagtgagtctttgatgatttgattataaagcttggtggcactggctttatcaaagttatcaatattgttgagttcttcacataatgatgctattgtatttgaaatgaaaagattaacaacatacattattgatgcacgtgcatattggttactccaatcaacactagataagtgttgaacaagtttggattcacatgttggcttattattttgatttatatcaatttgtggaagagctgtacgaagactttgatatgattccattattgaattggcgccaattttaccacacgtatatactaattcttgaaatgcattatcattaacatgacttaaaccagatataaattttatgaaatctttgtcattttttgatgttgatccttccatggccgtttgacatagtccaacaagtgcttgtaatgagttatcaattgttgataaaataattgtttttggtgtcgccatgatttaaccaaataaaaccgttagaattgtcaaatgaattgctgttgtttctttactttacagtggcactgactttttttggtaaattcaattatctttgtttgaataaagtttgtgaaattgttgaatctcaaaaaaatcaatttttatatgttgctacaagttctttagtataataaactgtggagaaaacagtaaaattaaaatatatgtaattttaggtaagtaattaatttaactgaaaaaattctctcaatgattcacaatttaaaggattatattaataaaaaaatcaagctcattgttgaccatagtaataagatgatctgttaatcaacatatttaacttaaatcgttgtttttaaatcaacattttcagcatatcgcttattttactcaaaatattttctcatataatattttgtgaactttacttgtggaagccgtttgttaaaaaattaaacgtgcgagaattagggatgtttgatttcgatgattctttttcatttggaaaattaaagtattcagatgaagaaaaatcaaacagtcatggattaaattcaaaagaaaatttttcatattttccagttaaatcaatatcttcacctcaatttcagccatttaccaacctattcatatgtgttacaaaagcatttcacctggttggatgttctatgacttcactgtttttgaaaattcggattatgccaacaattccaatcatcgaaactcaaactgtttggtgtataaacagtgacgtaaattttcgttgtggatattcacttgattttacccaacaaggatctttttcactaagtgaatacactccagtcattgaattttatcgtagatacaatacagaatctgaactttatgccttttcacttcttccactttcttctaaagaatctgttgagtgtgaaggtaaacctcttacatttttatacagaaatcaatcaattgatcttaaaagtattcataatggtcaaaatgttggtataataacagtaacagttgctcttggttttcctgagaaccaaaagtacatagatcctgattttggccgtcctatattagatgagtcaaaatcaaatgaaaaaccagccacagataaacaaattaaaaaaagcacgcgcaaacaccacaaacattctaagtcacaacacaagcatcgaagtcggcataaaaaacattcttcttggtctctcaaagcaattgccaatggatggaacccgccaagctatgtttcatccgattggaaagaaaaagcagtatccaaaggatggaagccacctacttctaacattcattctagtattggtgttgagtgtattgtgaacgaacagaaaaacgtttccatcaaatgcattcaaacagagtttcacaaaattttcgatgtagaagaaaatcaacaaaacaaaacaaatatagatgatttagaaaatgaaattgacgaagaagatgaaataatgcaactaattcaccttatgaatccgaacaaaaataaaaataaaataaagaaacaagatgatagcatctcatcatcagaatctttaccaaaacaactttcattgtcatctcctaaatgtttgttttcgaattatgaggaagacattaaacttactaagacgccaattataacacttttcgatgtacaagcaattgaaataagtgatacaacagatttaagcgaaatttcatcaagtatcgaaaacattgatgatttggtaaatcaatcctttccatcaaaggctagtagtgattcaaatgtatctgaaattgatgatttgtctgaaccaaatattcatattcttgaaaatttcaaactgagtgaaacagaagaagaaagtgaaaagacaaaatctattgaatctgttttagagtcttcaaagaagctaatttcagatacaaagattagtgatagtataacaattgaagatgaagagtccgaagaaagttcaagttttgatgccgatgaaattgtgaaaagatttggaaactttgacgatcctgagctgaaacatttgttttctgtttttatgggtaaggaataaatttgtatttagtatgcttttgaatcatgtgaacctgcgtcatattgtgaccgatattagcagactttcgactgtttaaattgttactttcacacagtgttttcatcggttgttagattctctccaaaacactttagttcttggaatacaaaataatgaaaaaaggaatattcatggcagaaattattgtggtacagcaattatggtttaagccatctaattctctcttggaccaaagtgttatgattatatacgaaaaatattcacattactgaatcgtagaaatattcaaagacactttaaaccagcaatcaacaattggaaattatcccttgttaaccttatatattttactggtaaataacacaaacgacaagccccaaaaaggtcttcttatagaaatactttatcaaaacctaccatacaatgatttgaagcaaataccataaattttttctgttccattgtgcattcacagcatttgatatcaagaaataaagccattcaaaatattatgtaaagttttgaaaataacaaaccccaactttttgtatgttttccttcatgttcaagaagaatttaactgtttctgatgcaaacataagtgctgtgcaaaataatttaaataattttcaaatattattttgaaatataaaataataaaataaatatcaaataaaacaaataaatatttttagcattatcaccataatttgatattttttgttttatattattttttcggattgtttttacatcatgtcactagttattgtataaggggccccattcaaaattcaatacatttgtctgttaattgtgttggaacaaactttttgaacgttaatcattcaaaaatctaagatgacgatatcatcttcttactttcatttttttgactgcttcaaggtaattttctgtcacttttcaaaaacgttgtgttgtagccttgtgaacatcctccgattgcaaaaacaataaaacgcatacctgtaaaagttgaataaactaacaacgaaaaggcgaagcggttgaagctatctgtatcgtttttgactgatttattagcaagtttccgaagttttctcacaaatgtgttttttcttcttggctttccccatgtatttcttttgcttattacaaacctctccacaaaattcaggttcaaagattattcgtgatcaattatctattttccaaacactcaaacactcgccttaccttactttagaacccaaaagggataattactttatattctcaagtcataacaaagagaacgtatccagtaaagtcacaagctttgttatgttaaaaatcgattcattatcttttaacatcagcacaagaaaaaataagtgtcatttccctttattagaattaccgatttcatatgttaaacattatttcaggctcttttctttagtattaaatcatttttcattaaaagcaaatttagcaatttcaatgaataattgcttcatgaagaaaatgttcaaattctgtgaaactgttcaagttctaatgtataacttttttattttgggatttttcttattttatgaacttaaagttttaattaacaaaatgaaaacaagcgaaaagaaaaaacataaaaatgttttaatttttgttatatttttcgtgaattcttttcaaatattttatgatggtaattcaacattaacaataataaattcaaatgattttaatgatattgaacaatataaagatatcacgaaatttataattattagtgaaggaatttatacaattccaagtaattcattttcaggatggacaacagttatttcagttaattttggtaaatcagtctcagatattgggggttctgtattttcgttatgtttaagtttagaaaatattatttttggagaaaatgtttcaacaattggcggttcagcattttcaatctgttcatcaatcaaaaacgttacgattccaaattcagttacaatgattggcggttatgcattttcgtcatgttctaatttaagaatattaacacttggctatggaatcagagaaattgggaattcagcatttggtaattgttattcacttgaatgcatttattattatggtgagacggaaccagatattggaataaatgcatttcttaatgttacaacaacagttataacatatccaacatataaagacaatacatttgcaggattacctgttgtttctggttctatcgaagggaactgcaatccaattccaacgaattcattttcatcatcacatacattcagtcgcagtgatacattcactaagtcaaatacatttactgaatcatttcaaagcgatttaacattttcatattcatatacattaacatatacattaacgattacttatttatttacatattatgagacgcaaacaagatcactttcattatctatagttaattcaacattttcttatatcgaaacgaagtttatttattatgattacacagttattatttattcaacgcattttaattattattcaaatttcattacaatgtttcacacgaacattttacagacaaatggacttacgactaatgttttaattggaattgtttgcggatcaattgcatttatattaataattgtcggaattgttacgttcttaataaaaagtaataataaaaaagaaaaatcgatttcaaagttacaatttaaggacacaacgacatcaagcacaaaacaaattgaggaagtaaatagtttagttgaagatattgttaaagaagatgaagacaattggctatgatttgactgtaaaataaaatttatttttatttgacatattttaacatatttaaaaaagtatgaaatgattcgcaatgagaaatggaaattgatttacaatttgttattattaccaatgataaaaacaaagataaaagataaagaatattgatttgatgaaaaatttgttagatcaaattgaagaaaaaagttttcaataacaaaaagttttatagtatataaataagtattacctttctaagttattaaatagtaaacattcagttacatttatttagataatcattatatcaaaaatatatcctttaaatgaaaaacactatattatatatcattatatttaaagttaattaaacttactttataaattcaagctattttgaaacatcattgatagaatagaatatcatatgaaatatatttatattcaaggaaatgtttaattcatttaatttatatcaaacaaagtaaattaacatttaaaattcaatatctcttgaaaattatgaaatttcattttttaaaaaatgtttaccagtcacaaagacatatcattttaatcaccaaaatcaactctaacacattcattcattatcttatttaaaagtgaccttataatcatttaattcagcatcttttgtgggtgtttttaaatattgaaacaaggaaatttaggttaaattgaaaaacttcaagaaaacaacgaattttttattgattaaccgtgcgatttttaacttttgtattggccgatgtgtatttagtaaaggccttcaactatcagatcgtgaagcatgaaaatcctttttttactgttcatttcgaacattacaaagcattctagagccgatacagcaccaggaaatccattttttaccactataaaaatatcaaatatgaaaaagaaccaaaacaaagaaaggccaactcataaacacaatgttggaggtccaatatctgatgtaaagaacaaaaattttgatatatttaacaataattatattctctttaaaacatgtttattttcaaatttcttgactaacagtaagcgtacatcaataatacctcaagtttttaacgacaaaataaaattcccagtttcatttttttcaattaatcaaaataaatcttttatagccagaatgcttattgaaaacagcatatcaaaacaaactttgaatagatgttatgggtgtatctctttgatccagtgtaaatttcttggtttttcattgatgcgaaacgacaaaggagaccgaccatttaaattcaatgtcattgttcatttaaccgctgttttttcaatgacattagtggtttatatcaatttttttcagaaaaggcatgtaaccgcacagaaattgtttttgaccaaatatgtattgaaaacaagcgaaaagaaaaaacataaaaatgttttaatttttgttatatttttcgtgaattcttttcaaatattttatgatggcaactcaacattaacaataataaattcaaatgattttaatgatattgaacaatataaagatatcacgaaatttataattattagtgaaggaatttatacaattccaagtaattcattttcaggatggacaacagttatttcagttaattttggtaaatcagtctcagatattggggggttctgtatttttcgttatgtttaagtttagaaaatattatttttggagaaaatgtttcaacaattggcggttcagcattttcaatctgttcatcaatcaaaaacgttacgattccaaattcagttacaatgattggcggttatgcattttcgtcatgttctaatttaagaatattaacacttggctatggaatcagagaaattgggaattcagcatttggtaattgttattcacttgaatgcatttattattatggtgagacggaaccagatattggaataaatgcatttcttaatgttacaacaacagttataacatatccaacatataaagacaatacatttgcaggattacctgttgtttctggttctatcgaagggaactgcaatccaattccaacgaattcattttcatcatcacatacattcagtcgcagtgatgcatattcttgctctaatacatttggtcaaagtaatacatattcagtatcaaatacatttagccaaagtaatacattttcaaggtcaattgcatttatcgaatcaattcaaagctatttaacgaaatctttttcatatttaataacttttacattatcaattacgcattcatttacttattttgaaatacaaacgcaaacaatttcgctaattacaattaatttgtcgtatatttatatagaaacagaacttatttattatgattacactgttattatttattcgacattttacaattattattcgaatttctttacatttatttatagaaatgaaatccagacagatgataataagacgaaaattatcattataatcgtttgcgttattgttgttgttataataataatttcattacttattatattattgattcgaattaaaaacaaaaaagaagaaattgctgaaaacgaaatatcagaacaacaaagtgataataaccaaaattcaaatacattcataacaggaatatctatatcaaatattgaagaagatccttttgcagatgattttaaagaagataaattcattgaacaaatataattttaaataaaacattgtctgtaataaatgaaaatcattttttcgattttgagaaactcctaaacaatttataatgttgtttaaatttgttcaagtaattgttagtgattctcaaagaaaaatttaagcatcggtaaacatatcttaacatcataaaatatttttgtttttgttttcgtagttgattgaatttgactcatatcgtcttgtacacagaatcaagacctttgccagaagaacatttgacaggttaaattgttctttcgtgttgttttgattgattgaatcgacattcccacaaaaagtatcactttttaatagttcaaaatatgggtatttgggtgtgtaattgcgttacgaagtatttcagatatgttatgatcagaattatttctggtagattaaaaattttatttaaaagaaattttataagaaggctcgttggttaaccaagtctgttaacagcctctaacaaatgtgagtacaaaatatggattaaaatcaaaagcttaaccagaaacaaaattaaaaagtttcgtttacctatgattattcaaccattagtttttttctaacgaaaatatgtaaacaggatgtcaacaatgcttcttgaagaacaaaaattcgatgaaaagtcagcggcttattcacttttttcattgatttaactgcaataatttaaaatacaaattctgggttaattacttaataaattcagataaaaccagataacataaatctccataaataataaatatattttttgagtcgtaaattaagattgcttcaaaagaacgcgaaatccagaagaaaagaaatttcatttcacttaacatgacatttgaggtgaaataaaatgattcggttttggaagcctagcacccccaaggaaaaggaactctctgaccttatgggcaagatacaaaaagagagcgacaaggcccttgtttctttgcttccccggctcatcgaatttattcctgaatatacaaaattaattttatcaaagctctcatccaaattcgtagatagtttaaagggtaagacgccagaacttactgatgctcaatgcgcaattcttgatcttctttgtgtatttatgcaaaattatgatccacaaaacccagatacaaatccttataatcttttgtttagtgagtcccatttccttgataatctattttctcatgtttcaattcttgatctccgtcttataatggtcataacaaattgctttgaatttgatccaatgcgctttgttggatggataaaaaagaactacaaagctgtgtgccctttgattaaaatggcctcagaaacccaaaacattgagtcctcaaaattagttcaaagattaacagtttccaatatgaaagaagtttatccactgcttgcgccattcatcaaaccaatcctcccaacgtttccggtctctgttgttattgattttatgatcgcaagtaatgaaatgaaggaaattatcccagaatcaaagtttgaagattggcttcttggtcacccaaggtttactatctcggacatagagtgtgttaccaagttttacaacttcatctggcttagtgaaacaacaattaaattaatacttcgctcaacgccacctgaaaaggtcaaagaaatagtatggttccacagccgaccagctcaaagcattaagctatctgaagaagtcttagctgaatgtgaaaaaagattaattgataatgaatttataaatgaagaatcacgcgatgatgattcaaggcgtacaacttatcactttgttcatctttttgctctttcatttgctgatccaaaccaagtttctgaggaagttatgaaatttgttgtatcattaattgaagatgaaaatgagtacattgcttctgctgccatccaatgcttcataatgtgggttaacaactaccaatataaggtcagtcctcacattgcatttacaatcgcatcaataattgccgatagagagaagggaccgtttattaacctctgtcaagccgctttaaccgtttttgcaacgacacttcctgtttcggccgcaattttgactgaagatccttctttaaggttctctaatagctctgtgatacaattaaagagatccgcatggacatttccacactttgtgaaaatattgaaatcaattgctacaatgaaggtcatcgactataaccaagcatacaacgcattgggatatgtttctgagtttctatttgatggaaactaatgtttcaagaatattttaaacattataatgcttaaatcagttttactgtttataatgtcaaaatgttacaaagtatgtctgaattttatatattggtagaaagcaaggtaactaataggaaaatttccaagccaagttatttataggtaaattcatgatatgcgcaaagatcaaaatctcaaataatgaattcatcctcctcataaatttcagcaaacatgtttttatttcaaataaatattatttttattctctcactgaaaataaaacattcaggaaatatatttatgccattagccaactatttccaaatattaggccacagaattaagtaagttggagaaaagatatttttaattataccctcaaaaaggcggacctcttcctccaagaaatgaatatgatttttttttctggaagaaaatgaatcattttattctttgttaatattacttgtaagtgaacatgaacacataaattcataataaattcgaaatcaagctttcaacttgttattctcagaaagattttttttaaattattttgagttatcaaaatatattactctctattaatatatgagtttaaatttttttgtgaaattaatgtattttctgaaataaaaaggaaaaatatatttttacaaaacgaccgtttattaccagatgaaaaaaaaataaaatgcagaatctccaattgttattacattttcaccaatgacagctgcttataaatggatctaaattttgttatttttcttatattaaatttgttttcatatctttatgcaattaattttttaaacatactttaattctacctaaatcatcgtatatcgcactcccgatgaattcatcccctcctgattaaagtttgtgcccccttgtgtcaaattactttcaactttatgaaattctaagatattaaatttatttcaatgccattttgtaccaaaacaatttctctattcaactatttgaagacaggcattcaaatacaacttctacaaaatgatattaaaattggaatgtatttgttttaaaaaagtaaattaattgttgttgccttgtttctgtggataatgcaaaggcatgaaacactgataaaacttaaattaacattatgaaaaacttggaatagcttaagaataccaaggatgataagcgtttgttaaaataatcaaatagcttataaatctaaatgaaaaaatcatttttttgttgttcatttatcgagaaaatatatttgttttttctttttgaataaatcgactagtttggacatataattcgcttccaagatactgctggatacaagaaaggagctgtcatcaaaaaacaataaggaattttaaaaaaaaaatgttcattgtttatgaagataatttctgtgaaaatatttttgaatgaattagattttaatttgactgtaaaaggcgaaaatgaaaagagaacattatcatctcacttatcattgtttatgactcatatcgatcaaatttttgatgacaatttcaatttcagatggaaaacaaccaatttcatacatttttgatgaaaatttgaaggttttttgtttgagttaaaatcaagaatatatcttccaattccaatcatcaaattgatgaaaaaatatgaaatatatctattaatgactttcagcattcgttttattgactatatttccaacatatttcatgatgaaaatatttttcataaaaatataaaatatataaatttcaaaaacaaaaatgaaacagcaaatcaacagatccataacgaatatcctcattatatgttcaataataacaaaaatcattcaaataacaaaattttatttttctcatatgaaaagattcataaaataagttataaatattatcatttattaagtcatttgtttacaaatttatttgctatctttaaaaaatgtttcgaattaacttcttcttctaaatttaaaaatcactttatttattctttgaagaaaattctattttattttgatatttatataataaataaagtcaaaatattttatattttattgaggaatttcttttgtttcatatttaaatcaacaattaaaaatttatatattattttatttttaattatatttaatattctttttcaatttattaaatatttttataaaagttatttaatttatgataaaaataaacaaaatttcaaaatatttttgattttaatgattatattttttgttaatacaaagcaatcatataacgaagagacaaaaacactcacaatatctgattccattgattattcaaatgattacaagaatgatacagaacgtgttataattattgatgttggcgagattgaaagtaatgcattcagagaatggcctttattaacaacagtaataattggagaaacagtcggaaatatcggtaatagagcatttgcatcatgtacaaaattagaatatgtccaatttccagataaattaatgagtggaattggaggtggtgcatttgcagaatgtatttcattaaataatattacaatccgttgtaatagcattggtgataatgcattttataaatgtacaggacttgaaacaataactttagctgtaggcgtccgaaatattggatcagatgcattcagaggatgtacaaaccttgtgaatatttatataccaagttctgttacttcaattgggaatgcatttttagaatgtacgaaacttcaatttattaatgtttcagaagaaaatattggatattcgaattatgaaaatgatggcgttttatatgataaagaaattacacaaattattagttatccgaatatgaaaagtaaaacatttacaattcctaattcagtcatttctattatgaattatgcttttgcaagttgtaataatttagaaagaatttttattgatgaaaatgttcaatatattaattcatgtgcatttgttaattgtacatcacttcaatgtattcattttaatggagaaatttcaccagaaatacaaaatgatgcatttgtcaacatcaacgcgacaacagttatgacaatagaaacatatcaaaatgaaacatttggaaatatgaatgttactaagggaacaacacttgacgaatgtctcccgccaacacgcacattcactaactcaaatacatttacaaaattgaatacattcactgaatcacttccatctgatgcaactttatctttaacacattcgttcactttaactcagtcattatctattacactttcgattacattttatagtaaatacataaatacaatttcattgttaacatttgaatccacttatagttatatatcgacaaatgtcatttattacgattacactgttatatattattcgtcttattatagttattattctgacttttatacattagttgtcactgattatgatgatgcaccaaaagataaatcgatctcaaatgaattgttaattggtattatatgcggtgctgttgtgatagttttgataattgtcggaatcgtaatatttatgattaaatatcaaaataagaagcgaaaacaaaatgaagaagaaatgaatatttcagatgaaaataataataaaattaatgaaatcgataatacattttcagttggtattaataattcaaatattgaagaagatccatttgcagacgatttcaaagaagaaaaatttataaatcagatataaataaacatattttaagaacaaaatattttaatttgtttattaatttcatcaatccaaacttttatgttatttagcaaattttatatttcttctattatatgattattatcgtaaatccaatttatccaaatcataaacactaaaagtaaatgataaattatattaaagaaaaaattggaaatttagagatattatggtaaaaatgcaatatttttttaaaaatcaaaagaaagatattcaatttcaaataagtgtgcgtcttgagtagttctgcttttatctgtgataacttaagtttgaacaaaaagtaaattattatgaaaataacaaatatatcgttaattcattgtatctaattaacgcattttttaacatatttatgaagtttaaaatcattatgcaaaagtttatcataattttcttgttgttttcctaaaatgatgagcgttcatcaatcaaacaaagtataaaataaaaagttttttttagtatagaccatggtcagcttgatgtatgaaagcttacaattttacttgaaaaatgaaaaaaattgtatgcatccacctccacttcataggactttttgaatccatatttcttcattgataaaaagttaattttttcgtttgctattagtattcattaatggtcttaattattttcaattttcttgatagttaacaagagtttgtcaacaggaaaattcatgatcaaaaaaatatctataaaaatttatatactaaaacatgatgtttattttgcaaaacaaaataaaatattataatattactatagtaaaaatatgtgattagatgatcaacctccttcttttcatctctgtgttatagttttattttttaggaggtaacgatagatgtcccttcagaaaatttgtaattactttttcaagcatatacacttaaaatataaataaaatttgatagtgaaaattatttggctagattcgggttatttgagtatataacttttatttgtataaattgaatatttcgaaatttgatggaaaaattaattcataattttttgattatttatacatattaatatgcacaataacattgctaagtatactatcaggtttatttcaaaatattgatttcgagagaaagtacatttattatgaaaatttacatgacaaaagatcatcaagactcacccttctttttctcttaaaaattttatataagcatttatatatactaaatttaattaatttgagatatttaaagatttctttcgctgaatttcgagaaaaagtagtattttgcacgacggtttaaaacccgcgatttatcattcaaatattgtacggttataaactttctggatggtcattaatcgtcggtgaaagaaaatttgtaatgcatgcatattctaacaactttttctcaaaactcagcagaagaatctcaataaaactttgatatcatttcaaccaaatcatcatcataatcatatttgaaaataaagaagaaaaaaagggtcaattttttttatacttgatttaaatattgcgtttttcaataaaattgcagcttttggtgtactaagaataaaagaaagaaatcatgttctatatgtaaatttatcaatgatactaaaagggttaactttgttaggttactcaaaaccgaattcataaaatctgatgaaaaaatagcactttttaggaaatgattcacttttacattttcataaccattaaactgcctgtccaatcccttcaatttatgatgtaattatgtgtaatatgatgcgcgttttcataactatcgtcatcgaccacaattttgatgaacgtttaggccttaacgtgtttcgcgaacaaattcaaatttgaaaacattttcacctggcgaaaacaattcaaataaaaatctattttataagtacaaacttgcagcgaaaattatgtcgcgcttaatcaacttgattgcctgcattatcatcagctccaaatccgagtcacccatttggtttgcagcccttgctgtttgcctcaatatttcctctgttcttttcattgaccgaatcactgctccttcgaagaactgcgggttatcctccatcagctgtgcgaactcagcgccgcctgcccaattgtacgtcagcagcataaacgttgggtctatatttttcatgtaatcatcgaaattcgtattaataccactttctctacttatttcgacaattctctttacgatttcttttgtttgttcccattgttcgcttaaatcttctggtatttccgcctcttctttagatccactatcacatgcgaatatacaaagcaatgaagcgatttgttgtggtgtcaaatgctttaatattccatcgaataacatttctgttatcactaattcatcaccagctgatattattgaggcaactctacctttattagtgatcaatttttcattatcaacaaatccaagtttttctaatacgttttgcatcgattttaagtcttcttgcataacagcggcgtttaatatttggattctttgtcttaaatctttaatcttttgttgaatttctcgtttctctttatatttatttatatcgaaaattgtaatatcaacaaattgttcggaaagttttcttaaatttccaattttttcgatgtatgaatcatatgtatctttattcttggtgataagatctctttcgtttaatattttaattccttttgatataatcttatctaaactattaaacattcgattaattgttgttcctgaaagttgatcattattaaaatcaattgattcttcactaataccaatgatatcattaaaatcaacagaaaagatataagctgaagcaccttcattagtttggattggtattaatgtctttgttatagtctcttgaccttttaatgctatcaatgcttcattagttttcttgtttgttgttgctactactataccccaaccccaaccattagctacttgtacaattcgacctttagttataaatgttccaatgttttcaggattatatattaagttatgtaattcattattaaaatgttcaagttgttcatctatttcaactctcattctaattttagcttcatttggtatctcaaattctgttattatattattatatttctctaattcattgtttaaaattggtatttgtcgttccatttgaaattgatgaaatgatttccgcattaaatcttcaggctttatttgacttgaacataataatgataataacatatgatatgttatatgatattcactatttaatggttgtgatggtgattctaataattgtaatgtttctgtttcatcatttgtatcattaataactattacgactgatccaaatgtatcattatttcgtcgtcctgctctaccactcatttggataaattctcctccggataatattcgtcgttgttgtccatcgaatttatataatgaatgaaagataactgtacgcgcaggcatatttaatcccattgcaaatgtttctgtagcaaataatatacgaataagtccatgttgaaataataattcaacaaattctttcataagtggaattagtccgccatgatgaataccaatccctcgaacaactaatgatttaagtttgtcgatttgcggtaattttttgtctgattcagataacttttcgatggctacttcagctaattgttcgactttttgtgagtcttcttcagaaatatatgacgtgttttctaatgagtatggtaattcatcacattctttgcgtgaaaatgcaaaaacaagaatcggatctaagtttttgttaactaatgaatctgctacttcgcacgttaaacgatagttggcattcttgtcacttttttgcttggatttcatcgccgataccatcatctgaacagaaatgccatgaaagagacgcttaggctgagaaatttgaactgtaggaaccattgcaaaggcagcttgaagagatcctttatcaacaggaccatcgccttctcgaactttataaagatcaccaccacgtggggctaaataataatttaatggaacagggcgatactcagtataaacaacatgacatggttgatgatgtattttagcaatccattcactaaattctcgagaattaggtattgtcgctgataaaaatacaaatctgacctcatcaggaagtaaaacaatggactcctcccaaacaacaccacgttcaacatctttcatgtaatgaatttcatcatatattacccaatataactcatgaattaatgaatcacctctgtaaagcatcatacgaagaatttctgtggtcattacaagacatgatgcacttggattgattgttatatcacctgtaataagtccaacgtcatcaaattcatcttttaattcacggtatttttgatttgaaagtgctttgattggtgatgtataaacaacgcgcgcgccttttgtaagagcagctttaactgcataaaaagcaattgccgtttttcctgcagatgtgtgtgctgatactaaaactgattcgctgttgtgaatacatgcaattgagattttttggaattgatctaactcgaattcatattgaagaagtggttcctcgggaaaaggaacattttcgattgatgcttgaccgtttggaagagcaacataatgtaaaacattgtcaccttctgtttcaaatttaattgatgttggtccttcgtcttcctttaattcatcaggaagaggaacaaacatttttctttgaccaaggaaatgtgatgtgaaattctttttttagaattttttttttcgttgttacacacacactttgttgatttaaaaattgaaccaaacaacaaggaatattcatcacgattatatatatggccgatttaaaaaaaatcgattttgaaatatattcagggtaatcaaatgaatattgcaaaaatagtcaaaataagcatgctctctcttcgccagctcaatggaaagaactgtgctaaatattttatttttttctcaatagttttgttttaatttcttcttttttttttctaatttgttccaaataacgtaagaactcttaaatttttctactaaaaacaaaggtaatcattttaatattggaacaaaatttctgaaaatgaacaattaaaaaaacatacttctttcttctttttaatataattgagttatagatggcttgctttcccaaaaggttactaagtatttgttttcatttgatatcaaataaattttttcatgaaaaaatttattttatatatcaacattttaagacatcctttaatagaagacattaccaaggaatagtttagtagaggaatatgctggaaaaattcattttttatctctgataattcctattgtaaggtaatcatccattccaaaaaagacgtttatctcaaaagttgtgctttgaattctgcggtaccgctgaagaaatttgaatggaaggaccagaaatagctttttcaatccattcaattgtggaacgtaaacccttgaattttgttaaccttccatccgctcagatccgccttcttaagctgaagaattgccaaagccttttgctatatgaagcagtttgtttgaacaaattttttgagttagcagaagtttttataaaaacgagtaacaaatttatcaaatctctttgtaaataaaatctcttccgctcttgcacaaagagcccagcaagattttgcctagaaaatataaaatattgaaattatacggttttcaagggtgtttcaacacaaatttttttatatcataattcaattttgagtggattatatgacatttgaatataaaatgcaaataccccgtctcatctaaacaatagcatgttttattgctaaaattgtgatatcttttcattattattattttatatgcaataagaacatcgtattattatttaaactcacaaaatttttgttttcatatttgaatgcattcaaaacaagaactgtcggttgtaaacattttatggaagttttagcgcccagagaaattcaacttcttttgggcatatgaaaaagatgcatcgaaatctcttttggatgagaggcttggcacaatgtatccgccgtaaacaaagtttaatattcggcagaatgggagatacatccttgcgagttgttttgtgaagctttgatgatgaaacatgcaatgattagcaatgaagaccatggcttcgtttaagctatcaaatcgtccgttgttgcacatccgaggatcaaatggaacaggtatgactttcattgatttgtattgttgcttcggaagaccaatcgataattcggccatgggtatggtctttttgacctgtggcattgttatgggtggtgcaatagcaaactggttgaggggaatctgctgtggctggaaaaagaaagtcatgattcgaagtgattttctatgcattcaattctttcctttttcagaaagtcatttaacaaaattgaatgggtatatttcgtctcaacggttgtgtttattatgctcatcgtggttcacttttgactttttaaatagtttacttgcatttttcaattccttacaaaacttttattggatttcaaacaaaaaaatcttcatgaataattcttatgatgagaacctcgacatatttttgaagaaaatgatattaaatgcattttatatttaagaattaaatttctatgtagagactataattagaaattttaattttgatattaaatgaaagaagttttgaaaaatcaaatttaattcaaaaaaacacaacttttcaattcaaaaaaaattgagggcaatgtggttcatcatcggttttatgagataaaagttgatgttttatccagaaaattttttgatttcatattcatagagtggtatttgatgccaaatgaatacgtttcccgttaaaatgtttaaattccagtttttaaggatgttttttgaagaattaactatcattatttaagtaaaacgatgtttctttgcaatttattttaatcttttttattatttatctaaaataagtattttattcttccattttgacataaatttatgtgcttaacgaaaaaatatttaaaattttattcattttaatattaaagttttggtttatttatgttgaaagattaaaggttcttatcatatttagaaaatgattttaagaacctttgaactttattaaaatttgtttccatttttacgatagatatacttctgtataagtaatataaaatcaaaagacatcggtccaatagctcctgtaatatatggtgcttgtctccatatataatctaactcagtgcttttaataagtaaagaactaaagtatgttaaatttcccattatgcttaacatcacataaaagatatttaaatcacttcctgatttttctttaacattttttacaacctgtggaatacgagatcctatgtaaatacttgagcctatccaactaaatattgagccaatcagtaaatttccttgataaggttttgcccaatttattgaagatgattgcttggataacaatgcaagtcctcctgtgagtgatgaacttgcagaagagctataaaataaaccactaccatcacttgtgttacttgttaaatcactaatagatgtagtgaaatcgcttgagagattttcagaaaagttttcttctgttgtttcaattttatgtaaaggttcattttcctgttctttagcaaaactattatcatctaaactaataccacttgaatcttctttttcttctttaccacaaaatttaacaaggaaatgattataataaagatattgtaaaaatagaattccatcaagaatcgtgtatataatgtttgtcaacacttgagttattaaaggtgctgtatatattgaccctattaaactcgtaatatctccagttaagattaatgagaaaaaccaaggagaaatacctttaacacgtttaattttgaaattttgtattatttgaggagaagaacaaataacccaaatcattgaggataccaatccaatataaaaactccatttctctcgaacagttactacgcattctctaaatacaatatatatccattcaacataacctggcgaacaaaccataaaaatgttgaaaatcaacaacggttaagataatcaaattttttagttttcgtcacactgaaaaaatgtgaagaaatagttaagattgttaagaacatcaagttttgagaagaaaaattgatttctctgaaaattcttagtactttgctttataacaaggtttatttcatgttgaagataataatataataatgttttcgttttgtatcgcattcaatttttgcaacttttattcagcagcaatctctacggtttaagttaaaagattgcgttttatagaaaacttttggaaagagtttttataaatcaccaaaaattatcaaattttattttaggatttataaaacatgaacaaaaaacttattcattccaaaatcatatttgttatagaaatgaatttgaataacaattacaaaaaagtgacaacatcttcaactacaaaatgtccaaaaaaatcagcaatgaaaatgctcttctaaaggaaatggttgaaagacaattacaacgccttctttgtcaactcaaagatttagatgaacttaaggatgaacttacagaagaagaaattcgtgaaacacgaacagagacaatggaagaacttaatgagtttcgcatcaaccttgataaaatgatttcaggtgatatgacattagttgatcaactaggtgcacttagacttgcaacaattgctgcaatcaatgaagcattcaaaactcctgatattatcagaatgttcagtgctcgccaaacagaggaacttcgagcaagccttgcaaagcttaaagagaagatgcacctcaaatcaataacagtagctcaatacgaagaaaaagcaatggaaatattaacggctcttaagtcattaaatgaaccattgtctgatgaagaagcagcatttttgtccaaacagatgcaaaacagattcagcggatttcaagaatcaagcaatagtgtcaatcaagcacaaggaaaaacacttatatccaaattcggagatcaaacaaagattacagatcaataaaaataggtatttatcaacgaaaaatatattattgtggattcgaatataaagtgtattgaacttggacaggaatatttggcccaattgtatgtaaaatacataaatctgaaggtgataagataatatcacatgattgatcataatcttttccaatgatgaatgaagaaacagctatatcaacattaacgtctctgccatctactgctttacttgtagtgtttgccatgacaaccaatcttttaccaatttcagattccatatcttcaagtaatgaaaatctttcaattcttacatgtccattggatgatggcaatgtgaagttctctcctgattttattactgcaaaatgttgttgctgtggtaattcatttccatcgtccatggtataatgtaatttgccaaataatttgaaaagaaataaaaatggcgaataaaattggctagcattaaatatttcgaactgtctcttctccccaagcttttactttaatatatgtttaaaatctaagcccatcaatagcaacattgaaatgtttgataaagtgaaaattatttccaaattataataatttttttttttttacttcaaaaaacaattttaaacaattaaaaaaaaatcaatccatgattaatttacaaagaattaaaatatgatgatcttggtcttttgacttttctcctatttgatgaaattggagtcctctcatttactctatgtgacattggaatcctcagcactggtctccttggcgtgctaaccattgttgccttgttatcctgctcgatcatagatgatattgaatcgaccaaatgaattggcctctgtgagaactcgagctctttagcgtgtattactttcttttttgttggctttggacttaacaaaattttttgcaattcagcgtttttgttttgtcttgattcgttttctaatatgtaattatcaattgactttttgacgtatgccaaatcaaaatcttttgtaattttgaactcttccatttcgtcttcttcattatttctttcaattttttcatcatcaaaattatcatctttaacttcatctttttgatttccagttatagccgggatttcctccacaacctcagtaaagtgtttagggtcttttttaaaaggtgattttccaacatatgttgaaggattatccaaatcccaattgctttcatcatgaaaaaatccgacgtaatcaaatgtatccactttccatattcttatacacatatcaacaccacatgtagcaataaattttccatttccaataataataattgaagttatttcatcattactacatcttatcataaacttttctttcagctttatttcataatcaccctcaattatttcccaacatttaacatatccaagtgtatcagcggtataaaccaaaccgttattatcgtcaacggtaatcactgacattgagtgctttacacgtatcgaatgcgcatcaaatttttccaaaatttccaacttcggaagcaacaaaatgtacataaaccctaatgaatcaccaaccaaaatgaatgacttaaagcaagccaaacattctatcgaattttccaattttaaattagcttgttggaaattagtttctaatgaccatacgaaaatttccccatttatatcaccggaaactataccattattataattcgttaaagatattatatcatgtttatgacctttaaattgtctaaaaagatcaaattgacctttttcagattccaagtaagcgcaaattaacttatctctatctattctaattaagaaagagttcaaacctatagctataaacatcaaaatattaacaattgcgttatttaaaggggacaatttcacttctgatattatatttccactattataattccacaaataaattttattctttaaagaacaagtaattactcttcttccagttatatctattgttgctgcagtaataacattattattatcatttaagaacgtggttatattattacctttaaacatattccaaattttaaatgtacaaattttatcaattgaaacgatttcttggaattctttcgtataatataacccaatgatttgataactatgtgaaacatgttctaaactttcatttaatgcattgatatcttccgcccatttaataggatatgaacaacatgtaattaaacaatgattacgttcatcgaatccaattgaactataataatcttctggacgaagtattgtttcatcattccattctcgaatcatccgataattaatgatgtcccataagcggaactctttcttaatggacattgtaatgatataatgttcgccaattgtcgtaataaaatttgttatgttttggatttgattaaaatggccgccaagtttaaagatctttttgagtggggataacgtccatacatatgcattacgtgagacaccgtaagtgattaagttgttctgtgtgatggagaattgaaatcccaaaattggagatttattattgattacttgaaatgtagtaaagttgttggtttgtgggtaatacatccagatcttgatggctcgatcatatgatgacgaaatataacaattaatcgtagaaatataactgatttgtgtgatgcgtgatgtatgtatcgtttctcgggttaagcgttggatttgataatctgtgccactacgtcggcgtggtgctattaagctatatacttctaataaaccatgctcatcaccaacaaagaaaatcgaccgtttaagtgtcgtatcgttttcatacaaacagagtgaagtagggatgttgaaaagtggcatttggggggacttaatggactttaagtagatttgcgcatcatcacaactcattttccggattttattggaagatggtgatgcactaatacttattggtaatttagaaagtgtgtcataatcataaaataaaagacgtcgatttgaggttgtgacagtaagaacattaaatgagggaatcatgattaaatgagaaaagaaaccaggcttagtgatacatcgtttaaacgaaagatctgtactactccaaaaacgaatagaatcactactaagtgtgatgtattgatcaatttgattatgaatataaatttgttgaatcatttcatggtgacattgggatttaagaatcggcgcagtaggtactttcttgatgaacttagctgcattacttttggagattttattagtggtgaattctcgcataagataatcaacaagttcatcccaactaatatagccattacaattggcatcaattttatcaaaatatttttcaaattcatcttgtgataattgtccattacagattatattaataaaatttgagtttttccattgatcaaatgtaatttcacctgctttaaaaacatctacagcttcaaattctttttttaattcatctaaaaattgatttttctgatgactttgtctcatgattgattttggatttgttggaaaaattctactagaacctaatgaccgaggtgattggcctctattttggtcattttcatattgtttattaacattaaattttggaaaatcagatttaatcacgtttttagaaaaaagatggcactttttcgcttaacgttcaaaaaagtgcgttttagaaattttggcggaaagtgaatcaaaagaaagatcatttactctatctttctgataaaattcttaatacttttatacacaaataacatttatttattaataactctacttagaaatatttggtaatatcaactatgcatagttaccaaaattcatttttcaaattattgaaattatccaaaaatttaaaggagtggtttaggttgaaccggtgttaatatatcattctaatttattcttcaacataaggttaattaaccttttaaactatatttcaattcattcatacttatgaagtaatttaactatttctgtataaccacatttagatgcaaacataagtgctgtccaaaatattggacaatatataaatttcctgttatgatcgaagcaatgataatattttcatttactttcatccctttttcaaaaaaatgaaagaatatcaaaattacaatacaaaatacatttttctccgaattcttctaaattattaatttcagcaatttctttctcataaagatatttaaagatatcatttcgatgaaattcaattgttgttccatatgcacattcaaatgttgaatgattttgttcacataaatgaataatttcttcatttccacctgcaattgcatatttatatgttttttctatttttgcactattcataagtaaatacccaaaacatttaactgaagaaaaaaatgctgcataatcaattaatgagacatttttatgattaataaatgaacatctttcataaagtgatggctcaattgtttgattaaaatcaaaatttgtttgtgatgatatttcttgaagtttttctatttcatcatttcgaattattttcgcaatatttaatggattaactccttctttttttaactgctcatgaagttcccatttattctttgatagttcttcaaattttttctgaaattgttttataaatataggatcaaaatctgatataacatcgaaattaacaattctgatttgcactaaacaaatgtaattgttaatggtatttgctggaatatattctgcaaaatataaagatgccttattttgaataatattctgatcaatcattgagttttgaatcattttttcaagaagatattttgattcttgtgcattaatcggtaacaaaaatttagtaaatatatctattgtattttcttttgatttatcactaattttctgtaaaaactcaaaacatgtttttctttttgatttgaaacataatatgaatacagaattctacatattgtcataatatatgaatatggaaaatttttagaaaaataatttaataaagattcaactgattcatctatattgtaatcatttaagttaaaaataattgtttcaagatttaataatatttgggtgttttctttgtatttgatagtctgactatgagataatcccatcaaaaatatttggaaacgagttatctcaaaaatatttctgcttgaaggaattcgtttattaacttgttttgaaatgaggtgatgtaacgtctttttcaaagatgatgatgaatgtcatctccgactctagagtcagataaaatcattcataaaaacaaaaatatctttctaaaaattagaagacaaaaatttttagaatatctgaaaaaagattattctagatagctttttttaatttaaagtaaaatttttttgtaaaattattatgaatagagaaaatgattccttttttgactaattcaactattgataaacattttgttgaatgtacaattgattaatatctaaatatgattcaaccaatattttgaatatctttaattttatacaatgaaaaacttatttatttctgaattcatattaaatctcaaattttattataggtttatttcataatatatattaatcagaaaaatatttctttattacctatttaacttcaaaatgaatttgatttccattgcatgcaatttatccaactaattattaatttttttactttttactaaccaaagtgcttaaattgtttcaagtatttcatgattttcacttagagcatgcatatacttttccacaaaatcttctttgatttctttagtagcaaatttgaacatgacacattcatttttaagcatcccagttgcataattttttgaattgattacgacattccctttttttaaaaaggattcttgaacttccataccagggaggataaaatgattaagatacacattatcaaagttttctttacttctcattaaaattcgatatctacccgtttcattatgtttaagaattcttactataccttgaccatcaaagtcatacctattgaatttatattcaagttgattatataaaacgcaaaaagatgtatgaatttctgtttctcctttatcaggatcaccattaataaagaactgattcattgtattttgtatcgtttcaagtatttttgcacttattgttggacgcgcattttgttctaaaggcagttctttgttttcttcattcattagttgaatataattgaatgatatctttatgctgagtttttttatactcataaaaatgataaccaattggttattatatatttttatttatgcaatcttgtttaaatatataaatttaaagagttcctttatttaataactactatttaatggtttcccacattattaattttatttatatatttttttggtttaagtatataaaacctcgaaatgaattttctcagatagtaaaaaaaaaaatttagaactcatataatttttaatatggaagtgtgcctctttccatgaacatttttgcaatttcttggaaatcacctttaattgccatacgaagcggagaccactcaaatcaaaatgaattccatttatatcccttacatttggatcagcacctttttctagtagtacttccacagcatcataattacctttttcagctgcgacatgaagagcagtacgaaattatatttatcaattcccaaagcattttttgcattaatatttattccattttcacatagtaccttaatacaatctatagaattattcgaagcggcataatgaattgaagaattacgatctttatcacatgcatttacattagctcctttacttaacagaagaattgccatttttggcttttcattcttaatagcataatgaagagctgtcattccacaattatcaacaagatcaatattcccataaagtgataacaaaattaaaatagaatataaagaaccagaaacagctgcaagatgaatcggtgtttcaccatgaactgctggtatagatgcattaaaatctgcatctaataacgcatgaacaagatcagcgacatcaggttttttggtgtcgtcttgatcttcatcatttgtacttcgaatttccccacttccatcatcatttagtgcatttggtacaccatatgtttctaaaagtgtaatgaaattatcaaaagatgagtatacagcattgtggataggtgtgttccaattaatgataaataaactttatgattttttaataaacccatttgtctgtattctgttcaagccttttaaaaaagtatttgattatcaataagggttgattatattctgcagcataatgtaggaatgttcggaaattaaaaaagaaaccccaaaataacattataatttctggaattttgaaataaaccatgtctcgaactgttaaatctgcatttccatcaataagtagatcagctgcgaacttatttttacgttgaatggcaagaaaaatgggagcattatgtaacaaaaataaaaaccaaatggatgaaaattaagaaaacatcaaatgaaaattaagaaactttcggtaaatttacaaaaaacgacatttaaatcacctccttcctctttgtatttttttagacttgcattatcttcgtttatgatgaatttagtaaaatccatcgaaagttagaaaaaacgttacaaattttaacgtattcaacatcacttttcatttgaaaacaaggcttaagggctgactagatataaattcatcttttagtaagttaatggattggccagacatcaaaaactgtaaaaaaaaagattgtatagacatatattctattctcaagaatcataacaaatggttgtatctttaataggagaaataaaaggattactataaataaatagagatgggaggaattaaatgtgttaaatcaccatatgttaggtgtaaatatttatcattttcggtctcaacatgtgaatcttcagtatgtggatttttttttttcttgaaaatatatttcttggaggtgaacaaagccaactgcatgtgaaatctgaatatatattaatttgcaaagagacacatttcacaggcatttacattttccatttttaattcatgcaaacaaacttaaacttaagcccatttttattttctatagtgtatagtttaatcacaataaccgctatgttttacgcacgagtttatcattttcattattgtatcaatttttttttattcctctaagagaagctacacgtttctttatcaaagaatttcttttctttgttaatttttcatggaaaattacaaattgcaattttatgttttcatcaaacaatttttagtagttataacatattgaaatgttctcatataaaattatagttgttacataaagcagtttcaatcagttcttttgttattccatttgttcaaaagttgtagttttttatttttaaattttgaggttaagtgttcaatacgtgagcgtaagaatttgtttcaatcttggcagaaaaacttgatcgtacggctcaatttctcatttataaactattcatttatttataaactattgaattccatgtatacttaaaaacaagaaaaaaagtcaatttaatatcacatattttatatagatggatggacaaaaccctcaagggcagtattataccccaactcaaccagtatacacgcaaccttatggatacgaacaaccagtagttgatgctggtaatccgtatgctcaagtaaatcccgatccaaatcaagcgaattaccaataccaacaaaattaccaataccaacaaaattaccaatatcaacctaatccatatcactatcaaccacaaacgggaaattatcaatatgattccgaaaacattaattatcaagatcttcaagttgaacaattctcttccattccatgtgatcaaacttcatattcttgttattgggaaaacccacaagcatttgaacctcaaacatattcacaaaataccaaaaaagaaaccaaatgcaatgatattttatatcttatagtcttcttaatcaacttagttattaccatagttgtctttatttggcttgtatcgaagaaagctccaactgaatcagaacctacaaatgaagaaccaagtgacgttgacaacttcaagagcctactttggaaatccattggcattagctttgttatcggccttgtacttaatattattcatgttatttatattgcagccattccagttatttatatcaaatttgggtttttcataggcgttgtgattagcatcatatacattatctatccaatgattcattacacattatattggttcttatgttttcccggaatattattacttatatcacttcttatgttttgtatctatcgcgaatatataccattttctgccgcatgtcttcgacaatccatcaaaatcatacttcgaaatccatctattttagtcatcataatcattgaaactatattagatttagtcatctgtggaatcttttcattaatgatatattatatccaatatcataacattagtgatgctctttacatatacttagtattttcatattattggatctcatatacatttggttatgtaatgtatttaacaggcgcaggtttagcaggaacttggtacttcttaaatgacactgaatattatccgaagtcacctgtttgggaatcatttaaacgcgcagctacgacatcatttggtagtgcgtcaggcgcagctttatggcttgccatcattgaagcatgtcgtgcgattatcagattggatatatctgattcaaactcaacagcgcaagtgattctgatcattcttaaagtgattgcacattgtatcatatgtataatccaatgttgtttcgcgtggattaatagatacgctttgatttattgcgctttgttcggcgttccatttaaagaaggatgcagaagatttatggagttatcatgcaacagatacgtagaagtgattatggaatcttcaatgattagacatgcgctgacatttaatatgttcgtgttcgtaataggtggcgcttgtctcggatatctgttcggacttttgttggatgataataatgttggagctgtgttttcgacatttttctccttgttgttcacttggtcaatttacttggtctgcgatttcccaattgaaactgtaagtgatactttggtcatttgcttcgctgaggctccagaaagattgaagacaacagcatcagagctatatgattcaatgaaggatcagttctcgaagaaattaaggaagaagatcgaaaagagagcaaataaacactgaaatatgatttgaataaaaatgaaattaataatatgttaaaaaaatttaaaaataaatttcgaataatgttcaacatttattaagttcgaaagtctttgctgcaactttgaaacgaaattacagaaatcacaaaaattgttctataaattagtcaacagcattccgacattactcaataatagataaattttcgaagaaattaaggaaaaaattgaaaaaatagcaaataaattaaaattttgatatgaataaaaacgaaattaataatatgttaaataaatttcaataataaagtttgattgccgttcaacatttataaagttcgaaagtcttttctgccactttgaaaccgaattacagatgaaataaaaaactgtcagaaaaattctatgctctacacaacagtgttcgataaaaagcgttaatattttctttgcgaacgaaaccaaataaggatacaaaaaaaccgccaaccaccaatttttgaccgtttgagatgggcttttcaattaagccgtcattcattttcgggatgtgcaaagaagtcgacatggaagaagaatcagaatcagaaatatcacaaaagaaagctaagaaaagcccaaagattggtgatccaccttctataagtgaaagttccatagatttcgcaaatgaagatttcgaaatagaaagaactgaatattcaagttatacggaagaatttgattctgatttgtcttcgtcttaaaaccttggtactcagatctaataaattttatattgttgataaacaagtttatatttgattaaatttttattcaaataaacaaaatacctctgtcacaacaatttttttaatgtatttccaaatgaaatttttaattcgtcctaatctttttggcaatagattttttcttctaattttcattaatcttgcttatcttaattaaaaaagcaggtataatgttgttgattaaaaagcttatatgaaagtttaatggaaagacaaaaaaatcacattcattgaatatgatcaataacattattaacaaagttttataattctatttctatgtttactatcgcacagatatttaattgctaatttcgttatacttcttgtgtattacttcagttccaattagatcttgttgagttttgccatttgttctactcaaaaagtttgattttaaacatcagaaaaagttatttcgtttttaatttgtgagatttactctgtgagttttactcaaatgtttctgaattcttttcagagaatataaaactatatgaaattgttccaccattcaccagagaatcttgtctttggttgatcgtcttcttcgcagctgagcctatatcgatttcatttgtttctgcaataataaaatcagttgtattgtagatttggaacttcaacttagtcttatagctgcttccaaatgagaagtcagaattccaagatggactgggaccagagattggtgatgtttgctttgagttatctccatttgtcactttgcaagtgtacgtaacacctgctacacctccaaagccactagcactagcgattctaaccttgaggtagtaaaccttcctgaatttccaataaagtgaaaagcctaataatgcaagtaaaatgacaacaatagcccaagaaaggaacttgttgaatatagctctgaggaacattgccttagcacggctttctccaaccttaccttcaacttcaatttcgtcaagattactgttgatgtgttcaatatgttgtctatcttggagtaaagtatcttgagtggcagctgctgtgtttaatgtatcattaccaattgcaattgcgttatctaagttatcaatgatagcattacccttgtcaacatttgattgaagttgcctgttttgtctataagctggatcatttgttaaagcttgacgtttttgacgaagttcagtaaacatctttgaatgttgtgtatggaattctctaatttcttggtcataataagaacgttctgattgtggcattgattttgtttcgtttgtcatcttattcagcattgaatccagttgtaccaaatcttgttcaattttatgatcaagtccttggcgttgattatatgggagtgaatcaagcctttgtaagtcagattgaatctgctcgataaggctttcggttgatgtaatttcgtcgtctaatttctgggttatgctcatctttttagagcaggattggtattataatacggttaggtgtcaattttatcggtttgaatcaatttttataactttttgataaaacatgaaaacaatacgcaggtggtccaattgacaaaactttgagaactttatatgaaaaagataactgatgaaaattttcataatgattccaattatttgacgtttttagattaaaaataagaatcaagtttaaccaaacgcctcaaaaactcctttattaattttatgttccatattgaatctctgtcttaatcagataaacatatggctatgatgaagaaggtacttcattgagtagctctctcagagattgcttcttctttgtgaccgacctaattgaatctctcttctcttttctttcttgtttctgcttcataagtagttcttgcttttctctattttgtcgttcaatcaacgcagtaaactctggtgattgcatgaccaattctggtgttacatttgaattcgaattctgaataacagatcccatatctcgcatagatcttgcaccattagcgttcatgttctcagagatcagaacatgttcccgaagttgggaaagtgttggtctatgatcaactggtaataaacatgttgtaataaaatctgctattatagggtctgagacatcagatatagcctgtggcatgattccctctaaaatggcattgcgttttgtcattggtgaagagtattcattatatggttcaactcctgttgatatctcaagaactgaaagtccgatctgccaaatatcgctcttgggatcagtgattatggacttgacttcaggggcagatgtttctggaggagttccaaataataacatttctagatttggtggtcctaatttaacaattccatctgaactatcaatgtaaatgttattacaacaaatatcaccatgaataagaggtggatttcttgaatgataatgttcaagaccatcaataatttgactacaccaatttccaattgcagaacgtgatgggctatgaacaacttcagcaacatagcttcgaattgtttgcaaagaaaataattccgttatatagataaaaacttttcttgttttatcgatccaggctcgatacaaagcaataagattagggtgagaatttgatccaatgaagttcacaatctgtattaggttgttaaaaccattttctgttgaaccttcaatataaatttcattccataaacagagaattccctcgttttgatcaattgcacgatatgagacttggatcccagagcgtacaattacctcttctcttttgaatcgccctgagggatccacattataatcttccattgtctgacactttccaaaaagtgtcatattattttcattttcattctataaatgctcattaaatttctttattattaattatttagctttaaaattcaaataaccaatgaaagaagaaattgttttttttttaaattaatctaaaatgtatttttcagaataatgtaatttgataagaataattttgaattaccaaagtatttcatttataataatgcattgcatacatttgacgtaataaactatagtattctattttgtgaaaaaataatatttattaatttggaaaaagagattttttattcaaaccccacatttaaagaccgtttatcaacggtcactcatagcattgaaaataaatccgataattcagatcaaatgtattcaataggtttatgtcataaattttacaactgaaacgtttcaatgatctgcacgatattatcagtaaaaacttattataaacatgatttttcaccaagggtttttataagaacaacaattttatgattatccttcagcatcgaattcggaaaagatgttataaaaggcgttcagaacatgtgacaaaccaacggttcatgacaaaaccacaccaattttgagtgtcatagtcgataaaccgaccggattttactatgaaaaagttttgtcgtcataaggttaaaccattccaaaattgacaaaaaatgtctggaaatcctccagcttctgatccaatgtatcaagcaacgataccacttgaacagcaaaatgcttattcgcaaccttatccaccacaacaaggatacccacaacagggttatccaccacaaggctatactgatccaaacatgcaaccagccccacaatatgctccaccacctccttcatatcagccacaaacatacacacaaggatacgttgatccaaatgcacaatatcaacaaggatattatcaacctaacccatacaattatcaaccacaaacagcaaactatcattatgatcctaaccatatccaatatcacgaaatgcaagttgagcaatgggccacaattccatgtgatcaaacagcttattcatgttattgggaaaaccaacaagcctttgaaccacaaaattactcccaaaacgttaagaaagaaaccaaatgcaacgaccttttctttgtaatattattcctcatcaatcttattgccactattgctgtctttgtttatcttcttattgccaaagacatatataaagaaactcaaagcacataccgtccattggaagtattctttaaagaaaatcttgtcaaaactttaggcataggacttgcgattggtgttgtcattaacattgtccatcttctttacatgaccttccttccaggcgtttacattcgtctcggtttctttatctgtgtaattattgcagttattataattatcgttccatcatttatatatggtctttatgttctctttatatatccagcaatctttttgttatttgcattgatttgtttatgttgcacacgtggccgtattgaattttcaattgccgtattaaagcaagcatgtctaattttgcttcgtaacccatccatcttcttatacatcttcattgaagccatttttgacattattctcaattgcgtattttcattaatgatcttctacatccaatacaagggcattaacaatgcgttatatgtctacttagtcttatcctactattggatttcatatacctttgcatatgtcatctacacaaccgcatctggcttaacgggcacctggtacttccttaatgacacggagtacatgcccaagtaccccgtctgggcctctttcaagcgctccatgaccacctccttcggaagcgaagcgtgcgccgccttttggcttgcagttgtccaagcatgtcgtgccattatccatctcaatggcaacaacagccaagttattattatccttaaggtcattgcgctctgtatcttgtgcattattgagtgctgtcttaagtggatcaatcgttatgcattaatctattgctcattgtttggcgttccattcagagaaggctgcagacgatttatggaattatcatgcaacaaattcgctgatgtattattcgaaggatcgatcatctcgttaagtacaacgttccatttgttcgcattcacattggccggattcttcgcaggtttcggcattggttatgcgatggataaggaatacagttacgtgttcatattcacctgcgtattcgcattgttctttacattggcaatatttttggtaatcgacttcccattcgaaggtatgacagacacattgttcatttgcttcgctgaggcacccgaaaaattaaagacatcggcgtcggagctatacgaaagaatgaagaactctttctctgactcaatgaataagaaactcgataaggaaattaagaaaggagaaaggagaaaccagtgaatgaaaaagtttatattcagtttaagtaaaccaatttgaaaaagaaaattttcaattgttaaatgaacaaaaaatattcgaatatggcaacagacttagtgaaatatcaatgtccgccgaatgaatttattttcattacaaatgatattaactcatgcggcggcagaaagagcttcataaatcaaacgaaacattaattatattatgttttaaaaagtcacttttacatgataaatactttttgtgattacgataataaccgctccgataggtttttttgtagtcacttttcaaaaaatgtgttgccatttttttgcatacatgcttgccatatttttagaacttcaggtggcaatgaaagagtctaaattcaacagaacgatttctgcataaccacttgaatatgctttcataagtgctgttttgggtaacttaatgaatttccaaatatatttttatgaattatcaaattattataatatatctcaaataaaacaaatgaatatcttcagcattaatattaatttttttttgttaaagaagtatttgaaccatttctgtatagacatttttttgaagcatttattagtgccaaaaatatttaaaaaaattgtaaaaatttttataaagcgataaaatattcgggtagactgaactacacccccggaaaaaatacgttatttacgatagaggactatagacattttatggtgaaaatgatcgttcgataaaatttcaaataatgattttcggcgttgcaaattaaattatgtatttaatataacggttatattgaatatgggtatagttcagcataagagtttttgctcattttattttgatgatccgtttcatgttgccacccaaatattttaataaaaatttaataaaataaacaaacaaactttttttaattttccaatttttgaataaaacaaggactgaaaaagacgtttattttaacaaaatcaggtatataatgaggtcgtgacgatccagaggaccctaggggcctcactcctcagggggtaggtcaccaaagcatgatttgatatataaacggtcggaaattgtactttaccattttctgatcaatccatcttaatagggtaatccaatataaaaattctgaatatttttgcggtaaaaattaaaaaaatagcattccatttgaaatggatatatatataatttttttaaataaaatgaatattattttttgtgtgcttaagccttaaggagaatctataattccttttgagaaacataaagagcatacatagtatatttattcatggagataatatttttattatatttaataacataaattcatttgtgaattgagtgttttgaaacaatctgtggttttgcaacaattgttctcttgataattttgttcggacttccctgtgctgtgagatgccgcattgttcctgttgctgtggaaagtctctttgaagcatttgttgctcgaattgaagattgattagatgttctgatcggagccgggatatttttcttcctaagcgaagcagttcttgtcagcttaggtgttggcttaggcctagcactaatttccacattactttgatctgatttacttttcgagatatgaggcaaatttgttccattcttcaacaagcgaactgtctttgatatgttaaatgatgggaaagaattatctttttctatgaaactatttggtaacttgaagctatcttcagatatttcttttccaaaatatcggtctatcattctgaggcttatcgaaaaagtgggacacatcggttgaaactgtactggggtgccccgaagccatttgtgattgaatgcctcctgtatcgtcatccgttttgtgcagtcaaccgtcattaacccccggatgaagcttttgcaatcatccgacaagaaacttggaatgacatattcgcctcgtttgatttgtgcaaaaagttcggcttgttttcgctttgtccatgggagttgacctgtaagcatagcatacaaaatgacaccaacactccaaacatctgtggtaactccgttataaggtttcccagaaatacactctggtgatgcataacaaggagatccacacggtgtgtcaacaagcccattcggtgggataaaacgtgaaagtccaaaatctgagaatttcacttggcctgaattacttaagaggagattttctggtttaatgtctctatgagaaacagacatgttatgaatgtattcgagtgtttcgagaatttgtcgaacaaatggttttgcttcttcttcttttaggtgattatggtcaactatgtattgaaataactctccgtttggacaaaactccataattaaataaaaattgttttgatcttgaagaagttcatatagttgaacgattcctggatgatgcatttgctggttaattctaatttctgtttcaaatctttcatgaagggattcactatttaagcgtgattttgggacaattttacatgcgtagtattgatgtgtttcttcatgatgaacaagcttaacaacagaaaaagcgccatcaccaacagtaccctttagagaataaggtccgatttttcttggttcaactactttcaaggcaccattcatttgttattgtaaaccacagaaagcatgtccaaaaagtgcctcgccgatagcgttgtaaaaaagaaagaacgaaaatatttttggaattgcaacgaaattttatatattttatgaatatttaaacccaaaaatcaaaataacagtttctaaaaccaaagatattaactcatttccaatagaatcatcaaaacttataacatggtactgaatgccgatcaaaatccatttaattcgtttttttttacattttgatacaccattaaatgttttaagttttaacaaatgaataatcaaaaaatatttcattttacaccacatctaaatcggcaaatctaaaactcaaagatgacatcaaaattttcatttttataaagtgaaaacttttcattgaaaaaaatcatggccctgttcaaaagtcctattgaaaaagtcgcattttcacaaccaatttttggctatttaaacgtatttcatgtataaaattttccacttcaaatttcaataactttcttcatcgatttcgtcacaaactttgaatatcttttgacttaagttcattgcttcgtaacgtacttcttcaacatcagagttctttagtagatccaaagcatcgttcaatttttcaactaattcagctgagtaaattttagaaattattttgccattcattccaacgcataacaaatatttgaaacatttgacaatttgtaaattcatttgttcatcacatgaattaattaaatcgaaacatgtgtcaatgaattcaacagatattatctcttctatttgttcagtgtcgaattgttctaatgcaattaacaatggttcgattgcgagtttctttagtttgaagtacgtgtcgcatgtaatgatgttgagaagacaatggaatacatttgcggtatacattggtattattaacatccaattggagttaatgatgagtttagtataaagacaaaataattctttgatttcgtgcgattcggattgtgatagtattgaccattgttcaaagtttataggtatggaacacttaatttcattatcgcatttggttaagattatggtaatgaatttcatgacttcaattgtgacttctggatttggatttaataggttttcaaggatgaaatagatttgttgtgttcgaattaaatgatgaattgtatatggctggatttcaagacatttacaatatccttgtaacgaataaatgtttatctcattgttaatcgataaatagctgtgaaaaaattcactgattctgtcaattaatgggaagataatggaattgtcaacataaagaagaacttttaaataacacataaaggatgaaatggtatcactatcttcatgaaatgaaacaagtcctccaacttcttcatatagctgattggtaagtgaatgtacacgtaaatcaattgacgcataatttagattaacaatgagattaagacatgaaagaaaaagttgcgccggtatttcttcatgcatgcggctaagaatttgttgataaaaatcatctgtggcatttgaaagcatgtaaatagtttgatgtttaaaataaaataaccatgcaactaaatcaagtacttctgatgaatcagtgtgctgatcaattaggtttttaaggaatgaaaacaaatcatttttttcaataacttggaaaaattcattaagaaatatttttgaaatttcattatggtagttttcgaaaaagctaagcagtccttctaattgtgattgatttgtttcttggtataattgtttaataatctcatcgaaaaaaagacgaaaatgaacagagtccatgtttgggtcataatttccttttaacattaaagacattttgtgttttttgctgggcattgcgccttttaatttgtacgaaatcatttatcacgagtgaacttcatcaagaaaaaagtggcaagaatttggaaataattaaatcattgcttatgacgtggtttgagctgtataatatctgtaaccaagaaaacgtggtgaggctatgtaataataattgaaaaatctatttttcaaaagatattaatttaaagatcttattgataaaaaagtgaaagagagttcaatttttcgatcttaaagcattaaaaatgatgattttgtattaaaatgtatacgtttttatgatccattaagatctaaaagtattaaaacctaatttctgtaattctttgatgtttcatgcaaacaattttgcttaaattctttcatattgtagttagaattatgttttggactttacatatagaaatttttatgaaaagaaataatatttaatctacagcttcccatttttcaccgcaaatagggcaatttggattgcttgctatccattttctaatacaatgcatgtgatatgaatgtccacaagcacctatctctggtgggcatggctcgagtacatcatctgcttcacactgtgcacatggcccagctataagagatctgcaaattgaacataaatcattatcatttttattgcgtgataaatatactggattaaatcttaacattgtatatcgaggttctttaacttcagtcttttttggtggtggttttcctgttgctggtgaccttatccttgtaggccttggtgctgggcggggtgctgaattagtgttttcagacatattatttcatatcacatatcgtgaaaagtgccattaattggatttgttctttgcacaaagaaatattaaatctattttaaatacttaagtccaaagggtctcttaaggatttaatttcaaattaaaagtcatggtgtattaaagtttgcttcaaacatttgtttttttgaatacagatgatttcaattggaaatttaatatatatgatggttgtcttaattggctttattttttctcatggaactactaataaagtcaatgatgttaatcagcaatcttgcattatattgaatgatatttaaaaacatttaaatgggtttaaataattttttaatttttgatcatactcagattgttcatcatctgtttgtagttttaggcataacctcacgaaaaaaaaaattaacatagaacactttttttgtgttttatggaaagaaatactttcaaaaaccattccgatagtaaaattaaaataattatttattcaacttatgagcaacacaaaagatatagaaaataagaatgtcacagctccttctcatgcgcctgtaaaagaagaatccaaatcgaaaaaggtaaagaaagaacataaagaatccaaaaaatccaaaaagaaaagcgaaacgaataaagaggcaaaaaaggaaacgaaaaaagaatcaaaaaaagaatcaaaaaaagcgcttaaagaattaaagaaagacaaaaagaaaaagaaagcgcataaagaagcaaaaaaaggcaaaaagaacagaaattatgagagaattccaatttggatacacgatacaattgaagatacagatgacccgttttcagatgattttggagatgacattcaaactcctatcggaacacttcaaagctcttaattaaacaattttttaatatttttgtaaagtaattttataaatcttataaaggaaagtaaaaaaatcatttaattttgataataaattatgtcagtacaagcataaaatctactggttcattcatcgatgaatgcattcattattatttttaaaagtgaaatttaatataactaaaaaaatctcacttatgccttttattatttcgctaaacatatcttattggtaaatattattattataaatctatgtaatttattttttattaaataatatttgttttgatgttaatgtattatactaattggtcttaatttcaataatttctaaatattatctcaatataaaaaattatttaaataatgatatcaaattaataggatcgatattaaatattttcataatttacataaattcctgtaagtaatttaacgatttctagatggcctttatgatccaagcaatgataatattttcatttatttacgtaaatccctttttcaatcaaaaacgaaagaatatcaaaattacaatccaaaatacatttttctcctaattctttcaaattactaatttcattaatttcattctcaaataaatatttaaaaatattatttttatggaagataattgcagcctcatatacaccattcagaatcaaatttataaacatttaactgaaggaaaaaatgctgctgtgaatatcaatgagaatattatttatcaaaacaaatttctcatttttaaattcaatacctatatcaaattaacatttaaatacttcatataatttcaccataaatattaaattttatatttttacatttttttattcattacaatctttagattttgacacaacgttataagacacaagatcaccaccattattacctattgaaatcattggtaataccggatgaaacttaaacaccgaatcacatccgatacttttagattggaagaacatttgccccttcaaccccattatcgccaagttttccttctttctcgcaacagcgcataagggcaccaattcatgtatatcgaatccgactatttgctgtttaattttgacgttattaaatgtgttatcctttgtatttaacaaagaacaattaccagaagaagtagcgatataaaggaattctccaccattacgatttatacccaattttattatattttcttttaagtttttattcatgaaaatgaagttatttttctcagttgaaggtactcttatatcaatacctattaaatcaccagtggaatatccacaaaagatttggttgttattatttggatgaaatattaatgaactaatgatatcatgatcagaagctatccaattacccaaaatcttttgcgtttctaaatcccataaattaatcgaattattaccacgtgcagtagcaattttagaactatcttttaatatagttaaatattgttcaattgaatcacatatgaaattagaatcgactcgaaacattgatgaaaaatatttgttttctggtttccatatgtttaaacaacctttattagttgttgatattataaagttatcattattataattaaggatttgtaagtcactaattttcccattattaactttaattttattatcgttactaagttcattatcttcttttaagtatattattgtattatcttctaatgatattactgtgtcaacattagtttgactaaatgcaatatgtttaacattactttcgaatttatatgtaaacttttgttgtaattcaaccgaatttattaatatgtttccatattgtttcgattgtgttttattaacatttatgttattattaattggttcaattccttcgtttttaattgttcgatgttgtaatgtttcgaataattcattattattattcttaaagtattcattattaacaatattattatttgaattagttaataataatccaaatgtatttgtactatttgaccattgtaagttattaaatggtaaagttttctttataatcgaaggaggtgatgcatgaaattgtacatgtttttgtgtattattattattatttgtattagtattactttgttgttgtaataatatcttttggaaatgttgttttgcattttttgcatatgatgatacatatggatgtggatcatatatgaaataatcgagcatattaaatgcgttattaaatattaaacttaatccgtctgttttttgtgtgatgaagttatcaattaatttaataaatgtaatgaaatcattacgttgattataatcataatgaaatgataaccaattatttaataagtcattaaacgtcgaaagtttttggatgttatgtattgatacataaggtttatcttcgtaaatacataagaatttacagattaattttaataactcaaatcgtactaaatatgaaatgtcagtaaagattggaatagataccattaatattaataaatttaagtcatcgtcattaatttggataaaacaacttaaacaatttaatgctatagatcgtacgaaatgtgaattatgatatattaaagaagcgatttgaaagtgtatacttgtctcataaaaaaaactttcttcgatttcatatgaattaatttcaaatgttttacatataaacattaatgtccattgaagtcgaacatttgatatattatttgtcgaaagaatttctcgaatattattaaagaagatatcggaataatttaattgtcttaaattcttattatatattataaaacaagtaataatacacgtgattaaagttttagttttttcatttaaattcttatcaaagatataattatatattttagtaatatcaaaatcttttttaatttgatacattatatctttgttatattcgataacagataaaatgataatacataacgaattatattcatttatatctttaatcggttcaaataacttttggaaatattggttaaatggtataatcgatgaaacttttttctgattctctttcgaacttaatatgtaatcggaaattaatttaaacaaattatcattttccgtttgcttataaaatggcatttgtaataagattaataacattgaaggtttaattaacgttttgttcttgattaaattttcatatatattaacgtcagtaggaaaatatgaaagttttcgtgtgggtaatataacgaaattagatgttatccatgtgtctaatgatgcttcccaattaaaccataacggatgaattgacatattcggtatttttggatacgatataggagagatattatatgataacaataaatattgggctaaaatgaagttatggaacaaaactgagatgactttatcggttcgaaataatttgataaataaattggtcggtaaataatcggcagaaatcgactcaagaattaactgtaatgtcagttttaattcattgttccctaataatgcggtgtttaaacaatctaatggaaatcgtatcgatggaaaacttgtccgataatatttcaaaatatgacataaaatcgaagtttctatgggcgttagtaaacaagaagtcaaaaaatcacgtgggagccgtggatctgctggaagtttttcattggcatcagttgcacataggattattaaatcatcaacaagatcaactttgctggtgtcgagttcattggtctcttttatgatcgatggaattaatgttccggcattatcacaatcaaatatgaaaaatgatggactacgaatttgtgaaactaattgacttattggatatggaacagtttggaattgttgggcatcataacatgaaatactattgtttgttggtaatggatatccatatccaacataatgaaataagattcgttgaagtggaaattcttttcgttgggtggctaaagtcttgaaattgtctttggtgggtgaaaccatatggtaaaatcgtaaagtatgactaatatcttgataatgagttttataaatggaatgaagaatcgtaggaaattcgaatttggaagaggcgtcacttggtaaggaccaggctaaataaggtgaaatacattcagtagatgatgaatgagtgtgtggatattgggatatatgagcaacatcaatattaatagattctatcgagctacagattggaggtatgtaaacattattagaagttgagaattgctctagattaaaatcaaaatctgtgaaaaaagaaatatatggaactttactatcagcagaaactttaggattaattgtttgaagatgttcttctaaagttttttcataagctggttcatccattaatgataaacttttaaatgtttgtgcttttttcatagttcgtgaaaattgtgaagttacaatctctgtttcaagatcttctgatgtttcacctgaataatcataatcgtaatcgtaagacgcaaaattttccaaactcattttttataaaaaaaacgttaacttgacttaaaaaggcgctctcaaaatattgacaatgcccagtttttgagcactttacgtaccattttttctgccttttattttcatctgatagcatttggaaaaaaattcaaaaataggttcattttataatatttatagctaggctaaggtttaagaaaggcactaatttggaaaattaaaaatttttgcctaattttaaaaattaattaaaaaataaataaataattaaaaaaatttcttgaaattgtcaataaaaattgatttgatgaaagcaaaaacaagctttttttttttttttaaatgaaaacattccaaaacattaaaaccaaaaactttttaaatttaattattttgttcttcttccttttgctcttcattttgttgttcttcattattttgtggtgctgctaaagcagatgcaaattgttcgagttgaatattatgaagagcatttggatcaatttgaccattttgtataagagacgccagtgcttctgatgcctctgctgtgatttgaatattttgattatttaaagcatcaagatcttgattatgtttaagtaaaagttctgtcattgcttgatcaacaattgatgttccttggaaatcttctggaggagttcctttcttctttaaagttgaattccatcgatttttaacggaattatctgttcgaccaggaagaagtttagcaatttctgcccacttctttccaatctgttggatggatgatatgataattcgatcttcttcggctgtaaaaggttcctttttaatctctggattcaaatgattacaccatctctccctgcattgtttagcaattcttcctgggaggagctcagcaagtgaacaccatttagaaggaccattggtatttacccaatttataatagtttgatcttctgcataactccatgaaccacgaacaatatttggatttgcgactttcttccaatgagcaagaacttgtttgccagttctgtttggaaaatttgttgcaatttgtgcccaatcttcagattgttgaacaagttttgataaaagttcatcttcttctggtgtccactttgatgctcctgatcgcatcctgtttctagtgcgagtgggagcaagtgctggtggagcttcgttttgttgtgtcggagcttcttcaagcatttcttgtgaagcaaccgttaaattaattgaaatttaaggaccgttaaccgctttgctggtttttggcgcctttttttggggggtgtcaataaatcatacaatacgatttcatgttaatattaatggcgatattgaagatatttgatatgtaaagttacgtgtttatttaacaaaattcaatcgactttttattcaaatcatattcaatcaattaactctgaaattcaatcataaacttaactctgaaagtcttagtctattcaacaaaactttaactcaaaaaaaaaaatattatataaatgcaattgtagatgcaagatcaaaggcatttttaaacttaagttaatagaatttgagtatgttattcttttgaagatttttcccacattgtgtctttatatacatctaatttcacgatatataaactcataataaaaattttcataaatttataccgtgacaacaaatatgtttacaagacatttttaagattaaaaaaaatcgatttcaatttatttaacaaaaatatgaaaattctaattctttttaaagcgttgaaaaaaaatcggccaatttctatttaataacaaagctgactttcgatctgttattttctttatattcttgaagaaatttaacgacttctggtctacgatgctcagatgctttcatacgtgctgtttgaaatatctgctttcaaaacttcctttctattatgggttagaccgcaaataactacttttattgaattcttctgtgcatgaacatattgtgtttatatcaatttatccatcataagctgcattataaagtattgaaaattgagaatgatttttgtagacatgtcaaaattgacaagtttattaataaccagtctcaattgacctcatagaaaattttcaaaacaaatggcgccgatgcgctggttcagtattcaaaaaattaaatgataaacctttgaaaaaacaatgatttttttggggggtccgaatattgatgattcccttgtgtgcgttcggaggggctgctgcagaatagtcttacaaaaagttcagcactgagtaaagaatttgctaaaaatgtttattataattaaaatttcaaatagaaggaaacggctggctttcgcacatgatgtcttggagacttcccaagttatttgccaaatagacaattgcattttgttcaattgaatcatttgtatctttaatgaacttttgcttttcaacatcaatttcatgaataactcttttcgaaattgaatctcttttttgaattgtttcgttatgtcgcgtttgaaagtcgttttctagtacggaaacatttttagcaatttcatcattttctttcgaagtagaatttgttacttgttgatgctgttgagataactgcaatagaactctatgatgatctttaaccctcgaaatgatatcctgtaattccgcatttatttgtgcttcgagaccattaattgagtcgaaagtttgttgttgatatatacctaaaattgattcgattttcttaatcgacatttctttctctttgttcttatcaggttttgttatttctaatgcgttttctttttgtattattgggtttgttatgaatatttcatcttttttggatgcgtaaattcttttctgttgttttcgttcaggtaatttgggtttaattgtcgtttgttgatgttccatttttaagttttgttggaattgtgtgcaacgcttcgagaattcggtttgaattgatttgggacaattctcaacaagaaactgaaactttaatggtttctttgttgtgattttctcaaacgcaataagtttctcttttgttgtgaatcgtattgttttgttacttgttgaattttcgcatatttgtgaaaacctaaacacaaatacgtcgggtaaatcaatggatttatgtattatacatgcaactaatgtgtcttggtttatgtcaagccaaccttcgccttcaattttaactccgttacagataaaactagtaaatttgacatgaagaatattctttgacatcgggattttagctctttgattaattaacataataaatgaatgaatcgattcacgaaaatttgttgcattaatcgatgaaaaagaagattcaaattggccaaatacattttgaagatgtggtgactttgtaagacatgacttaactctccatgtaaattctgtgacaagcatttgcgttaatgaatcattagcttcttgtattaattttaaacattccgaaatatgaacttcactaaaatattgtgaaaataattgtcgattctttggactttgtgaaattaatgtaattaataattgaaataatgatgataaaactgattctggaagaactaaattaaaccctaattctcgggaaaaacgttcaatgatttctgatagtatgatattcttcatatctggattatttgaacatatcgtactaacaactttaagaaaatctgcagtttcattttcaaattgtgctttttcatcaaatagtaacacatttgtaagtaagcctatatcaggtacaagttcaatgggtaatgtatctttgacaatttttagaaaaaatgaaaatgcctttatatgttcaggttcatttggaatataaggaaatattagctttaaattcatgattcctcttcgatcaagtcttccatgttttgttgaaaacaatgaattcctgaattttttccagaattcatggctgctcggatcaattggattgctcaacagcgcttgtattgatcccgcttcattattgcctccaagtgtcgacatcaaaacgaaataaatgttttaacatcaaacatttgatgcgaattaaccgtttttacacaaaaagtgaaaaaagaaaataacaaaaaattatcaaataaaaaacattcttgaagagaaattctgaattaaatatgaaatattggatcatcttcaatgagagcgttgctccttccgaaagaatcaattgatgagttagctgataaaaattataatttgaatcacaccatatgctgtctttcccatcttctattccaatacttgaagcaaaaaaattctgtacaaaatttgaattcataattttgtttttatgagaaaattttattaatgtggtcatactcatttgtgaaaagtgattttttttaagttgtattctgaatattttaaggaaaatataaatttttaaaaatttttgatcacaataatcattattaaaaaaacatattttgataaatatatatatatatatatatacacacacacacacacacacacacacacacacacacacaaaaaaattacaaatttattgagtaatattaggtaattttggtgggaaaaaagcataattatattgcaattgatacaaatatttaatgtatgccatccaagaaaatgcccaaaatgcttcgcctatttcaggtttattgcctggtctatatcgaaatgcttttgcggcaatttttagttcttttctcatttcgagaatttggtcattcgaatattctaaaagttgttcatttaatttattacttttattttcatttatacgaattgtaaatttagaataattcaataaaacattctcaaatggaagctgtggtggatcaaaaacaaatacaggaatacacccaaagtaaacagaatcataaaataatttgttaagatatgtcatatctttcttttgaaaaacgcaaaagtccgaattaccatagtattttagcagttttgtattggttccgaacactgctttttgtttagaatcatgagaaattgaagttccaatttgagattttccttttgaatttgtttgatttatggaaaattcatgaataaatatagtgtgtttgcgggtttgagtccaattaacttcatcaaaaggatgatcagggaaatatgaaacttgtggaataattatgttgcgatgaccataccagcctcggagagtttcgccgattttaggatttggcaacgcagcaattgcattttttgtgtagatatatttgctaatttgtaaattttctaaattgagatcaaagtttgatacaataacatgatctagaccaagtcttttattataccaaggattattagaacgaacttctttgacgtaatttaaggtatctttcatatcttggaaggattgtgttacaaatggaagaaagaataaatttgcttcttttggattttttgtaataataggtgataacattatttcactgcgaagttcatcttcaacagaatattgaaaatctttgttatcagaattattaatttgtttcaaataattagaaacattatagcaatatatttttattggagggaagtgattattgaaaagctctatattttgagaattctcagtaaggggaattgattcctcattaacttgtttaaaatcaaatggagttgatatcataataaaagcgaaaaggataaaaattataagaactgcaataattgcatgctcaagtccttctactttggcatcccgacgcaagtacatttcagttcccaaaattcagagtcttttgatcagaaccgttattatatggattcaaaatgccttccaacaacactttcctataaatatgacttcattgaaatacctgaacatgaacaaaatgaacaagtaggaggaatggaagtacctgtttatatttcacctaagaaaacacctttagataaatattacaactctattgaaggtaccatatttgctacaagtaatgccaaaccagtaatcaattgttttacccaagataagtttctaccaatatttagacctcaagatcaacctgatttatcaacagttccaaatccaaaaaattacgcttcatttcatgatttttcaatggcctttgaacagtggtatcgaaaagcaatagtgtttttttcacctgttatattaccaaatccattatcaggagaattttaccttatttcaatgccaaagatatttgaaagggatgaacgaaacaatccaggtcgtttccgtacatttaaaccagaactttggcctcttcttccacaaaattatctagatatggttgataaaatatatgattcaaatagtaaaattgatccagatgaactttttaaagagcaaattcctaagagagatccaataatgtataagcaccatttaacatctgatgatcaatggtgtagccaacttgttccagttgagccaattccatttttatatgagttctatgaagattatgagtttgcttacacacaatgggcctccttaacatatgatgttcttaaattttttccaatcccaccaaaagaatttgaaaaaattgccgctcttgacgtcattaaagatgaccaagaagacttcttagcacaggaaactaatgatagcgtgtgtaatcaatttgattgggcaccaaaaaatattaaatatctcgatcgagcttctatgagtcttcatgaactatttgttgcagacgttgacaaatacgctatcaaacccaaaactgattcaattttatgtgtttttgatttagatggcaaacaatttgtcgatgaaatgatcaattatggaatcaaatgggactcaatagaaaagaatgaaatcattcggccaaataattttctcagaggtgtaccagaaaaagacacacacaatggtcagatgttaataagtcgccgaaaatttgatttcaatttaattattaacttacttaaattcaattacacaagacaacaattttgctctttaatggagactcaagtaccagctttgaaaacaagcgcagctattgcatcttctggaataatctcaacaaacgaatttttcggttttatcgcgtcactttctgtcacttcaccttatcacaaataccgtttgtcgaactttttgtatgcaattgtcagaaataaccccgacgatacgaagcttcttgattttctattggcagacgaccgtttaccttttttctatcatttcatttctttagtgttttataacacaccaaagaataaaaatcttatacctattatcagtgatcttaagaacgaacaaaatttgaaaattaacaaattttatcttcttgaaaattttgtcacattatttaatgaatgtcttggctataaattttataccaaatcgattgaaatatgtcataagttaggatatgaatgttctaaattacttactgatcgaagttacattgagaaaatcagatcatcacctgatgaagattcatataaagtattaatgatgataattcaaagtgaaacaccacaacttcaacgattacttttggggaataacttctatcaatgggtttccaagaatgagaaatattccaaaatactttggtcaatagcacattcttcgactattgaaacgttttgtaatatgttttctaaatatggatttaatccacaagaacttgaaacgtattcacctgaagtcacacgtaacatttgttatttcattaataatgtttgtaattatattattaatttaccaaacaatttacatgttgatttttcaggtgtttctttaaattctatttttaagtctattattatgagttctaatgagaacatttcgaagttattagttccgatttcattaataatgagtgacccgaagttaatttctgattttaattcgaataaatatcaagaattacttcttggtaattgtgcgatattatgtgctgatctgaattcgttatcattcccattatgttgtgagcgtattaaagcattaacatcattcactaaaatcgaaaattgttgtgttacgatgaccgaaattactgattttaatgaaacaattgttgcacttttacttaaagatcaagatattacgagaatgaaaagttattggaaattcattcaactattatcgcgttatccgaatgttctttcgaacatattaagtgcaccgaatgttaaaaaatcaatttcgacaatcattaaaatggataaccctttgttatcgagaaaatttttcgagttttcgaattatttgtttaataaaaataaaaaccaaaagctgaagaagttgttgttggatgcagtaatgccttcgataggaagaatcgtaactatataccaaacatttggcggaatatataaaaatgatatagcactaaaacataaattcatttccttcttgtgcgcagtgttcgcaatgaaagggcaggaaacagaggaattcattcaggcgttcattaagcattcgaaggaaaataggtcggcaatagaaaagaaactgaattcgttgaaaaagaatatgtgattacggataattaaagttagaaatagaattaaagagtagagaaaaaaggcttttattaaatcttattttatgtttatattttttatttataattcaaattgtatttttgttcctaattttatagcgaaccttaagctaacgtaagcatgctttagataaaagtacctaattttgcatttttatttgttcactgttatacgtattatgcctttatttagtttcatgaaactacataaacaatataatggatccttccacattaatctattctgtttaccattattaattatacgattgtagggtaaaacaaattttataaagacagtttaattttgattacaaaggatactcagcttatgtaatatatatatatatatatatatatatatactctggtatgattcagttatgagcccatttctgcagaaagacaatttttatataaagtatacaaataagtataaaagtgtcgcaaataaacttgtcaaattatattttgcttcaaatggaccccaaaacactggaacttcccatcattcaaaaattattaaaaaaggaagaagttacatggattaacccaaaaatggtaaacccaccagaggcatttgaaaatttcaaattaactcttcaagatgtattggatgctgagaaaagacttcacaggtttgctccacttatcaagaagatttttccagaaacagaaaacacaaatggaattatagaatcaccacttcaagaaataccaaacatgaaaaatctccttaatgatttttggaaatccaatttaacaggcaacttatacataaaaatggattctaaccttccaattgcaggttctgtcaaagcacgtggtggtatttatgaagttcttaaacatgctgaagatcttgcattttcccatggccttcttcaaccaaacgatgattacaccaaattatcagatccttctatacgacaatttttttcaacctattccattcatgttggttccactggtaatttaggtttatcaattggtattattagtgccagtcttggcttccaagtttatgtccacatgtcacgtgatgctaagcaatggaaaaaagatcttctccgctcgaagggagtccacgtcatcgaatattctggcgattacaacgaagcggttttaaacggtcgaatccaatcatcgaaggatccgaaaagttattttattgatgacgaaaattccaatgatttgtttttagggtattctgtttcatgcttacgtcttaaggaacaacttaagtctcaagggcttgaaattaacaaagaaaatcaactttttgtatacattccatgtggtgttggaggagctccaggcggaatttcttttggtttaaagcaagaatattgtgaggatgtgcatatctttttggttgagcctattgaggcatgttgtatgttattaggaattacatctgagctttatgagaatatatctgtgaatgatatcggactaagttgtaaaactgaggctgatggacttgcgtgcgcaaagccatccaaattagtgtcgaaattaatggagaaattaatgagcggtgagtttactgtggatgatcaaaagttgttcgttttcttgaaacaacttttcgattctgagaatatatttatcgagccaagttcgtgcgctgcttttattgggccaactttgatccaaaaggatgaaaactgtttgcagtatttggaaagaaaaggaattagcgacaaaatggacaaggcaactcacattgtatgggcaactggtggcgacttggtgccaagtgaaatcagagaaatgtactacaaaagaggacaggatctgtacgagaaaataaagtaatttaatgtataaagaaattgttttttatagcgaattccttgtaacaatttcattatctacattgtaactgtttgcaaataaattttttcattttattcgattggttttagagaaaactaaatatattattaattgtttttataagaattaatatacaagttgttaatatcataataaaaatatccttgaagttgttttgatttgatattgtaaaatgatacattaaatttcactaaatttatgactacactctttatataccatcaatcattaatacaaaaaaatatgttttaaactattaaatacataattaagatctgcaagaaaatctatgagaattctaatttgttataaaattaattttctgaacgttccaactttttgattgctgtcaacaacatttcgtattcttaaatggccgaacacttatacgctcaaaatccatctttgcaatggtttctaaacatctcccgctagaggagtgctatgaaataataacttctatagctggcggcacatgcggtgatgtaatgaaagggaaagacaaaaagacaggcgaaattgtggcattaaaaagaattaaaattatagatccaaaaggaggtttcccaatgaatgcaatgaaagaaattcaatcactcaaagaacttaaacatgaaaacattgttcaattaagacgggtttgtgttagtaattcacaagaaacaaatagtgtatatttaatatttgattactgtgaatacgatcttcaaggactactttcattgaagaaactaacccttctagaagtgaaatgttatatgcggcaattaatgaatgcattaaatgtttgtgcagagcataacttcattcatcgtgatctgaagcctgcaaaccttctgttgacgcctgataatgttgttaaacttgcggattttggtcttgttaaaaagattgatccaaaagcagttactaataaacctatgacacctaaagtcataacaatttggtaccgcccaccggagcttcttatgggttctaccaaatatggtcttgaagttgatatctggtcagctggttgcatattatatgaaatgataacaaacgaagtcttgtttcgttcttacatggatcaagaagcagatgaactttctgctattttccgagtatgtggttttcctaatgaggaaatttggccaggatggactaatctaccaaattcaagtcttgtccaaaatataaagccaaactttcctatgtcaacactagcggatcacctcaattctcggctgcccccagagtttgctgaggctaatgacttgatccaaaagatggttcaatttgacccgtcaaagcgcatcacagcaaaagaagcacttttgcacccgtttataggggaaaatttcgaagaatttacccctgaaaaattggagaaaatgactttcccagaagctcatcagtataatatatcacgaaagccggcaccaaaaaagactacaagaactcggcctaaaagagttgtgccaccaaaaatcaaatagaatgaaaaatattgagttttcggattttccgaaaaaaaacgcggattagcttctcttgcatgttagaatttttataatcgtgaagagaaggcaacttcgtcaacaaaatgttatatgtatttagaagaggtagattctggttgacatgaaataaacttaagtctttattaatatgttctgttctttattaaaacaaagaaaaatataaataatatgtgaatggattctacaatagaatgtacctaatggtacttccaaaatatattaacatataatcaatcgtctattcggatgatgcaaagaacaattttccgataagaatcaaagctattaaaaaataggaaattttgacaataaagtcaaatttagatgtaacttcatttgagccatttccttgttcatgcttgttgataggagtaaacttagaaggctgaattttttgagttacttgagataattgaacttcattgattctagatgatccatccttccattgaatattccttttgctactgggagtaatgggttcattaacacttggtagatatgtatagtttctctttgagcgtggaaataattcaaaattcccaccatttaaaatcacatttgcagatgctttggttatgctttcgacatcatcgcccacaagtgattcttcatttctgtcttcttcttccaatataatatccgagtattcggacatctgacctgttttgccacttttaattttaaacggattcccttcagtgtgccccatttcatatgcataagttatacaagctaattgttgatttgtgttttatagttcttaaatttaagatgatatatttatattttgggcaatagatgttctctttaattttctaaaacactagaaaaaagaaatttttgtcggatatcattcttttattaatcaaaaacaaatattgtaaacgctttattccgaaatattcattgtaatttataaaatttaataacctaaaaccatatgaattttattcaaccataaacacaaagtttcgatctactgatgtcaaaatcaaattaacaagtaaaaacacagaaaatccaataaaacttacaatgatatctcctctcaagtaatcacccaagttatctttctctttgttatctgaaatcgtgggaatcaaagcgtcgtatttgttttcttctgatgtgatcttaaacggtttccaatcagatttcagccaatttattgatttgcgcgtgaaaccaaaatgaatgtacaggagagcaaatattatcattacagtagtacatctgattactatgttaagggaacttcttccaacaggttcggtaaatttatattgcgataatcgaaaaccaaataatgaatataaaataatggtcataacaatcgctatgacgggaatccctatcggtggaataaggaagaaaaaggaaataatccaaatcccacaaaaaacactaacaaaaatttgtaatattgaggaatattcaaataggataactaagcagtaaaatacaacaaaaactgtggaagcaattcgaagagctattttgttaccaatttttaaagaccaaatcatttgacaaaaaatcataagaacaagaatttctgtgtttggtgtacgagaactgtgctctaatgctgtgtaatcccttccattccactctacacaaggtggactttgttggattgaaagatgaaataatgatgcaattgaaaatgagaagccgagtaaaaatacatatcttattatattttcgcgaagttggttgtagataccttgtaattttttctgtgaaccatatccataaagagagaaaagaagtggaaatgaaatcaacattatgaagcaaaccaaaagaataatatcaaaatttagacgtgtcccaatggataaaatgacagctgatgtgaacccagcgtcagtatgaaaacaatcatcaaatgcaaaatcagaagaactaaataacatctgacatatgatatgaaaaaatttcaaaaaaaagttttcaaagaactgattgaatatattcaatgcattaaatgacagtattgttttcgctcaatattttttgacatttctataaatcgttttgttgctgttttgtcttttcttttcatttaaagttccaatacgaaatttttttcacatgattaacagagctgctttcaatgcaagagtatttgcttataacaaaaattatttaattaaaaaaatcaaatcgatttttagtaagcagaataacatcttaaaaaatcttcctcaagaaacgccaatacaacctatgcattcaaatacgccagatgttacaccagaaccaataaatgaaattgaaactaacgaaattgaagccaatgaaactataatcaatgaaaacacaacagaaactcacatagaggaagaagttcttcctccaaaaaatttcacaaggatttcatcttgtatatcaaagataaattcatgttttggaagcgagaaagttagtgattttcttgaattcatcagaccattcttcaattctttgaaatacacaagtgttggtaagaagaatgacttctggtcaattgaaggaactccagccaatttcaaaatcaaatttccaaaaacacaaatttctggatttgaaattatcaagcaaaacaggagttgtgaaattgagctgtttgatttaagcacaaacattgatggagaaaaaattattcttttaaagaaccaatatcttgaatcatccaccaacttcacattttccaaaccggttctcacagataatcttaacctatatgcaatacagaccaaagaaaataattttacatgtctttataactataacattttgattgaacaataaaactttcaattcttaacatgtcattgttaattgataaaaaataaaaatgtcaaatttgaattatttactctttcttttcttctttatctttttccatcttctcgatttgttccttgttgatttgacgagcttcttcgaatttcttcttgaattcttgtgtgatttctgctgtcttgaaacgaacagaaagaacatcatgggattcagttccatcagcaaaatcagtagcagtccaaatcaaagcacgttcgttaccagcgtgtgacttaagttccatctgtggaaggatgtaatgatttgcacaaacgcggaatgtttggttacgcctcattaaaatacggcatcttcctgtttctttgctcttaaggattttgataaagccaacgccacgttccttccattctttgcttgttgaatcgaaacggtaaagaattgccttatcaccgaaaagcttgtcttctcctgcatctgggtcttcttgttcaactgttgaaggggcttctttatggctatcatctacagcgtttgcatcatcttgagcttgtgttgttgtagctggagttgcaataactggtattgttggtgttgttgtagctggtttctctgcttcaggtgtagctggtgttgttggtgttttgtctgcttcagacattttaatgtgaacgaccatgtataaccgccagtaaacgatcaaatcttcctgaaacaaagtgacacgaaaataaaacattgaaaaacgattattttgaatataaattttagtaatattacttccaacgctggcgaagttgtgtgagccgattcttcagctcaaggaaatttttagcttgtgttgtgttcgtccgagtattttgttgttcgtctgtctttgttgatgtggtaggttgagtatctgtatttgtaggttttggggcagttttcctgggggaagtcaactgctttgttacattgttcggctttgtgtcacttgtcttttgtagtgatgagttcaacggctgagaagtatttgtagcttttaatggggatttaggaagtgttactttagttgagctcgaaacatttgttttattagttgtactcattgttgttgtagttactgtctgtgctttctttttatttgtcaatgaattaattaacgcattacatagtttcgatcgaatgtcatcatgattaaattctttcattttatcttttgcaaatgtaatcactctttggatatctgactgctgttgcatgtctttaagctgattagccaaagctacccaacatttacaataaaatgaatctgtaggaatggttcctctaaaattgctcattccgccgagtaaaccattgaatatttctatcggcggcaatttattaaataatttgaaaatgatcgaattcgttgcttgagaaataccttccattaacaccaattttctttgccatctatttgcaatgaaggtcactgcaagtaatatttttattaattcttcttgatcaaaattacaataaattatcatttgatgaatcgcaatcattacaaatttcattgagacccaatcagtatcacttgataataattcataaagtaatgaatttagaattacattacttttatcaattattgctttagaattaagtttcaattgttctaataaatttcgacataatttaattttcttaacagaatccattttcgaaaaagaagtgaaatctaaatcattcgacatatcaattggaattactgatcttgcaagttctctttgatttggtgtcaatgattttataaattgttctttttctggttttgtcatttttcgataaagcattgaaagagcgccgctacatgcagcagctacttcaatagatttatgatcaacataattgattatttctaaaaatatggatgagttattgtcattatttccaatggcaaattgtaattcattaaaaagatgtacaagtgatgtggcattacaaacattaagacatgagcggagaacgttagagtactctgatggttctgagtgcgttctcacgaagaaaagaaggtctaaagaagaaccaacaacttgtggaggcttcgattcaatgctccaaagaataacaggaacaagagattcaatctcttgttgtgaaattaattcttcttcaaaaatggtcataagaaagttaacaccttcaactataaccttgacattcttatcgaaaaatcgtgttgatacccaacgaacatataaatcactacattggaaaaatgtggattgatcagattcatataaagaacgactttcattaagactttcaatttgatctggtaaaagactagaaaacattttgtcaaatattgactgaggtagaatttgttgtgcttctgcttttaattttccaataattgttgtgacattttgacgatttgatattaaaaacaatccaagatttggttgttgtgattttaggcgttttatcttttttgcttgtgttggtgtagaaatatattttgggacatatatttctttttctttaacttcttgtttttcttcattaatgttattttgtgcttctgctttattttgaactactgaacctcttctatttggtttcttcggtgattgtggttgtgtatctttagtttcttgtttttctttttgtctttggttattttggggcgcctcatccttaacgttctccatgtgagcgtttatgtatcgttgagaagcacttggcaaatttttaagtgctgcattaaaagaatctggaatttcttgtttaatacaagaagctacttgtatagcaatttgtctagttgaagacactctatcttctaaacattgtaaagtaaaaggtattaatttttccatttcattttgaggtatttcattaatatgtgatcgaatccatttaataatttcaagtctaatatcaggattcggcttaaatgaaatgtttgcaaatgatctaacaaaaggagaaggggttgcatgaacacaataagcattaattgtttttgtagcttgttctctaatatttggtctttgatcagcccaatttgtaacaattgcaggtgcaattgtattaacatattttgatatacctttatcagaagcattagcgatttgttctaaaacagataaagtccttaagacaagattcttattaccatcgcctaaatatttctttaaaattttcattaaatgatctaaatcatttgatgaaatttgcttgcatttatttaatgctgtttcaacattttcgataaattctttttgtcctgcccatttagttgcattttctccttcttttagttgttcttctgttaaaaatttggacatttttactcttacaatatttgcttcaagtggtttatttttcgatgtatttctttgccgataaaatgtttttaatggttcaggtaaatcttttgctgtttcgaaatcttttttaagtctaattaatgcatgttctggtaaaccggttaaataactttcgaaattttgaccaaaatatttatataaatattttgcaacaagtgaagcaggtgtttttacttctggtgttttatgttgtaataatgtaatcaaataaggaaagaaatctttttgtatatcacctacaccgaattgttgtataatttcgatacatatatctaatgccgatttaattgttgctgaacttaaactttttactcctctattagtactacaaatttcaaaaacttgttgaaggacaaacgaaggacatattaactctgatataataagaagtaaatcatgaattggttgtttaagttgtcgcattgataatttttcgataagatatggaaatatgattgataaaatactttttcgtattttgttcgatttaacaattacatgtcgaattatatcaattattacttggttaactccaatgtttgattgattaaatcccggtattttctctaatccacgaataatcgcatcgctaagatcatttaaatctttatatgtcgataatttatcttgtaaatcatttaagccggaaatcttttgcttaaaattagaatttgatagtttcgattggatttcacttgttataaattgattccaatttgataatgaagcatcttttggtatagtggaatcaaagttggtgtctttttcggtgtcgttttgtatttgtaaaggtggaagtggtaatgatagtatttttggtgtgataacttcttcgcttttattgatggatgctgatggtgctggagctggagttggctgcgttgcacttgtggttttcattggtgaattttgcattcgtgtgctggctttaaacgctgatgcatcatccaaaatgttatcgaaattgtaatctgcttttggaacttcaatttcttcatcttctgttgtttcttttggtgtgcttcttctaacatttctctttggctgtgtttgaacttttggttgtgtttgagcattcgctggtttcattggagagttctgcatctttgtgctggctttaaacgctgatgcatcgtccaaaatattatcataatcataatccgcttttggaacttctatttcttcatcttctgttgtttcttttggaatgcttcttctaacatttctctttggctgtgtttgaacatttgctggcttcattggggagttctgcatctttgtgctggctttaaacgctgatgcatcgtccaaaatattatcataatcataatccgcttttggaacttctatttcatcttctgttgtttcttttggtatatttcgtttgatatttcgttttggctttgcttgtgtagtttttggtgaattttgtatgcgattacttgatttaaatgctgatgcgtcatcttttatttgttcgaatttatattctttttgtggtatattaatatcttcatcatttttgtcttttatttgaagattttgattcggttttcgtggcagcttcggtgagttttgcattagtagactcggtttagatggaaaaacttcatcatttaaattatcaaaatcgtactctttttgaggaacctcaatttcgtcatcatcaataatcttttctttcggaacattcattcgaatgttttttcttacatttctttttggttgttgttgtatctttggggaattttgcattaaagtacttgatttgaaggcagcagcttcatcatttagattatcaaaattatagcctctttttggaacttctatttcttcgttttcggtttttctattttgagatatgtttttttcctttgattgaattggcgaattcattactttagttgattttgttgttggaaaagcatcttctgtgaatgactctggataataaccaggtggaggatcatttatttctggactatccaaagatgttgttgatttcttcatgtttttctgcaattttaaacggacgtacttcatataaaacggttaaagattcaatttgatcctgaaatgatttcagcatttacgtttcagtaattaaagttctacataaataaatgttagtaaaaattagctaatgaatttgatggtatattgaaaggaatattaatagattttggttaaaaaattgattaattttcaacaagatctaggatttttactacatatataaataaaaataacgtgctttgtcatgaaaaaaattataattgtgaatgttattaggaattagtttgtttcgtataggagaagtcgagttgtttatgattaattttgattacattttattgataactttcctaaaaagtgtcactgattcctaagcgaccgtttatatgaattattaacatccaactgttcaattttcttgatgaccaatattctcacatgtttaagttatgagtattaatttcttataaattaaaataaaatatattttttcaataataatttaagctaacaattctttatttatctgttcttgatttctattccaattcttcatgaacattattatcaaaaaaatataggtaacggcttgggtataaatgaaaaatgatgtaaaaattgaaaatataccaccataaaacaaacaagctattacccatgtgacagtttccattatcaaagccaaactatttatagagatttccaatttttgtaataaacaaagttgaactgattcgaaataaattccacatatattaattacaggtaaaacccataataaataatagcaaatcataattccataagaatgtatatcgaaatatatatttttgttattattattatatgaccaagtgatagctatataattttcaatttgtgtttcagtataaggtaaaattaaagttactaatgttaaagttattataaaagtataaacatgtattggaacttttcttaacctattataaatatatagaggaccgagaaaaatttgtttgtaaattgaaattaaatcgcttccttcataaaacatataattttcaaattcatcaagttctttcttatatggaatccacagaggaattaaattaagtattgtatcaaaaagaaaaacaaatgcaaatgaacgtataatattttctgtatttgaattttgcaatatttttataaaaaaattaaattctttattttcttcaattttaagtttgtgtcttccattttttaatgtaacatttagggaataaagtataatattgtctttaaatttttttgtcatcggaattttgtaaacttttttccctttagttaacaatgtgaaatttaattcgtggttcgagcatccaattacttgtatggtaaaattgttttcattaggtattttgattttgcgagattgtatcaatgatggagaatgaaaaaaattcggttcaagtttattcattatagaaccatttgtaatgttatcataaataaaagttattgttgatatatttctattttttgatataattttatatatattttcgattctagcagcatttgaagaattgtcaaattcaagcatttgagcaaaataaaatggaatttgaggaaaactttttttatatagaaaatgaatataatgaacattattaattgttgataattttgttatgataaaagcacttaaaaagcaaataatcaaaaagatgatgtttaaataatgtgataaaaaatatggcaaataacgaacatgatattttttttcgtttgagatcgcttccattaatggtaaatcgatgaagtgtgatttgtggaaacaccaccggagaacttccctcaaattgagcacactaaaatttttgaacgcacaatttttgaattactttcaaatttttgagtgaaaaccttattcaattgaattttgagcgggtgcacaaaaatggacagtacgatagaactttttgaaaagtcaattttccaccgttttaacgtttgtttttttgagctttgacaaatctgtttcggtgacggttaactccaaaagaaagaaacagaactaaatctaattagattcacatgtaggtgtaacatctatatcaacaacatttcatattttctcggatacaaaaaatatctttgcgattactttgattatatagaatgtttcatgaaacggataaaattgctaagtttttaaatcaagcatcttttaaggtctgtggtacaacttaaaaacgtttgtatgtaaggaattacattatgcgagtacaatttttttgtcattaaaaaagataccatattaaggttattaataaagtgttacactaaaagccaatgaaactatgtacattaggctttctaatttacatgtgttttctcttttggaaaagttcatcaaattagcatataattttatcaattgatttgtctaacaatttaatgaaaagagtatttttccaggatactttgtatgtgtggtgtaggcgagtctttcaaatcagtgctgatttttttcaataaagtttctcagactaaactttcgtattcacttcgttacaactttacagtaaatttcgttttgttgaaagaagagaaatcaatgaagttaagtaaactgtgagtacttgttcatcctgagtctccttttttgatatgaactgaccgatcatccaaacgaaattttttcaatgcttttcattgaaaaaggaaattattctgttgtttattttatcaccgaaataaaaaacactgaaatcgaaagtaaatttctgaattattgctaatgaaactttttccctaacaacatccttcatcaacattgttaaattgtaataacaccacccactaagaaaatgcggttttggctcaaagtgaaagatgaaaatgttagttgtccatttttaaattcaatgcttcaaaaatttagaaaacaatattatgtaattaacaagcatgaaaagtaatgctcccttattttatgaacccgttttaatttgtgggttgcaaaaaaggatcttatgtaactttaaaatttgaaaaaaacgtttttgtatttcttctccccattgaaagacgtttaaaagactatcgttgacggttttggtctggcctttggtaatgagactcactctcgcttatccagatcatgggacacaaatttgcattgatgtagaagatcctgttgctcttaatagcctttacgatcaccgtcttggtcaggacattgatggttcaattcttggacaacaatttgcaggatatcttttccgtcttggtggtggattcgacaagcaaggattcccaatgaaacaaggtgttcttactccacgtcgtgttcgtcttcttcttcgtgcaggcacatcttgctatcgcccacgtaaggatggagaacgcaagaggaaaactgtccgtggctgtgtcatttcatcagaaatctctgctctccacctcatagttcttaagaagggtgatgctgaaattgaaggtcttacagataaagtcgttccacgtcgttatggaccaaagcgtgctacaaggatcagggctatctttggtgctgataagaaggctgatgtcaccaagcttgttcttcgtcgtgaagttaagccaggcaaattcacacaaccaaaaatccaacgtcttatcaccccacgtcgtcttgctcgtaaggctaagttcttgaaggaaaagaaggcccgtagggaagcagctgttaagaaggcagaagcttataaggcattactcgaacaaagaggtctcaagcactaaaccattaattttgacatattgtttgatctatgcttctgaattggtgtcattttagaatgtatcttatttatatatatctcaaaaaatacatttaaaaaataaggtgcatgagaatctttcatgtatctgagctatattatttaggtttctttaaaaatattttttttaatggcgctattttgatttttttggtcgcttaatccccaaggcaaaatgtaaaccatagaaacacaaaaacaaagagaaaatgggtttcagaccttgcgagtcaagaaatgaccttcttaacagatgggttcgtatgaagagagaagagcgttttgagaagtattgggaaaagccaacagatcctggtactgttctaacacttgccgaatgcgaaagatggagaaaacgtgtacttgaaacaatggatgaaaaactcactagattatacacagagccaatcccaccagcagaaacgcgttttttgaatgatgaagtaaataaaatgataaaggaggtgcggcggtgggagatgagaatagtggagctagggggtattgattattccagagtaggggtgaaaatgcctgatggagatatccttaatacaaataataatcaatatcaatattttggaagagcccgaaatctaccaggagtaaaagaactccttgaggaagagagaaagcaattaattgagaaagcaactggggcacaaaaaattaacaaagaacaattaatggagaaagttaattcggattactatggcttaatggatgatgaaaagataactgaacaagagataaaatttgcaatggacaataattatgataacttttcatgggagcctgatttaacaccagccaaaataccacagccacatgaaatccaaattgggctcaacgagctgtactctggtaaaacagcaagcgttattgtttgattgatgaactgggaatccataacctaaaaaacaatttttttgaaataatttttttttttgaaaatgtataattacctaaatttttggtacaaacaaaaatcgttttgttcatgtaatgcgtcgttattatatttttatttaattcatatgaaaatttcattttttgaaatatgtttcttccattaaatagaacaaaatctgaatgtcctattgtatgcatacatgaaaatttcattcaaatttgctaaatattgtttaatcaattgcattgctaaagcaatgctaaatttgaaaatatgattaaaaatgtatatacttattaaatttttttatttattgaagttgtgcatgcaaacatattaaagcatatcaattatacataaaaaaataaataaaatataaaaatcatttagccattaaatcttgtgggttcttagaactgtcaccgttaatgtcattccttaatgagaagaaggtagcaaaaggcatcagtattaaattgattcctgctttttctacaaagaaaatccaaaccaaggcaatgaccagtcctggaacaaagctaaccgcacacattccccatgttaagtagtttaagattggccgagatataaatgttaaaacagtcaatacagtccaaataattccgcttgataaatcatgtgatatttttgcgatgtaccgataaaaagagataatagccattgcaaagcatatggctacatatgttgatggaacataaaaaccgatataacacgtttcttctaatgtttccattccaaatgctgactttagtataaattcattaataaaagctgtaactgcaatcataaggaggttagaaaaagttgttaatctctttgttgttaatagtctgaatatttgtgaaaaaattcccattggagctagaggtatcataagagagaacagtaaggtccacttcctattttcatcccaacaacttttccagaaccagagataatgaatctttctcattttccaagtttttttaatgattttcatatcacatttcacataatttatatttcacgtcacattacacaaatttcgatgagtgagacacaaaacgctgatcagacaaaaaaacatccagcaattcttgatattgacatgaatcactcatcgaaagattcgatagttttatcaatttttcttttatttttctttgcatttgccatgtttaataatatatttgattccgaagtatatgtagaagaatcaacatttccttttgatacaaattgccaaacaaaattaaagcatgttgcatttgaattaagttcaatgaaaatggataattgtccaatgaagatcgatatttcatttaaaattaataataacattattaaacctttttataacatctcatttgatgttgcaatgactcatacatatcaaagcaagtcatatttattccatcgttttcagcatagatatgctttatttggttcatccaagcctggtatggtcactgatccagttactatttatacaggtatggttcccaaatatgattctctctttatatcattaactgctcgcgaagatatcagtgaattcagttcattagttgccactgtttattatgatccatcacccactgatttgtcatatttctttactatttttgcatgtgtttcatgtactattttactcatcaatcacatcatcaatttttggtatcatcgaaaagaaatcataccaaaagaattctatgttacctttgttttattggtcattggagccattatcttttgggtattaatgttttctggcttgaattcgttttttggcgaatcattggtttcggtttattctgccgcattgagagggttctcaatttgggtcattttgaatttggttgtaaaggacacatcaaagctgaacatcatcatcatcctgttgtcttcagcaattgccgcagttgaggtaagtgaggcgggtataatatatgcatctgtttcggagctaacaaaattagatttccctttaattattttgtacgattgcattttccttgttacagccgtttacggaaatatgaaaatagaggagaagaagaaatccaaattatccaaatatttggtgttgggaactctaatgatgttttattgtacttttatatcactgagattaagtgatagtaactatgatagaatgagaaataccattcagttctttaaaagagttgtggtattcggttatttaatgtgcattgtgtcattccatgtgattcagattcagaaggtgaaaggtgaataagtttttgtggattatttttttgtagtttgatcaaacagaaatgttaaataaaaaaatgtttaaaaaaacgatttttcatcgaacatacgcagtacctttaacttaatttattgatgaaaatattttcaccagatagaagggaagatcagacatgtgatatgaaatggagcgttccgaagtaaatttgatttaaaatctttacgaattctttcattatgacttctatatataacatggttttcataacattttgatacgagagaatgtgtgattaaaatcaatagattgacctttgttacaatcaacttcaagtacagagcgaacaaaaagatgaattggttagtaaaaatgaatgtttttaaagatttattaaaaagtaggtattgtttgatttggaagttgggctttgctttacccgataagagcagtaaaaatcgacattaaaaagtgtcaaacagtaaaacgctcaaattttgaattgatagatacgataattcaattgttgtaacgctcttcacttcacccaatgcattttttatttttactcataaatattattccttaaccaaaaatgatggtggccttacatgttgtcttacactatatcttcttcttaccgctactcctggttcgcgaggttgttctctcacggtttgcgctggtgtctccgtttgcacgtcatcgttcgtgagtatacttggcggcggcgctcctccgatgacagtgccagaacggcgcttgttcattgggacacccatcggccctcccatcggtgcgcccattggcattcccatgggccttcccatcggagtgtccttgaacataacaagacgctctctgatgcttccgcgccgctcaggaggattattgttccgattcggcgctggcggattttcgcgtgtctgtggcggtggcgctgcaggcggcgttgacgatggcgatggtgatggctgtagagctggtggcgttctttggaatgctgacattcggttccgaactgatgatgatgaagaagaaggtgcgggtgagggtgcgggcgatggcgcagcattgtttcgctggaaggcagagagcctatcacgaatggagctgccggatgaggatgctggcgatggtttaggtggctgtgcgcggagtgttggctggggaggcggctgtgctgttggcgatggtgctggagtaaactgtgtgcggagccttggcgaaggaggtgctgcagtaggctgttgcggcggcggtgctgttggtggaggtgctggtgtaaactgtgtgcgaagctttggcgaaggaggtgctgcggtaggctgttgcggtggtgctggagtaaattgtgtgcggagccttggtgaaggcggtgctgcggtaggttcatgttgaggtggtgctgaagtagatggagctggctttgacggttgtgttgtcggcgcaggtgttgctgttgttgctggcttaggaggctgtgtatgctgtgttgatgttgatgatgttgtcgctgttgttgttggtttaggaggctgtgtatgctgtgttgatgttgttgatggtgttgttgttggtttaggaggctgtgcgtgctgtgttgatgttgttgttggtttaggaggctgtgtatgctgtgttgatgttgttgatgttgttgttgttggcttaggaggctgtgtatgctgtgttgatgttgatgatgttgatggtgttgttgttggtttaggaggctgtgcgtgctgtgttgatgttgttgatgttgttgttgttggtttaggaggctgtgtatgctgtgttgatgttgttgatgttgttgttgttggtttaggaggctgtgcgtgctgtgttgatgttgttgttggtttaggaggctgtgtatgctgtgttgatgttgttgatggtgttgttgttggtttaggaggctgtgcgtgctgtgttgatgttgttgttggtttaggaggctgtgtatgctgtgttgatgttgttgatggtgttgttgttggtttaggaggctgtgcgtgctgtgttgatgttgttgttggtttaggaggctgtgtatgctgtgttgatgttgttgatgttgttgttgttggcttaggaggctgtgtatgctgtgttgatgttgatgatgttgatggtgttgttgttggtttaggaggctgtgtatgctgtgttgatgttgttgatgttgttgttgttggtttaggaggctgtgcgtgctgtgttgatgttgttgatggtgttgttgttggtttaggaggctgtgtatgctgtgttgatgttgttgatggtgttgttgctggcttaggaggctgtgtatgctgtgttgatgttgatggtgttgtcgctgttgttgttggtttaggaggctgtgtgcgaaatgaatttgcgggtgcaggtgctgtatgctgtggtgcggcgttatttttccaagcagcaagcctatcacgcatggacatacctgtggacgaagaagttgttgatggttttgactgtactgttgttggcgttggttttgactgtactggagttgttggttttgtctgttcacctgttgtcgaagtttttggttttgcttgtgttgttgttgctgatgtcgtaggtgttgttggctttgattgtactgttgttgtagatgttgttggctttgattgtactgttgttgtagatgttgttggcttcgattgtgctgttgatgttgctggtgttgctggttttgtttgtgctgtagttgttcttgaattttgttgtggtgttgaagcattacttcttccttggaatactgaaagtctgtctttcatagacattcctgttgatgttcctgttgaagttggtgggtgtgaggatgttgtttgttgttggcgttgctggactgtattagtttgactaggagttgatggatgttgtgcttgcgttggtttcgaaacatttgattgaggcgttgcttgcgccggttgatttgttgtattagccgtatacgcctgtggtggctttggttgagttgaagcagatgcattgctttttcctgagaaagctgatattctatctctcatagaagttcctgtggatcgaaaagccgatgcctgaccaggctgcggagggtttccttggttcgcattattttggaaagcattaatccgatccctgaaagaactcatgtttgcgcgtaataaatgtcagttattaattgaaattatcgtcatataaacgttcgaaaatgtcctttatcaatttgaaaagcggcaaaaattagtttctttcaatttattatggggaaaattaaatgactttaacttcaatttgaagaagagataaaacattaaaactcaaatttaagtatgcacgctacttggagtttttaactttaaagaaacttttttattataatattatttcgaattaacccaaattatttatcatatagatatgtattaggttatttgttctggaattttcctttggaatggcttcaattttggattttgagcgaaaataatggattcttgttaaatcacaatcatccaattggattcattaatgaaagttatttaatcgttttgcacggttttcgtgagtccctttaaaagtgatgactgtaatgttacagtttttagggggggttaagaaaatattaactcagtctgtttgcataagaaaaattcaaataacatgtctgtttatttaaccgttatttctttgctttgcaatttctagcaaaaaaatttgccttttaatgtgcaaaaataaaaatgagaattttaataagttataatcgttataaaatgttataacattttttgttttaagattttataaatgattaaatgtactcagtgaaattcgtttttggaaaaaaatgagttagcttttttgttcgttaagcatggctttgttctttttggctacgtttttggttggctggttttgcaaagcacaaaaggtgaacttcctggtgaagtaaatttgagagcaaaaccgtctttaaagcacttttgattgatgtgatagttgatgttaaatcacttcatttttatattatgtcccaagagcaagttgagcaaacaacaactgaacaacaaagccaagaagaagcgaaggtagagactaaagaacaagaacaaattgaaactacaattgaagataatcatcttcctccagaagctgaagaaaacaatgtaaatacacctgtcgaaacaccaggagaagataaagtcgaagaagccaatgaggaaactgaaaacgagaaagttttagagcaaagtgctgaagacaagtctacacaagctgcagttactgaataaaattttgctgcaaagaaatttcttctgttttttccaaaagaaaacagaattttttgttaaaaaattgaaaatccaaatataaattgatcaatttaaaacacttctcgcttggtttgcggaagaaaatgtttgcggaaacgagtacatcctaatgcacatgaaaccgtatgattcacattatattatattatatgaatatatatatatctatatatatttctctctaataatgaatatatgaataagattaataactataatggactttcgcttgtaaagcaccgtgagcgtttgcttataagttgttaattttgtggtacatttggagctattgatgaattagaagtgacgattaaaaccgtggtgtaaaatatacgttaagcatttgaccggttaaaacgttattttccagatgtttcgcgatcgatatcaagcagggtttttaaatttgttttattctgttggttccaaacctctaagtatatgggatcagcatgtagaaaatgggtatattaaaagaatcacagatcaagacattagaagttgtgtcattgaaatcgtaagtacaaatgtaaatagcacatatataacatgtcctaaaggacctagagaagaacttggaatcaaattaccatttcttgttttggttctcaaatatctcaaaaaatattttacttttgaaattcaagttttggatgatatgaacatgcgccgtaggttcagagcttcaaattatcagtccaaaacgcgcgtgaagccttttgtttgtactcttccaatgcgtttagatccaggctggaaccaaattcaattcaacctttccgacttcacacgccgcgcttatggtacaaactatcttgaaactcttagagttagtgtttatgcaaattgtagaattaggcgaatttactttagtgatcgtctatatacagaagacgaagtgccacctgaatatcgccttatacctaataaaactgaaagcgaagaatgagcaaattgtcaagcaatgtataaaggagcacctttataaaattatcacaaaataaaaaaacgttatataaatatttgaaaaagtcgtgtaatgttctctaaatattcaatgtttaaatggtcagagcaaatgaacgttgcaaacactgaaagatacaaagaatggcaaaaacaatactcgtcagtatttgttccagaaaatctccagagatcagatgagaccaagttaatagaaggttattctgttcattcaaaattttttcagggaggagagaattctttatcagcttatgaaaatgaattggttgattatcaagggcaagtgatttataggtggaggaacttagattctcatcaaagtttgtcgatgtttaaacatcgaaatgggaatcattatcttgtgtttcagatagagttatatggatatagtgtgtatgagttagaagctgggaaggaaatgcattttgtgccattacaagttcatcctgaaaataaaaaaaattttgttgaagtattcatctggacatcggctgactatgatccgaatagtgatcttttggccgtaggtggctgttattgggcatgcccttggtcaacaattgttgttgattttgcagatcctctccatgaacaacctgtcgagcattggttgtatgtcgaagatttaattgattccaagcaaattgatggcgatgtggatttcgaaagttgggtcgacggaaatcttctacttaatatcaattccgaaaatcaacataaaattctattaccaatatcaaacataaaaaacgccttgatagaacttaaggcaaaagatagggtgtgcgacttaatctaacgtcttcgatttttgaaactcattccaaatttttcataatgaaataacgacttataaatatttttctctatacaattttctttttttcacaaacattttgatcaatgcgaacaataattaaaatattttttgacttctaattttaaagaaaacatctctaaacaaaatgatttttggtaatatcaaaacgagtttataccttaataatttcgattaaagtgaaaatatagacataactatcatagcattgtttgctaaattttatattatatttgtaaaaaagataatattctaaataaataggaaattatgcataacattattttctagattatctacctctttcagaagaaacacattcttttatttaatattcaaacataaacacaaaaaaataccacaattttattgttttattgcaaccattgtgaagagcacttgaatcaaattgttcattttgcataagaaacgctattgcaattgcttaaaattcttatggaagagctttcttctttaaagtttaattccatcaattttcaacggaattacttgttctaaccagaaagaagttcagcattttgtttaacagatattatgataattcgttcctttttaatccttgaactctctccctacattttttagcaattcttcccgagagaagctcatcaagtaaaattccacgttcaatttctattatgggaacatcttcgaagaagttgttgaacgatcttctcttgatgctcctgagctcattccgtaatttaatggaaagccgcacagtttgcaaagtaaatactatgtttaaccacatcacaacaacaacaataacatgaaatatttaacggtctctaatttattcaaatacaaaaagtgccatacaatgaactcggacgacattctccagcgccagctccaaatgatcggctacaaaaaggcctcttcaattcagagcttcggtgacattacttcggaccaatttattgatataattctttacattttcaaccaaattcctcaaacggcaaatcagctttctgctccacccaaatcacactccgctttgttcaagtacaccactcaaatggttagtttgatgagctctcttggatactatggcgatttacgatacgacaatttcatgtatccaaaggcagacaaaacttatgatgtccttcgtttccttcttgagaaggtaccacgatcggagtcagtcgcgacaaagacgacaacctcagtcactccactttccttgtcgatatcctctgcaatttccaccttctccgaagcccaaaagcagaagaacaatcgcgagccaatcgctcagccacttccccttcttaattcctctctcccagagcaaactaagtcgtccataaaatcaattctcaaacagccaaagatcccattcatcgccgtcccaatcctcagcaactccattccgttcaacaaacaatgcggccccaactcctttgcgtcacttctttcccgcaacgatagagaaagtgacatcgacacttttgttctccctgaggccgatgaagaaatcgcaaccaaacagacctccacaaagtcgctacaaaaagtcgccaaacgtgcgtttgcgacttcactctcatcgacggaagacgtttccatatcggcgcagccaacgtcgacggcgccatcggccaaaatcaaatcgcgacttgagaacatcgcacgttttgagttcggtatctccgacactaaaatcggcgcatctgtagttgtgccaactgtcgcagcatcgtcactcgtcagtcgtgaagcggaaatacaacaaacagaagaagtgcaacagataaaagatgtgtctaaagagccgaagttaacaatggaacaagtgcgctcgataaaagctgagcaacatgaagaactccaaagtacagttgaattacttcaagcgacagaacaaaaagttgcggaaatcgaagaccaacttgaggccgaacgtgaagaacttaacacaataacagtggatcttcagtcattgattaatgagaatgagaaacttgaagctgaagctgagcgagttaaaaacgttgcaactgtatcgacatcagattcgacacaaatcaaacaattgaaacgtgatctaatcgatagtacatccgaaattttggatatcgcgaaccaatgggaaccaaagaggaagcaattaatcgctgagtatagagaattgacgtcgttcttgaagaggagaaaagaagatcgtcaattacaaatggcgaaacttgcgaagttaaagagacaattacaagaaggtgaagaaaaaatgcaaagtttcgacgtgtctattaatgagcttaagaatgcattggaagcaagaggtgaacaaatgcctagacatcattacgttgaaatgatattcgatatgattaagaagatatcgaagcaagaagctgaggtcgaaaaaatgagagtcgattatatcgctgaaaatcaaagaatgaatcaaacagtggagaccgttaagagaacatggatgttattggacgaaacaatttattcggaagctaagaagaagaaagaagaatggatgaataagtcgtatagaatggtggtggaattgttgactatattggaaaatacatcagaaaatgtagagttgtcaggtaaattaagtgcacaagcaatggaattggaatcgaagatcgataaaattaaacaacaaaacgatccaaaggcattgaagagaatattgaaggatttggaagaggtaaaagaagaaattaaagaactcgaaagcagataagtaaaaggccaattaacttgatgtggttttgatgcactattgaaatttcgaatgtaaagctttgaaaattagctttggaaagaagaaaaaaaacagcgataaaatatttggatataaacaaaaggagctgcgaaagaagtttttgattataagcattacaataaaatatagactacagaaaaaacatgtatgccgacaccttaatataacctaagcctacactgtagcattattcatagataacatacttagtaatatttatttactaaaaattttttcgatttaattatgtaaatttcgagatattcctatttttaactcacttcactaaggagaaggttaacacaaaaaatttttttttcgtttttctttacatattttaattaattcatatttttgggactgagtatacttaatagatattaaaatttcaatttgccaaaaaactttataaatatttatgatttatctaaaattatgttgtttgtttaaagttttttcgcaatctatttatgattaactttattacaaaaagattttctcaatatttattgacacatgcggtgcactatttgtgtaccttcttcatcgtattcatcacgtgtgataacgcattgtgggaaccaattgagtgatgcaaagatagagccgcctatccaaactccatacctaagttctggtggagcaatgactttaatacacattgatggtggagcaatgtttactatttccttatacattcgttctggaaaaccttttaacgctgtgtttcctcctgacacaacaatattttggtaaaagctcttttgttcctctattttaaatgaattaattgaatcataaaagattcgatgaattcctttctcttcgaatccatttaacattggtttaaaaagaagttctccacatttaaatcgttcttcactaatatttatgatgtctttatttgggagtgtatattttatttcacgaatagatgaagtcgaaaatttatatctttcttcatcataatcaattgcaacataagaatgtttttctttaatgtcgcgaataatgtccttttctgcatttgaaataaaagtattttcatgttcattaataagtatttggagataatctgtgatactttcaccagcaagatttgtttttcgagcttcagtttttctacatttgaattcataaattggaagaatttgtgaaacacctcccccagattcaagaacaattcctgttttagttcctgatgcaagtaatggaagatatggttgataagcaacataaaaagctggaacattaaatgtctcaaattgaatctgaatcattttttcccgattagatttcggatttaatattgcatctgtaaggagaactggatgttcggttacatctacttttaatttgttattatatagatagctccatattttttccatattatcccaatttctaatcaccccatgttctattggataatttaaaatatatttacttatgtcagatataacttcatcaccaatgtatatatctttagatgatgaattcatttttgaatggccgataattgatggaataattgtacaaggcgattcttcaccagcataacctgctgcacacatgcttgatccattatcaatgactaacacttgaatttcacaatcaaaactcatcaaatgtcaaaaaagaggaagaaagtgaacacaattttggcattttttgaccatattcaaataaattatacagtaaagtatttaaacaacaactgttatttcctaaaaacgattaactcattttattgctgataattattttaatactttatcacaaattttttgcagtgatataaataatttatgaataagaaagttatggataaattaatctcaggaagaatatgatataaacattttctcattgagtcaaaaaaatggtgaaacttgcaaagttaaagagattttcaagatgttaatatttattattaaaaaaagaaaatagttttaaatatcaaagcttattttatattaaacaaaattacatttgcacgacaaatatgtcttctttgaaatcagcaaaagggtcttcttcaattgtcggtatagaaattcctgttaaaaatgtatttgtagtttctttttcgttgacattttcttctgaactttcgtttataatattttctgcttttttgtttcgaattcgaatcaataatatgacgagtagtgtcaaaataatcataactataataacaacacaaacaataataataattgttgttagattatcattacttaggaattaatttatatttatatatgtataaaaatttgaataataattataatatgttgaataaataacaattgtgtaatcatagtaaataaatttagtttcaatatatgaaaacattgaattacgtaaaaataatgaaaatgatttgatttgagtttcataaaatgttaatttatgtgtaattaaaatggtgaatgtataagaaaatgataaagttaaataactttgaagtgatttcacaaatgtattcaaattggtgaatgcacttgatttatgtgtttgattgtgtgtatgtgtttgatttaatgaatgagtttgattatgtatatgtacttgatctagtgaaagtatttgattgtgtgtatgtacttgatttaatgaatgagtttgattgtgcatatttatttgaacttgaaaatgattgagtaaataacagtttacattcactgtaaatggaccaaatcttgtatcttcatatgttggatatgtaagaactgttgcattaactgaaaaaaatgcactttctccaatcgatagttgtgaaataccgtaataataaatatatttaagattattatgcgaaaatgcacttgttgcaatcgctgataatatctttacccaattaaagtggaaactaaagaaggattaacttcaattggttatgcatttagtggttgttatagtttaaagtcaatcatattacctaattctcttcttaacattggctcatatgcattatattcgacttcattacaaaatattacattaggaaataaaataaatattatcaatagttatacgttttcaaaatgcacatcattagaaaatattataaatggaaataatataagcaaaattggttcatgttcattttatgattgtaaatcattattaaatattccgtttgataataatttaattaaaattggttcaagttcatttgataattgtatatcatttcaaacaattagacttggaaataatttaaaacaaattggttcatatgcattttataattgtacttcattacaaaccattacatttcctggttcacttcgttatattcatgaaggtagttttgaatattgtacttcattagttacaataatctttgaatctaatataaccggggttggagcgtatgcattttatgaatgcacatcattaaattgtatttattatcacagtgataaatacgtcgatgtagattcctatgcttttagtggtgtaaaaacagagtgtgtgtatgttgataagtcgtatccttatgaaaaatttggaggtctcgaagttaaaaaaggatttcctaaatgcactgcatcgacgattaatcgtgatctatctggaatacttataccaacactttgttctataatacctttttttgttgtaggaacgacatttgttgtttttatactcattcgtcgtaaactattaagtgttcaaccggatgataattctcaattaaaacagtcattaattatcgaagaagaactactgggaaatgaagaattagaaccaaaagttcagttagaaaacgaagaaaaacaagtgaattcaagtgaatgtcaaaaagaatcattagaagattatacttgatttgataacccttacaatgatgttggtaatgatttcatttagtttgatgtaattttataaatgcacttttttaataaaaattatttttattttttcatatctatttttaagtataagaagtgacttagaagtgaatttaattattgagataaataaatataaaacattgcgttttgaattcaaaaattatagattttaataattatatttaattttgaaaaactctataaaatcaaagttgatccgtaataaaattcattagatgttatctacatttgattcactaatgaaccttttctgtcaaagcgatacatagtttttccattcctctttttttttaatccgaatacaaaaaaaaatatacataacacttcattgtggtttatttatgtggtagattttaaccaagatgagaatgaaattcatttctagatatcttttttgggtaacaaattcttctcatgagattttcgcattaactttgatgatggaaagcattagataatcagaaaaaaatagaaaaatttttaataccacaaaatttaatgaattttttatccaagttttaaccactctattgtatttttttattgtgatgtatttatgctattggtatttaccagtaataaacatttttttttttttggaaataacatttggaaataattaaagttatttttgtcagcgcttatgtatgcatccgaaaatatattgatattcatgctaaagatatttttttcttgtatttaaaatcaatttttatgatataatattttataataatatactctcacaaaaacattttttttgtaattataatatttgattggctttttttagctccaaaatatttcattaatattttaataagcctttttcatcatgttttatttttatctcaccaattgagaacataaccgaaaatttgattcaattcccatccttcaaaatgacaaatctctccaacaagacaaagattctcaaaacattatttaaggaagttatagaacacagcaagtgcgcattgatctgttctaagcagcttgaagctattcttccatccataatcacatatcgagataagttattaaattcaaatcttaaaatcagtggtttatcatcaaatttagtaactatgcacatcgaaactataaccacaatactctctaattttgatttacttcttcaactctgttcaaaaaattcatggccgaaactatctctttcgctctcaatttcaacgcctttcaacgagataaaagatattacacaacgacttgaagaagagtttaagcaattacaacttggaacaacaccaataacaattccgaaagccgctattgagcaagacctcaaatatgtgtttgatgtttacagtgcatccgaatccaaaacaccgaaagccaaagatcagctgaatcttgtcaaaaatttatattcagcatatgatatcaatgttccatcttcaccatccaaagttgatgacattgtttcacaagcgggaaattgggaaatcaatttaaatcaaatttcggatgaccttcaaatcattcttggatcctcccaatcttcattgtcgaaaactacaattgtcggcaagaaagacgaaatattccttctcaggatcgttgccagaaatcagcatgtacttgaccgagcgcaacgtgagctcatgttgttatcgacattgaagcataagaatattgcaaattttgtaggaggctccatcaaaaacggcattacgtgcgcgttcaaatatggcagcaactccattttatccaatttacttcgtcaagttgatggtgcgtcaccattagaattaacgaaaattgcgtatggaattgcatgtggcatgaactacttacatagcaacaagatcttacatcgtaaccttaactccaatgctgttattcttgagaaaaagaacaaaccattattatggaattttggtatttcatcccaactaacaaacccaacgataatgccaccagagtatcttgagtccggtgtttacacacgtaaatccgatgtatatcaatttggtttgttattatgggaaattggtacccatatgagaccgtttgggatggactcgtcagaaaccgttaaaattaacgtcatccagaaacatttgaggccccccatcaatgacacttttactccgcatatgaaacaattaattgaagattgctgggcacagaaccctaaggacaggccgactttcccacaaattcttcgacgttttgagacaggcaacatctactttttgaattcttccacacaaaacgtgtcaaaatatttcaagaagattcgaagtgatttgtggaaaccagagaaagtcactgatgctaaacttaaagactttgttactgcgtattcagttaaagggaaaggcgcaattaaaactaaagcgattactgaatttgttgataagtcagataaagagactttaattaaagccatttcacatggcatcgttaacaagatgaaaatacttgttaacaaagctgagaagaaacaaactatcattaatacattatgtaaattattgtcacattcagaagtcggcaaatatgcaattaaaagtttcatcttttccgatggtgtcaaatgtatcattaatttaatcaatgataagaacaacaaagaatatggatacaaaatcattacgacaattggaaataatttgtcatcgacttctgcatgtcaattattaccttatgtattaaaagataataacttaaatgtgtgtaaatcattggtgatattgggcggtaaggaatcggcaaaaatattgaacgaaaacatcgaaactttaacagacgcattaaaagatcaaaagatgaaagaagacgcttcgttcctaatacagttttatcttgaaaatgtatcagctcaagaatatgttaaaagaattactgtcctcgatgcaatatcgattggagatttaatattattgaaacgtttgatgatgtataatgaatttatcgaaacattttcaaatgatcaaattatatctttatgtcaattaattgtaaatggtggaaatgaacaaaaacaatgcgctttgttatttgcattaagtttaggtccggaattttatcaagttatttcacaattcccgaatttcattaattcgattttagatattaataacattgaattagttagtcgattcattgtaagagttacacgtttccctcaatcgtgtgaatatttgttaacgaataagtccaacatattcgaaaagaactttaataattcttggtatataatcgctttaagtcgaattgcttcttattacccaaccgccgtatcgtcactatcgtttgtcaaaaataaaatcaaagaaaacttgaatgacatgaaaaatattgaagcaactgttcgattattaggtacactttctagatgtaataatttttggcaagataatgaactaattaaattattatttaagatattagaatcaggtattattacaacattagagaaaatattaattttaagtgttatatcaaatgtaactgatttcatatctattggagatgaatacttcttacagttattgtcaattgctgaaaatgatggtaatatttcgggtatagctttaaaggttatatctacaatcgaattaccaaataagccttcaagagaattgttgagattattgatattgttaaagaacgctatcgaaaaaggtgatgataatgcaaaggctgcaagctcgaaaattatcgaaaagttggcatcaaacgcaaatttaagagaaatgtttcaaatccaaaagttcgatcaaacaattgtgaatgcgtccgctaatgaaagtgatccaatgacttttatagctttgatgtctgcactcgataaattggaagtgacgccgaaccctcaaattttgtcattgttcgataatatgttgatgaaatcattcggtgatcacgaggcttcggaagaattcatggaactcaggaggagaatgcggctgaaggcgaagtggtagtaaatgacgcgcatcaaataatatttgatgcgataattaaaaatttttttgattttatgactttgatgtgatttaattaacacgatgtgaagtgaatgaattgaaaaccgaattcagtgaacgaattttggtgtataatgtgcgtacgaataagctatggctggtgtttataaatttgttggtaatgagaaattaatttgtcgctcgaaaaaatgcattgataaaattatcaaaaatcatttgtgtaaactttgttcatcattgataaagaatataaaatcatatatgcaaaattgatgaacacacttagataaatataagaatagttatgaagatttgtaaaaaattcaaaaaagtggttttatcatacctataatctgatgcatccacattattcaactgatctcagatcatgtaatttttgatttttcggaagaatatatatatatattataaaagatgaatatgatttaaaaatcatgcattttcaacagtagataacgataagttcttaagagctttaatgaacgaatggaaaatttaaaccaagtaattgagcaaagtcaatttactaattaaataaaaatcatatgaaaaatctcttatgaaatcggaaggaatcaatgtttgtttgccttctatattaaacttataattattttaactttgttgtatttaatttgagttaaaaaaatatataattattagaataactttgtttattcatttcagatgctaagttgaacgctgtttctgttttattcatatattatttcttcttcagtatctctactgctacaactattttccaattctgagctttttgaattgtcttcatcgattgttatgtattttaatccacaaagacaaaattcttggtaattatgctttaataattttttaaacaatttaaattttttaacttttttcacaggtaacattccaaaaaaattgtattggtaatttttaaatgtgaatacttctgttgtttgttcaaatgctctagcccctattgtaggacttttgacaccagtaaaaaaaactttcaaattcttaactctataaaatgcatttctatatattaatactagattaggtccaaaatgtacagttttgagatttagacacccttgaaatgcattttttccaatttcaacaatttttggtaaacataaatatgatattcctttacacccatcaaatgcgaaaggtgaaattactttatcatcttttgttgaaaagaacatttcaatccttccaggtgggaaaagccttaatttcctccctttattatgaagaattccatcatttttataattaaaaatataccgacttgatgcatatatattaattagattattacatgcataaaatgctgagtggtgaataaatttaatcttactcccgatatttatttctttgatttttgtaaaagcaaatgcaaatgaattgattttgtccgctttcgttagtccttcaatttgttgtaagtttatgcaaagctcaaaagctgatggtccaataataagtgatcttttgctagcaataaattttttgagttttacacaagaataaaaagcttctttctcaattataaaaacatttgattgtgacatatcaatttcttcaatttcgttccattgataaaatgcgcgactcattacttttctaacaaaaagtgaaaatattattttcttataattttcttgcgtatactgctcgacattattttcattaacttcgtattgataaattgttaatgtattttgtgacatttcaaggttttgtcttctatctaataaatccatacacccaactttttttgtaaaaataaagatagaaagaaaaacaattttttttgcatacattaaaaaaaataaaatactttctgaatattttttagaagaaaaaataaaatttttaaacgaaaaagattattaaaccatatttcaccatttaaaataataactttaatcaccctatattgacagcacgaaaaggcaatgaaattttaattttaattttatcattacagtcaaaatatgtgttttacaattctattaaattatttatgccacatcactgaaatttcaattcttattcaatttttgaatccattaaaacacttcacctcacctcaattccacgtcgaatttttaagacttgaattctaattcatagatattatttacattaaaaagttatcattgtgtaccctacacttgagctattgctcattagcaccggcctccatttctgtttattaaaataacaatgcatccaatactttaatattggctcatcttccgccgagaatccgacctttttcatttcttcgagtattttatccttcgacaatattttgccgactgatatttcggccaatttcgtgataaacttgttcgcaatatttttgatcgaggaatataaaattaacataaacaatgattctgatccatctgcgcctttcccaagtgtcgacgacacaaatgaacgtgctggacatccatcgcccgagtaaacgctattatcgaagtcaagcaaactgatcatgctcttatttttttgctcaaagttcttaacaacaacaatggaatacttaagacacatgagtgcattagcattatcaatacgtgcaatataattcggcttaaaaaatggagataaaaccgaaaaacgtttcgctaatgacatcgcatcatctgtgttttgtgaccgaataactaaggtttgaccactgagaacagtaaaagcacaataaaaaaaggatttgttcgctacaagctctgtgagtttgaacttagaaagattaaagtcatcgcgaagaacttcaagaacaagttgagagtaaccgttgagataaccgccgaagtcgatagatggcaaatcttcggtgtagctgacttgcgtttcgactgtcgcgaggatgggagagacaggaagctgtgaaacaaagtcatacaagaagggctcaagtacggtgaagtgggtaagaactttaatatgtctgagatcattattaacaatcatgaaataacttggatgcttagattcaccttgattttcatcgatttccgtgatgttgaaatgggctaaaatgggtttgagtgcattaaacttggcattaagaatggaaatcgattcatcttgaagattggcatcaattgtttttttgagtgatgacgcaaatttcattaaatcttctggaaaacaatcaactgtaggatgctggatcttatttataatatccatgatttgttgctgacgagaatattgaattgaataaattatatcttttgattgattagctatgacaaaaactatagagcgacaaaaccctcgagcttctatgtcataaacttgagtataaactgcaatataataagctgattcatacttagaaattactgtagttattggtaactcacatgaatcatatgaatttgggttagctggcgtgttaacaacagcattcataaaagcagtagtatctgtgattccaggtgttttcccatattcccaaaaagcagatggaggagctccttgagaaaattcaaataaggcagaataatatctccgctcctcggggaacatttgtaaggtatcttcagcagttgctgaagaccaacgagacaatcttctgtgtgattttggggaatcttttgattccattgtcgtttacttggaaaaacgttaactaatgaaagttcaattttatttttcattgaaattttcaatgaatgccaacaaaaaattactatcgttttacttcattgtttcgactataaaaagtgccttttaacgttttaatcatgaaataaatgtaattaaaaaaaataaagaaaagaaatatttttattgagttaaaaacaatcaattagcttccggttaaattataattggtatatagtatttcctatgttgagctacataatcttgaaatatattctgaaagtcctaaataataagcatagttcgtgaaaacgattgcttcacttctattttctgacacaaacactccgtattcgttttgaatgtaataaccacagcatgtttcgccatcaacaaaatcagaattacaattatgaaatttatgtgagattccatattttttggtttcgcccatccataacaattcattgaattgagcagacgctgatttgctttgtaaacatgttgaattcaaatttgataattcattggtgatcaatataacaaagttaaaatatttttgaacgctccctccaatgatcttattgagggccatagtattggttatgaggttacttgcataacaattttggaataatgaacttaaagtatcatcactagatatcaacttgtcttgtaaaacgatgtggaggtctgtttgagtaatggtatctgtgaatggatctccttgaaaatatgtgtattgagaatcaacatccagaattcgggtaaaattattcatgttttgctcaaggaattgacgaattgcaaagtattttagaacttcaggaaatgaaaaatactttctttgtaagttatttgcgtaaaatgtatttatatcacatgagttgattatttcagaaatttctttaggaattctaacgccctcaaccgtaattaaataaacagttgatctaattccaatgcttctaatggaaactaaaagatcacgtatagtatcgaaattattatacacaaaagttattattagatctgatggagtacttgttattgggtttgttgaacattgataacaaacaggacaagttgctggtctggatgcattcatcatttgtgttaaaggagaattatttgtaaatttcatttctagagaaagaagaagaataagagcaaaaaccagtattactaatggtatgtaagaaaaaatgattgagatattggactttaaagcccttagcatttggctgtccactttttgagatattaccgatgattaactgcttaaatttttttttgaggaaaaaaaatcaacacttcattttcttattcaaaaagtaggaattaacgtcaatcgtccaacagaaccaataggtttccacttataagcaaatcatgactaaaattgcaaattcggaggtcatcaatttactagaaatcgtttcagaactattaagtccagcggcagtatatacagttacaacaccacagaattttcttgaattacttgggccaacctatgtaaaaagtcttcttgctctctcagaaataaaatcacctgaagagctccttaaggaactacaattatttaacccaactttagttaatgaatgtccaacttttgtatttttcacgtcaaaaggtcataattcaaaaaaatcaatcaaatggaatcttatcagtaatccaccatatttatacacatttgatcctataactaaggaagaaacaaaatcatcatttccatgtgaatccattataaagaaaggtaaaaacacactcaaaattcactacattgatggttctacttcagatttatattttattagcaattcaacttctttttatgattttgtttcacaatttcttctaaaaaataatacgcttaaaccttttgatacgtttattgaatgttgcagatattgtaataaatatcctaaaggcttcaaagcccttgagcagcacattgttaatctttttacacaatccaattatattcctatccgtcatctttatacacttcgagttgattctcgtttcaaacgcattattggaacctctttagtgaagattaactcatctaagaagatgctttgtttttatctcaattacataacagctttatacttcgagaatccaccatcaccacaagagataatgcgtgctgactcacttcttaccaactctttaggagcagttcgtgatgtttttactccaaatttttatcgtgtcatcactgattatttaatatctgaaaccaaaaacttcaatactaaagaagaagttcttagtggttttattaaacttgttaaaacatttcctattcccggaattcttcgttggatttgttggatgctttatacagaagcaaaacgagtttttccagaaggagatggcccatattatagtgttagtaactttttcttcttaagaggtttaggtccagttctcacaagtattagtgatcaagatgctaagaagaaatgtattcttatcactggacttatcaatttttcggcgaaacctgaataccaacaatttattccgcttttcaaagaattaatttccgaaatttcgttaaacataaacgaatcaaatcttgtgcaagcaattacagaagatgaattgacaacggctgtatgggatttggtgggagcaatagaagaaaatatagacgcagtaacagaaatattacataaggatttgcctggaaaacatccaatgcaatggttcattgaaagacagtacgaggcagcaaaagcttataaatctgattgaatattttggtgttagtttagtttgaactcattaaaataataattaatttttaaatttttagtttttgttaaaatgaatgaataaaattaggatttttcaactaatgttgcgaaaataaatacaatgttacacattttggtgtatctaaaataatttataagtcactttttaatacttcagattaaaaatatcacaaactcatcccaaaaattgtatgaccaaatatcagttcaaaagtcatttcaacgaaacgaccgcattatatacctaccgttgctgcacattatgcattgcactgactgtagcacattgacatagccttgaaacaaggaaggagagtacacggcaaaagtactttgttttcagttcgaacaatactttatcaaaatatcaattttttttttttgtcaaccatacatcaccaaaatttgtagtttgctggaagttcttattcggacgttcattccaaagcattaatagaccattaatacaacacacctagcccgaaatttataaaagaaaatactataattcaatgctttattttgactttttaacgagtttactcaacctaaaaatcactaagaataaactattgaattcctttcaaaagtcatcaaatctttcggatttttgggaatgagtttgtgtgacatcaagtttcacaaagttattatgtttttttttaatgtttgtccgtgagccaaacaatgttaattattttttttgtttctgttgttattagtaatttggtatattcagcatttttctcataaagattttcatgtaatttatattttgaatattgaaaagcaattcaagcattagaatttatgtattcgggaaagaaatattttcagaaaccattacaacattacccagttttcccatagttttcactttttgccacaggtttctatgtattgaattaatataccttattttatctcagcaaaaaacacctcccacattcagcccaattagacaaaacgaaaaacacttcgaacactcaataagagaaagcatcgggagatttgttgttcaataatattaaaaactaaaataaactttttttacatcagcagattttttattgatcataactttattcaaaacccatcaaatcatctaatttttgttgcgtagttcatcttttctggcctattttaagacttcttttcctcttctttttgtcttcttgatacttgcaattgagatgattttgatcgtttccctgccagtttttcaaataatcttccatttttgatgcaaataattggcctttacagctcttctgatgcctgatatatttcatacatattcatcctcctcttcatcatccacgagattttggaagttgtcagcatcacatgatttatcatcaatttccgcatcaccttcattttcctcttgtattcctttaaatatccatgtctttaacactgcatcccttggtagctctccccaacattccaagaacgaatcagcagcttctgatttgctatatccacgcgattgattccacaagaactcattaaatttggagctagcaatggacttaaggataccaaagacccttatgtcttagagctgatatttttcggttgctgatgtaggaataaaaaacatttcgatgttgttttttctggcttcttcctctattgctttggtaagatgtgattcatatctatcacacaaaagaagtcatctatcattgcctttccacttgcgaagtaaacgcaaatattcgatcatgcatgactaggaagtatttcctttttttgaatgcaagatttcatacttgcaaaggtttgacttcattgcaccaaactgttcatgacatgcgttcgttatcccctgtgcaataaatatcggcggatattttttgcctgaactagaaatagttacaattactgataagtttttcctatattcatccgggagctgtgcattgacttctccatgacctctttgggcaagaacttggtacctgatggaaacatagttccaccaagtctcgtccatatcgatgatatcatcgtctttataatttgctattgcatttaaataaagattggcaaattcatcaacttcttcttgagaaattttcattctttcattttcccatccttctagagaaaaggccatatcgttcacaaaagtttaaaacaaaatggtaagaaataggtatgttcatattggtctgtttttgtacatcaaaagacttccatgattctaagagtaaaaggcagagttgtttcctcttgacaacaatccccggaatgatttattggattttgatgaaatctgcaactgcttcttcttgctttggagtgaatctccttcaccaaacaccatactgctgtccgcgacgatagttattatttttgagttttttttccatttcgaaagaaggctggacggaacatctgttctcttttgaatattcataagtttcatgctcaatcaaaggcatgaaatatctattctaccaatgttttgtcttcgtgataacggctccaatgccttttggctttgtaacgatgtgaaaacttgaactggttcacaatggccacgcttttgtcagaacagactatgttaaatgattaacaaaaaatgaaaacaatgggaaaactaagtaatgttctgtttaaacattttaaaattcctgtaccatttcctaaaaaacaacatattttcctgaaacgaatgtttttagaaaaaaaatatctattttcgagaaaaataaggttttcctaatggctaatagcattactcaaaaacaaatgttttttaaaaaactttttccgagaatttctattgaagtaatttaactatttctgtatgaccattccaagatgcaattataaaagctgtatcaaataaattaaataatttccaaatactattttgaaattccagaatatgaaaataaattctaaatataacaaataaatattttagaattaatatcaattcctatttgttcaagaagtaatttaacaatttctatatgaccgcttgaagatgcccaaataagtgctgtatcaaataatttaaataattttcaaatattattttgaaatgaaaaattattaaaataaataaactggagaaaataatacggcattccaatagattgaaaaataatgggaagatatgtaaacttctcaaaattgaaaactggattattgtcgatttagtttcaaaaatctctttttcattcaatttttattaataaattttttaatttttttccaatatttctgactgcttctttattacacatgtgtaccacacatttttgcatgaaattggatctctttcgtttatatgttaagaaatcaatttccattgatatccaatttttgttaccaattcatgatgcatcttgaagtgttttaatttctatatattctcttatttgattattaattacctgaggctttccacgttccgattcttttggaatttcatttgttgaggtaaactgtcgaattgtattatcaactcgatgagttccaacatgtagtatccctgctatttgtttttggctgaatccttgtttgtaaaggttaattatgttctcggcattgttcatgatttccctaataataaacggtctgtattcaaaaaattcatagagtttcctcaatgccgatttattttcacaagtttaataaataaaacaaatgaatatctttagcattaatatgaattccttcttgttcaagaagtaatttaactatttctatatgaccattttcagatgcacacataagtgctgtttcagataatttaaataatttccaaatattattttaaaatataaaattattaaaaaaaattttaaataaaacaaataaatatctttagcattaatatcaattccttcttgttcaagaagtaatttaactatttctatatgaccattttcagatgcacacataagtgctgtttcagataatttaaataatttccaaatattattttgaattaccaaattattaaaataaattctaaataaaacatataaatatctttaacattaatatcaattccttcttgttcaagaagtaatttaactatttctatatgaccatttttagatgcataaattagtgctgtttcaaataatttaaataatttccaaatattattttgaaacataaaattattaaaataaattctaaataaaacatataaatatctttaacattaatatcaattccttcttgttcaagaagtaatttaactatttctatatgaccattttcagatgcacacataagtgctgtttcagataatttaaataatttccaaatattattttaaaatataaaattattaaaaaaaattttaaataaaacaaataaatatttttagcattaatattaattcctttttgttcaagaagtaatttaactatttctgtatgaccatttgaagatgctttaataagtgctgtttcaaataatttaaataatttccaaatattattttgaaatataaaattattaaaataaatatcaaataaaacaaatgtgtatctttcgtattgatattaataactttttgttttaatatatatttaacaagttctatatttcctgattgtgaagaaaataccaaaatatcatttggaaaattattgttattaataaaatacttaacaagatataaattacctattcttgcagattcattaataatgctagcattaattttcattcctttcgtttcaagatatacaaaaatttcataattacaatacaaaatacattttttccctaattcttctaaattatttttttctataattttattttcataaatatatttaaagatatcattgcgatgaaattcaattgctgtttcatgtgcatcttcaaatgttgaatgattttgttcacataaatgaattatttcaagatttccacctgcaactgcatatttgccagtgttatttacatttgcaccattcataagtaaatacttaaaacatttaattgatttaaaaaatgctgcataatcaattaatgtaacatcttccccattaataaaatcacttctttcataaagtgatggttcaatgatttgattaatgtcaaaatcatttggtgatgatatttcttgaagtttatctacttcatcatttctaattattgttgcaatttcatttggactatgtccttcttcaatatatttttgatgaagttcccaatcgttttctgaaagttcttcataattattatagatttgtcctagataccgattaattttcagattcataggttcttcctctacaatataatgaataaaatatggaatttcaatattttcagttatattttttataattttagaatttaataaattttgtttaaataaatgataaaaaataattaaagtttcttttgaattttcattaagaagaaaatgcgaaaatacatcaagaaaattggatttaatgcttgcaaatttatttataaaacacaaatataaatcaagatcattcatattagcaatataagatgaatataacatttgactaataaataactgaaaagataacgaataagtatcatcaaatttgctcattaaccaatttactgttttttcaatagtttcttcttttaagcaaaaaaacatattactgatttgaagaaagtttataaactcatcttgaggtttctgctttatctccatattgacagttcttccgattatttttaaagaagacgtttatttcaaaccggggaaattaacgttcctgttctatcgttaatattaatttaaacgggtttaaatgaaaactcgtggtgaaaaaatcaccacaaatcccattgtatccgaaaggattgattctttccttagttccttacaacaaatcctagcctctgttacatctgatttgtttgtacagcaaatgtttgaagattctttatcgtcattatttattccagatcgagtttgtgaaatcataaaaattcatctaaatagtgataccaaaaaatttttagatactttaatgcaacgtttacaagcaattgaagcatgttttggtgaaaagaaatcacaatctcttgaatcaattggttataaaattctttcacttcaaaaagaaaaaagttcagatgatgcaatgaagatattaaggggacaaattatagaagtcttagatttaggaaatcataatgatcaaataaaaaaaatcaaaaccaaaacaaacaatttcaaatttgtacttaacaatttaaagcaacaaatagcacaattacatgaacaatatttagatgatacaaaaaaatctaaatcacaagttaaaacaaaactaaagaaattatttggtgaactttatgaatatcaacaaaatcaaatcgaatttcaaaatcaaatcctaaatagcacaaagaacaatgagttaaacagaatcaaaaaagattttgatgttgaacttgaaaagtattcaacacgcgagacatttcttcaagatgaaattgctaaattaaagaaagaaatcactaaacttaaacaagaaaattcacttaaatatgaagaaaattcgaaactaaaaaatcaattattaattattgatcaattaaaattagaaaagcagtcattagaaaatcataacgaatcacttcaaacgcaaatcgacatattaaagaatgaaaatagttccaaaagtaaacagataacaaatttattagatgaaaacaacaatttgtttaatcaaagttcgtcattacaaacatcactttcttcgttaaggaaaaaatatcaagaaaaagaaagagaaaatgtaaaattacaaaatataataaataaaaacgaatttgaaaaaaacgaattttcgaacataaaaaataaactcgaaattactataaatgaattaaaagaaaaagtattaaagttcgattcacttttaaacgaaaagaataaaatgaattcggagaacattatgttaaaacaaaaagttaaagaaatggaaatagacttaaaagatatgaaagaaaaatccgatttttatatgaatgaaataaatcattattcgaaatatgttactgagaacaaaaaattatcttttttatcagaacaaaacgtaaaagaaatcaaagaattaaattccgaaatagataatatgaaaacaaaaaatttaagtcttcaaaatcaaattcaacaaatgaaaaacgaaatcgaaaaatccgaatcattaaacaatgaaattacttataaacttaagaacacagaaaatttgttacaagaaacgcaaaaagaacttaaaaaaactattgaagaatcgaatgaaaaaataaatgaaacaaataaaacaattgatgaattaaataatatgaattttaatttgataaatgataataaagaattaaatgataaaatcgatgatataaacatcgaattaaataatacgaaacttaaactaaataaatataaaagttcatttcttaaagttaacgaagaaattaaaattaaaaatatatcaaatgaagatttgcaaaaaagtcaaagagttataataaaacaaaaagatcaaatgaataatgaaataaaattattaaaacataataatgaaaaattacaaatgaaaattaatgaaattgaaaatgaaaataaaaatttgatattaaaaattaaagaacatgaaaatcaagtaaaagaactatcgaattcaaccgaattattagcaaataaaattaaaaacattaacgaatccaagaaaaaaataaaaagtcaaaatgaaaaacttaaagaaatgataaagaacaaagaagaagaaattataaatttaaacgaatcaaacgatacattgaaattgaaactgaaatcaattcaatcagaagtaaatcattcaaaaggtagaatcaattcaattgaaacaacaaacaacgaattgatgaaacaaattgacaatataatgaaagaattaacacctattttccctgatatagaaacaattgaagaaattcctaaaaaattaattcaattaaacacacaaaatgaaagtataagaaatgaatttcaaatcgaaaaagatgaaaactttgttacttctgttaaaacaataaaaaatgaatttgatcaaatgaaacacattcaaaacgaaataatttctttattaaaaatgagttctaatgataattctgatgtaatttttcttgttaaaactttaaaagaaaattatgagaatttatataacgaaaaaaacgaaatattaaaacatttaaatactaaagaaccgataatcgaaactataaaaaatatagaaaaacaaattccaaatttatttataggaaattttgaagaaaagtttcatcaattattaacagaaagagaaaatttaattggagaaaagaataatatacaaaaaacacttaaatgtgatacaaatcaaattgttaatcaagttgaagaaatgtttaaatgtattaaagaacttcaaaacatattcgagacaaacgatttaataaatgtttctaaaagttataaagatttttatgtttcattacaaaacgaattaaaatgtaaatccagaaaagaaattatagaaactattaaacgaaataataaaaaccaaatcgaaacaaatgaattaatttcgaaaattttattaattttgtttaatatcaaaataataattatttcggatataacaaacgaaatgaaaaataaaataatcgaaacaataacaaattttaaatcaaaagctgataaagataataaaaacgtaatatctttaattaataaggctaagaattacggatatgttggcgattcattcgatgatgcatttgatttcattacgaattcaattgtcgaaatcgaacatcaaaaatcaatcgaaaatatgcatcaagaaatgtcgaaatttaaatccttacaagaaaaagaaagaaacatggtaatacaagaaaagaagaaattaagaaagaagattaaggatcaacttgatgaaatcgcaagtattaaagagttacaaattcaacaagaaaatgatttcttgttacaaagtgaaaaacttaagaatttaacaaaaaacacacaaaatgaatgcgaaatacaaaagaaaattagaaaagaattaataagattaataggaggaaaagtagtcgactttgattatctgaagttgaaattgtccccaaatgaatacatcgtggcgaagtcagcagatgtagcgaaaaaacatgacttaaataaaactttgtaatgtagtgtatatacttttttaaactgtttttatattatatactcgcattcttgatttaatacaagaaactgaaatggtttatcagtatcatcgcttatttaacagaaaaaaaattgtgttaaattattttaggaattgctttgttctaataaatatttatgtaggttgtgatacgtacgttacacaaaaaacaagaaatagagctaaatgaatgaagaatcatcggatttatatttcgcaggattaacggtcgataagaaaatgatcgggtttaattcaaaaatccactttttgatgaattggggtggtgtattatttggcaaaaattggctgtgaaaaaacgattttcaaaatgtgccagccggcaaaatcaaattttattaaccacaatttttaatgatgtccagcacgatgaaagatctacacgttaaacgtggtgtagaagatttcgtaattcataattttttgactgctgctaataagtgcaatgcaattcttcaacatatccaagaaaatggaacaagagtcccatttgaaattgaaaacacatattcatctgagtctgtctccatttttgttcagtttcttaatggagaaaatattccttttgaatttgatcaacaacttaataatgaactttttgatcttgccaaaaaataccagtgcccatctcttcttagaaatcttgccacaaattgctcacgtacagttgaacttcttctatctgaaattgaaaatggtcttgataccactctaacagaaaacaatttaattaccttcatttctcttggtgatttcgacaatttagaattattaagttcaaaagtacttagtcgcatcattagcaaaggtattgaaaaccaacaaataattcttcctgcgctcatatttttcattcaatatgcatctgcacataatatccttgatgcgaactatgataaaatccttggaaacattgaatttactaaggaatctatccaacaattaacagattctcctgatttcaactgtcctccgagaattaaacttgtttcacttgtgaatagtattgaagaactacttataaatttcaagagtattttacctggacgtgaaatcaaatcagaaatttgcgatcaaatttgtactgatttaactttagcacaagcaatgctttttaattctctaaatgaaattgtcaacgccagaaatgaagatagaaatggtgcaaatcaaaatagtaaccaaaatagaaaccaaaatagtaatcaaaataatggaaatcaaaatagtaaccaaaatcgtaatcaaaataataatgatgcttcaccaaacgcagggtgtggtataagaagatatgtggaacataataattaaggtttaatttttttcaaaaaaaaattaataaaatttccattttcttctactttattgttctttttcaaatgaatttggctcttcaataaattgatgacgaccacatttttacttctgttataggtttgatatctttgtgtaagttgttatttttgcgtgtttttgattttgtacgtttaaatatatacgttaaaaaatggaagatgagaacaaaggaactgaggaaagttcttcattttcacagacagaaaaacaattaaatgaaatacaaaatgaaattcttcggcaaggaaaagatgtagaaaaatttattattgaacattcaaaaattcatcaaaatcctgcaattaaatcattacaaatattgtttgaattatttaagtcggaattatctattaatctttcttttagaaaagctttaatgaatgataaagccctcattcaacaattaaaagatatcataaataagaaaaataaagaaattccaactgttttaacacaactatctgacgaactaaacataagaattgaaaaaatttcagatattaccaaaatatttcaagaaatccaaaatgaaaatcaattattaaaattcaaacttactcaaatgacacaagaaaaagaagacataaatgctcaatccataattgaaatagccaagcataactctcgagctgaattggcagaaacacaaaatcaagattatcaaaatcaactttatgaacttaaatccaaatatactaaacttattaaatttaatgaagaacttcaaagcaatatattacttttgaaaaagaaactttcaaatcaccatcaaatcaaaaaagaaaataaagaacttaaagaacaaatcaatagacacaaacatgaaacagaatcttccaataaacaaattcaagaacttaaatcaaaacttaaagcacaaaaacggaatcaaaagcgtattttaacagaaatacaaaataacattactaaccaacaaacacaaaacactatttataaaacggatcaaaagaccaaagatattgaaacaaaattttcaaacgcattagatgaaaacaatcgattattaaaaaagttacaacaatcatccaaagatatttcaagacttgaagaagaaaatgcaaagttaatgtcaacattggaaagatacaaacatttaagtagttcggtaatgtatgattcagatgtgtcaacaccaacaaaagtcaaaagttcgtcattttattcatcagaagatatatcaggaatgtcaaattcttcttatatattaagaccattaatgttggcaacgattgcatgcaatagattaatatcaaagaataagaattcgtcaactaatgtgtctgatagttcattcgacgtaaagaaagaacttgtgtcactgaagagggaaatagtatcacttcagagtgagcttgctaaatgattaattgttgtaaataaattgttatcatatattaaaatttataaattataattcgattatattattgattcttaatttccaattgctaaaaaaaaatacactgaaaatcatttatgccataaacatttctaattttattagattacggaatttactgaatgaaaaagaaaaaataagttcatatttcaatgattaatacaaaatatattttatttataattattatttaaatcaaatcatttattctttctataatttcttgtaatgtatttgttgatccgaacattcttctatattccccgctgagcatcatttctattaatcttgtaacccttgttttatttaactttaaaatactgccttttgcaaatccgatatcactatcaccaaactgatcgaaataaacaggtccaaaattataatgttctctaccaaaatcgcaatccaccaattgaacagttgatgccatattgccagttaacatcaaaaatggtgtaactgtcatttctgtacatttcatacagtgatctattgtatcatccaaacctatttgatttataagtccaaaacttttataacaaatttttccacaaaacaaacatttcgcaagtgtcactttttcggttttcaaatattttcctaaattttcattataaaagaaatcaacaaaattctcacataatgtagtaaactcaaacttcacacatggcgataaaaatgctatatctgtgatttctgcttttgaatcttcgatcattttttggaaaggcatcagctcgtacttttctgtaaactcctcaactgaaggtattgaaattgtatcgttcgggtttgatgccatttgatgtaataactcaacgcgtcttataaacacttcgaataatgacttatgtatatctttatcatgaggagctactgacatagccaatatcttccaatatttcttaatcattttttgaaatatttcttcattatcacttaaatttgcactattaaagaaatcaatagcaaataaagcaaaaggatcattagtatctgaaacattattatctttaacaatgaaagcgattctaatcaaatgtattaaagcaagaatcatttttttatcatcgatacatttaggttcagttctatttaatacttcaagtaaagcaatattatatgcaactgtttgagcaatagaaactccacataatgaaataatttcactagaaattctttctatttcttgttcaatttgtgtatttaaattttcgaacacaggtattatagtattacaagtagttctatccattggacattgttttatactttcatttaatgccaaaagatatacaacgttttcattaccggagttaaaacatttaatatgagcccaatgaccacaagtttgaactctacaagtaatcggataacgtggaatggaatcatgtgcaatgatttgttcgattttcgaaaggattcctgttcgatatattgtagaaataataccataaggctcttcattatcattaaatgattcactacaaaaagcgcaagtaaatgaattaggtgaagcagaatcgaaagttgctaattcattagaatttgcatctgcaaaagcatttaattgtttttggaacttggctaaaatcgctgagcgatctattcgcttaggctttggcttattcgattcatcaatttcgatttttgattttacataattcgaaatcattgaagaaacttcagatgattcattcacgaaattatttaacaatttaatgccattttctaatgataaaatattcgaaattaacaaatcggtgattttcataagtttattttcggtttcattgggaaaagtatataatattaatcgatataatgcgaaaatagtacgttttaatgtatatgaagtttttgaaggatttgcgtttaataatttttccattaatttaattaatactttggacttaaggaaatctctgattctattcattggatcaggtaataattccaatttaggaatcgttaataacttttctttatgttcattaattttattatagaaattacttgatgaaatatataaaaatacatttgcctcatttaagcattcaggttttaataccaatttaatacctttatctatttgttgagggtcagctacttccaaaaatgtttcgtcgagagtatcattatcgactttaaacttatttaactcaataattaattgttctcttgtattaacaccggaatatatatattgaattatcgcttttcgtaatgattccttcttgaaatgataaccagagaacgttgtgtcgcacgcaatgattattaagaaccgacataacaatgtcattaaatttgtccatttctcacattcgactaaatcagttgctgtatttttatcccaataattaataccaaattcttcagcaattattgaaattattttatttgtatcttcacaacattgtaaacatatttgtatcgttgttatatattcgtaatgatattcgaagtcttttgcgatgtctgtaattgattcatcatttgaagcgaagaagttattttggattaaacaattgcctgaaacagaagacattacatatgctgttaattcatcaatatcattaaacccaattcgtttcaggagataattcggatcaatgttattatgtaatgagaaacatattaacgtattaatactaaagtcaataagtggatcagagatagggaaaaattcgttataaggatttaatattatcaaattttgtttgaatatttcagatgacatttcattgatattttcgattcgaagttttattgccttagaaaataattcttcgaatattttgtcaatgattttgaaattattttcattcaaatttaaactcgattcataatagatggctttggggaacgtttggtcctttggaaattcagtagaaattaacgatatgcattgtgaaatgattggtattaactcatagacacataaatagatgaagttccgtttataataattatccgtttgatagagctcatgttcaccttctttacgtttgattacgttcacaatttgtctcattgaaatgaatttaattatttctgtaatggcagttgaattcacgtcgttaagtgctctcaaaaaaattatcggatactcaaaaagtttctcgatgtcaacgaacaactgccagatgaaatttggggtgcccgaaaaatggaatgtaacttcagaattatcattaacgatggagtaatgtgagatgtaattatacagcaatttaaatgaatgaccaatgatttgatgcttcttttctgactcgagaatattctttttgtatgaaatacattgcgatgaaagtccaattgcttctgtaaatatattacttagcgatgtgtagttaagtagaaatggttcgtagaaatctaaaagagatgtaaagttggaaatatatccgtcgacaaatttcttggaagtaataacagaataacacatcgaattaaattgctgtatcaaatcgtcatcaattggatcgatgtttttcaaaatcttaaaaaaatttggcggatttccttcaaataaaatttgcgaaatgatttctaaataaaatgtaccccattgaaacgtataactcaaaactttgtaaatcctgtggaagttttgcggctctttgcactcgttcgatgataacaattcgaaaattcgacttatcgccgctttgaagttgacgagataactctcggacacttccgccggctcaagcggcgttcggtgtttttcgcaccaattttcgcgatttattgcgtttggatcaccgcaatcacatactgccaaattgccgtaaaaaatcgttaccttatggccaatgtgttcgtctttgtcaaagcaataaaggcaatatattgagcgatctgttttacaacaatttttgcaatggaaatatatgggacacatatcttgaccatttactgtacaccttgaaaactgtgcatttgatacttgataattattaaattctttaaatgatgaaaaatctggatctgttaataattgtttgatttccttttttgcttcatccattttaagagcgactttttcaataaataatttgtcaaagaaatgttaggtgaaaaatgaaaaaaaaatttctaaaaaactgagtttttagaattttctgttgcacattgtgcatttaccgcagataatgttgtgctttcctgtggtctcgcattctggctttccgcaagcagtgcattttccgcagatgaagttgacgcatcttcccttggcgacgcattcaagttttccacaaacggtacacttaccgcagcagaagttttggcatccctttacgtcacattccttctttccacagaacttgcattgatgcatgaagaactcgtggttgcaaactggttcaggtggcttaggaggctcaggcttgggttctgggtgatgatgtggtggaggtgggcctggtgggggtgggaaaggaaatcctggttgtggatagcctggttgtgggtatcctggttgttgtggataacctggctgttgtggatatcctggttgttgtggatagcctggttgtgggtatcctggttgttgtggataacctggttgttgtggataacctggttgttgtggataacctggttgttgaggatatcctggttgttgtgggtatcctggttgctgtggatagcctggttgtgggtatcctggctgctgtggataacctggctgctgaggatagcctggttgttgtggataacctggttgacctgggtacattaaaagtgaagtgatttgaggtttgataaaaatattgaacggttgcaaccgttgcctcatttttcaggggttaaggaaattttcgataattcaagggcaaaaattccgttttttgcactttttatgaatatgtttcaaaaatttttgaataattatttgaattttgagataaaccgaaaatataattgatcgaattgtaggtgatatcaccaaaattttactcctttttttccttgtttgaaatgcatgatgtaaatattgttttaatatttcatcttcagttatcaaacaaattatatatttcgatttagaaattgaatttttcaaaattaattaatacaaattttatccaaacatctcaaataaatgtttaatcttctataaaaaaattgttcgactggagcacattaaaaaaatattaatcataaaaattaagaaataaaaataacaataattttttatatcaaagaaaatacttttgcacgtagcgcccttcgatagcttaccctataaatcttattaaaatagagattcgaagcaagaaaaaaatactttgaacttttaagttaaaagtatgttgaaattagacctgactcatcacgagttgctgttggttcatcgattgatatttttccttcttcataagtatcgtatttcttcaatgcattaataacagcatcagtaccaaagtaaggatgtttcaatacaccctcttccatgttatgtcctaaagttattgcaggtattccatttaatcttacaataggttttccttccagaaccaaattgtaccaataattaacggtttctaccttttgatcgttaaccgttattgggaatacccattttccttcaatttgaatagggtgatagggcgaaaggagcaccccattcacatcaacgcaatttgatgttccaacacctttaatcttcatttcgattaaacattggacaattcctccgtcttcaagtatgtcacctttcttgaggtcttttacaagctttttagcaccatctttaaggctaacattagcttcgccattgaaacaaccagcgctagcattataaaatcgtgtcattgtcctcctattaaattgagttgtgccttggctccgatcacgactaatttctcttcctttaggtggtggtaaattcaagaagattttatttgcgacttttctgatttctttaaatttctctccttcataaaactttaatgtttcatctttgaagttaccacattgttgtacaatatggaaacgtaagaaagaacggatataatctttgccccatttctcatagaatttcttttggaaggactttgatatttgtccatgattatcatcatcattaatcaaatcaactaaaagagcatcaagaaaaacggaacgattttgaattgcatcaacttcactatagaagttttgaacatcggtaagagcttcattaagatcagctctagtgttctttatatatttagaaattaattgtatcaaatagtagcgatatgtttgatctctaatctcttctttttctttattagaattagcttcatgaatatcatcaacaccaaaactttggcttgtcgttggaatcgttacattaatttctaagtctgaaattgcatctttcggaatactaattacaacatttgtgggcattccattatacaaactaatctcgtgctttccttggtacttagagcctttgatttccactgtaccaattggagaaagtgttgttaaaagatttgacatataattaattaatatcgttccaaccattgtacagtcaggacaatatccataaattccattgccaagtttggcaatgttttccattaaaacggaatcaattgagtatccgaatgaaaatgatgaaattgtaaatttacgatttggtatatctgaaagttcttcagtcaatgttggtattattcccattggtggattgacattaggttctccatcagtgaatagaagaattgatatattgtattcttctccatcgaactttttggcattttgaatacccaatcttagggcatcccaaatgttggtgcaccccttagtgtaaagtgatttgactgcgttacccgcaagtgacttccctgcggccgttgtttttgtcggttgtaacacaactgatgcctggtcatcaaaagcaatgagagtaatgtaatcatcatccccaagaagcgctaaaatggtatttaatgcgtgttgtactaattgaagtcgtgataaaaataagtcttccattccagctacattttgacacgaattaccggacattgatccagaaacatcaattaatgctataagcgatgttggctttcgtgcttcgacttgatttggttgaagaacaacttgaaatatattattatttctattctttggatcttctgtgtaattggcatataatttgtcaaacgtaatttcattgattttggctgtcgatattggtacttcaggaatggattcatcattatcgtcatcggccgtttttggtgcttgttcagaaagatatttgtcgataagactctttagtgcatagtttgtcttggcatcggacatactcatcggttgacgcgttaatggggaaactggattaacagataatgccttttcaatttgttctctttcatacgtttgaccatcaggcataatgacggggtccttcatgatctccaaggagattggacagaggaattcgttcggaatgttgtctgtcatctttgtgaagtgaagaagaatttgcaaccgctcaattagaatcattcaaaattttgtgggatgtgaacacgaattttcactcaaaaagttctcttactgcacaaatagtagcgactgaaatgttacgtgaaaaatatttattttcaattggattttcgcctttaaactgttcttcagtgactttttgaattaaatgttttgccactttctgtttgttgatgagttaaagctgttttcaacaatagaaattatttctaggaatgaatcagattcgatttttttagaacaacacatgtaaatgcgatgagaggaagtgcaaacataatgtatttttattttataatttggtttcgataccaataatttatcaaataaaatcttcaataaaattcaaattcagtatactgaatatactatgattaaagtgttaatgttgttttaataattttatatatttattaatattaatattaatataggaattgttttaataacttgaaacagtattccatgttgcagttagatataataatatagaaatattcaaaatgctcttaatgaatgaaggaattgatgttaatgtaaaatctatttttacaataatgcaagatgtccaacaatatggttcagcatgaatttacatcatgatagccaaatgataattctaacccagtcttttcaacaataaataacaaatattcaaatacaagaaatagaaatgaagcaatcttaaaaaatagtccttaccgattcaaattttgcatatcataaaataatgtaaagtcaaaattcgacggaaatactgaaacatatgaaacttattaaaatcacataattttttcgttcaatgcacctaacatgattataacgtgacccaagaaaaattccaattagaaatttgttataaatgtttaacacattttaatttttaataacataaatgataattactggaacttctttgatattttgctttgatttatgaatactacaagtgttatttttcaagatgccttgttcaagttcatcaaatgattcacatagtttgttcatgtttcattatttcttggtgatgatgattcagaatgtttatctgttgacttttaaaatcacgctgtaaaatgttttgagcatgtgaacaatatcttttgtataacttgtatttcggacagttcgtggggatttttaagatattattgtagatctttatcatctgcaaattcttaaacgatatatacgtcatctttttttgattaaaaaatagtcaatgtatattatgacattggggtgactcattttggaaagtaatttggctttgtgctaggcagattcttcatgtggaatgctttacaaacaagttctttcttgaagttgaggttgtttacacaaaccataataaatataatagtaacgaggctcttcgatattgtattgcataaagatatcttaatagtgattaacagtaaaagcatagttgaacatgttcatacacaaaaatctgtattgtagtttgctacctaattttttactggtgtccactacccaatattatctgttacacacgagcaccaacattcatatacattttcatccatagcacgttacttcccagtgcacattagcgtttccttcgatgaattctaaagtttattcaacgaatccaatttcaaatatgacaactttcaatttatttatatagtcaaaaagcccattcactcgttcacgagctccaagtcgagtctgcttcttccgtgcatgttcattggtgttacgtttactcttacacgcaccgtatcgaatatccttatcactctctcctccgagcagaggcattcctcgtcctcgttgaatcgccacttgtctccatcgacgtgtatatgtccgtcgacgccgtacttctctatgagcaccacgaacaccgtcggctttatccttatcacctttccttcctccactttgcccggcgtcttcctgagcagctccatcatgaacagctgcgcggagtctcttccggcctcctgcgccatccggtgtcgatagttcaaattctcagcgatcccttcaacaaattgtttcgaagacaattcgttcgatacgttttcatatccgcacgcaatcgctaattggcggtgcactatcagatcggagtaccttcgaatcggcgatgtgaaatgtgtgtaaattggcatcgcgagaccgaagtggcggaagttatcataactttgcgtaccagatgcaaaatacttcgcaaattgcatgcaacgtgtcgtcatgattcgtacgatttcgtcaagtgacttctccttctcaccaacgttatccaaagtctccgtaagcgttttgttcgattcgggatcaatgtgcaaatggaatcgcttcaaagcgcgattcagaaagtcaaaccgagcagctaatggtggctcatgtcttcgcaacatcgccgactgagggaaaacttgataaatgcgcttcgcaacttcaatgttcgcatataacataaactcttcgacaagcgaattgacttccaaatgttcatacaattcgccccgtaatggttcatgagtttcagagtctaatacaaagtgtaactgcggtgatgacaacttaagtgcgccggcatcaaatcgcttttgcttcattatacgtgataaatataataattgtcgaatgccttcagctatttcactatgatcattctcatcttcgacaagttgttgggccttttgatatgacattgagtcgcgatttaagataatcgtgcgaccaaaccagatgtctttggtttcggctgtccgcttatctaaaatcgcaactacggagaacgcaaagcgctcaatgccgcccatcagtgaacataagttctcactgagcaaacttggcaacatgttaatgcgcttctcggtgagatatactgtggtgcctcgttctcgtgcttctaaatcaatggctgtgccctctcgaacaaaataagaaacatcggcaatgtgaatgccaacttcacattcggtatcggaaatatctttgaaatgtaatgcatcatcaatatcaacacaacctggtggatcaatggaaacaacacaacgatctctaaggtctcgtctattgctaatttcttcttctgttggttgataatctgcaggtggtaaacattcgataactgctggtgggaaactattatgtggaatttgatgtgtaagaaggataacttcactctcggtttggatatcgcctgatgtaccaattgtagcaatataatgtccatttggatatcgtgagtttttagcccaaccatcaatggctacttggacacggcatcctagaagctggttaactatacgggtacgtatgcgaatctttggtaacgatggctcatgtggtacaacgagaacgttttgccaatcgttggtaaccgtcggcggttgttgtatcgttccgcaaatgatgcggcttgcaggcttcatgatggcgataactttgcctgtagggaacttagtgtcaccaacaacaagaaatttctcttccggaaggagttggactgcgaccatgtcaccttcaattgctctgttttgatttaatttattttgaattattatctctccattcttttgagtacgaacagtagcttcttctcgagaaaattgtgagagagaaaatgtccctacaaatgcattaccttgatctactaatttatgaacttcaagagcagataaatgatcttcatattgaatctcatctgcattgatggcatcgggcgctgtaagacgattggctaatgactcattgttgtctgcccaatgatgtattgtatcaattgtaaatggagttgaatcacctgaaattaatttcatttcttcataatctttttctgtgtttgttaaataaataattggaaatatggatgataagaattcaagtgctttaagtattaataattgatgatgttcttgtgtagtcattgattctgtttgttctacatatgttttcttataatgttcatttgcaaaaacagaaaaatgcttttctggagtacgaattagacgatcaagtctatttatagttgctcttgatttagttcgaactgtttcatatattgtctgtaaaaataaaatatttttcatattgtcatcttgaagagcatccatttgatttagaatagtttctgaagaaagaacaagaacatattctgcatctggagttgtaaaaggattttctgaaaaatttggaagtcgacaatcaatatcttctcgaagatagtgctcacgtgatagacgtattacatttcctcggcgagtgtgtaacaactgcgttttatgtgttagcatcttgaacacctctacgaatttctgataaatcgaacaaagcctctcaatctgatcgaaaagtgccaatggctcttcctattataaataaacaatacaatctaaaaaagtgcattaaatttacaaacaattttattcattaagaaccaaaaaattttcgttgatttccattaaaacttaatcttaaacttgaatcatttcttcttcttattggtatatcttgatctttatttggattttccatttttttctttttttctattgaattttgtttatccaattccattttctttagataattatttaatgcttctggtgcattatcgactgcattcatttggatcggtcttatgtctaagaaatatccaattgttgatttcccaacgattttatgcaaattttgtatttctattgcaatatttttcatagcgaaagaaagtgatttttgttcattcttcataaagttaatacgttttatacttctattgaggtcattttttcttttttcgatttcatttcgtaatttcgcatttaagttattaattatttcaagtgattgttccatttcatcaccagcagatttccaattaaatataaatgaatcgatttcatttgattctaaatataatcgatttgattgatgttgaataaacttaattttccatctgcgaaaactttggcggattatgaatcgttcattttttagtttcgatctttctaatatgaatttatatggttcttttcgtactttttcttttgtcgtataataataccatgcacgaaaagatttacgtagacgctttcgaagtgaatcgatataaccttcgaacatttgcgaaattcgttcttttctttcgaaaataactcttttatattccaaaaaacaatttcttaaaaatattttctcatgttttcttatgaattcatttactttctttcgtttatcacataaatatttccatgattgaatcacatttttcattaaagtaaaattatcatgataaagaattttatacttattctgtggtcgcttccatcgtttgaagccaccaaagactataatacgtccaacacttaatgaataccatgcatcgaaaaaatttcgttttcgacgatttatccaaaatgagcgcgcaattgcattcgctcgtttagaagcatctttacatcgtttaacatatattatccatgttttaaatataaaattttttaaatgattttcatgattcttattcccaatttcaattataacatttcgtttctcaatttttaaaagctctaaaagagaattatcagactcattaaaatcactattcgaagtcttttctacaacacgtttttgcgcttcttcacttatcatttgatgtaaacggaaaagtgcctttcgcgaatgcttcgaaaaactgatgtatttccatttccggagaaatactttgcaatgttgatcaagccaacttcgttgcattaataggacatcatgtttgattttgttggtggcttcatgtgattcaattgaccaatcacgccaatgtttaagtgcattacgactttgatttacaaagtgtcgattaagaagaacacgaaaatgatcatcacgctttgaatacgcaagaaaaaatccaagaagtgattcatgaattgcagaacaatcacgtcgtatggtgttatgaacagcattaagaataacattataatgttgcttgctggaaaaggatctgaatttggattgaatagtaacagcatgtttatctaaattatcagtggaaaactcttcgatttcacgctgaatgtcataaagacgaccatgaatacgattgaatgtaatgtttatggctttaggaacttgaagtgcataattcatggtatttacaataaatttagtatcatcttcgatttctttaagtggtgtagaaagagataagatattttggtgaattttttttgcttgaagatatcgaactgaattattttcttcggttttttctggaatttcgcttgatactccagggttttgaaaatgaatttttcttgtagtttgttgctttggagggcgattagggtagagcgtttctaatgggactaatctatgctttgtattctttcttttcattcgttccaaaaaacgaataaaaaaataacgttcgcttctttcgctaattacgatagtaactgttacgatagtgatttttaacagtcactttttaacaattgtgttgtctttttttcatttgttgtgcatatattaataaattctggaggcaatgaaagtgttttcgccatatttgtttaaaattcaaaaacactttaagtgtaattatataattaaacatatttttaaattatgataaagatacaattaattactatgttataaatcaaaatgaaacaataacgtcctgtgacgttaattatattttcccaatcagtttataaaagatacaaatacaaaatcacgaaagagcatttttaaattgtatttaaggattacattctttagaacacatacttccacaatataaatccaacacaacaaataagtaaaatcaccaaaaacacatccatacaacatcccgcctttgttcccagtgcatcttttgtatgttccaatcttttgtttgcatcgtccaaattttcttgcgttttatccatttgcttatcgacgtcgtcagtcatgacagtcaaaacttgatactcgtcgtgcattgtctgcgcaagatgcttcaaaaattcggtaccttcgagaacttgatcaattttctcatcaatcgcttgttcattttcattgatttgaagctgccattcatcaatgccatcgatttcctcgagttcggtctgtgttggatcttgtggaacaaatgtgactaattcgggattaagattagctgaaaaattagcacctttaagaagtgcggctttcatgggatcgttcttttggctgacaaatgaaagccctttgaaccaacgctcgcattcttcgatatgagcatcaattaaatcacacatcttatatcgattttcaatgttagggcattctttacctttcttagagtatttggcttcttctttgataaccatatcacgaatagctttggcttcttccttaacattttgaagttttgttctaattagtgtggactgccgaacaatttcaggtttatcatctttagtaccacgtgcattggcgtagcgatctctttcagctatatcgtttctaagctctctaatttgaagatttatttctcgcttctttaaagtaaatttatcaacttttttgttgtttttgccttggctttctggcgtatctttgttacctgttgcttttccaatttcttctacgcggcgtaaaagtttttccatttagttgttttttagaggtttttcactgcctttacttgaattccggttgtgacatgttaactgaaaatatgtagtttcttgtttttatgaataaattttaaattattatgggttttaattgctttaactcacgtaaaaaattcgttattaatcagaatttcatttttggaaatggatttgatggagaaattatttcaaaattaatataacacattcatgttttccttcaacctagagatatcttaaaaagagaattgcaatcaaaaaagtatgcatacatattttatgataaaagtgaaatccaacacaaacatatatgacgaaaagttatttagttatgtgaacttcataccaaaaatcataccaatgaaatattggccaatttccattcattttaatctttttttttatttattaattttacaagaataaattggaataaagttattgaacaacacaagcttcttgtcttttctgcattttttgacgtctacttttttgttcttttgatggcttatctttgttttgatcttttggtgggttatcttctttcttacttgaaaatgctaaaagaacgatttggtccaaaagttcttttgtcccttctcctgtaagcaaatttgtttcaaaataatgcattccgtacatttttgctttttcttcaccttcttctcgtgaaaccacaggtggctctgaacgaaaagaattagctactaaaattttgacacattcatttgacataaaaggagaaagctcttggagtcggtgatccaattccataaatttgtctttttcatgaatttcataaacaaaaaggataactttatatttagaatgagcaactttaatggtaaatccaacggaacaaattgcttgttcaaggccgttggtatcccaaaaatcaagcactattgattgattatgaaaattataattaattttgatcagtttattggcaattgttgtttcagaaggtttgcgtgggtcaccagtaagataataagcaagccctgttttccctgtggaaatagatccagtaatgatgatacttaccgaggcttcttcagtttccatagtttgtaaaaacaacaaattgtttcgttctcaattttctgtgggatttttttgttgaaaagaaaacggttttataaaataacaaaagaaagggtaccagatctatcgttccgtggggaccgacaggctcaacaacccatgtaaactatacaaaacataacgataggggcttaagtatctttacgcattcaatctaatagaaatataaaaattttgaccgagctcatcaacttctaaaaatcgactatcgttaaagcttaccaacccaccaatgatcggcacgcgttcaattttgtatcgtttagttttaactaagtttgtcgccatatatgaacaatgacgatcatttccatgaacattactgaagaaaaatacaacaaaaaatatcaaaataaatgggaaactattaagtcaatgaaagatataatttttaatttagacaaagataatgtagttcaagcagcaaatacaatatttaatgaattttacgaagaacatcagttatcatttttatttgttgttagtcaaataatatattcaatatttatcatacgattgactgattttgatatatatttgaactttctaaaggaaattgataaattagaagtcgataaaaaaagcaaattaagaataattgatatttttgcaaattttcttattcacaaatttacacatgaagcgttttatcttcttaaaaaaatgattgaatatgattttattgaaacaaatattgttaaaaaaatagaaacattttatttcattcatttatcagagaaaagcatcgatgaaatatattccattaatttttttgatgaaatcgaaaataatcttgataaccttaaaaaaaatgattgggaactacacaaaaaattaattgaagaaggagtaaatccaaataaaattgcgaaaataattcaaaatgatgaaatagaaaaacttcaagaaatatcatcgcaaccaaattttgattttgatcaaaaaattgaaccatcactttatgaaagatgttcatttataaataaagaaaatgttgcattaattgattatgcagcatttttttcagcagttaaatgttttaaatatttacttatgaacaatgcaaatgtagaaaatacaggtaaatatgcagttgcaggtggaaatgatgaaatcattcatttatgtgaacaaaaccattcatcatttgaaggtgcatatgaagtagcaatcaaatatcataaaaacaatatatttaaatatatttttgaaaataaaattaataatattgatgatttagaaaaattcggagtaaaatgtcttctacatcataattatgaattatttacttttttacttggagaaggaatgaaaattagcaattcaattattaatgaattggctaaaattggaaatatatttcttgttaaatatttccttaaagaaaatcaacttccggaagatttattggttttctcatctaaatcaggaaatattgaacttgttaaatatattttagatcaagaaggaattgatattaatgctaaagatatttatttattttattttgtgtttattttaataatttattatttcaaaataatatttggaaattattttaattatttgaaacagcacttattggggcatctgaaaaaggtcatacagaaattgttaaattacttcttatgcaaaaaaatattgatattaatgctaaaaatatttatttgttttattttgtgtttattttaataatttattattttaaaataatatttggaaattatttaaattatttaaaacagcacttatgtatgcatctgaaaatgattatacagaaatagttaaattacttcttaaacaagaaggaattgatatcaatgctaaagacatttatttgttttatttaatatttattttaataattttttgtttcaaaataatatttggaaattattttaaatatttaatacagcacttattggggcatctgataaaggtcacatagaaatagttaaattacttcttgaacaagaaggaattgatattagtgctaaagatatttatttgttttatttattatttattttaataatttggaaattcaaaataatatttggaaattatttgaaatattttatacagcacttatgagtgcatcttataaaggtcatatagaaatagttaaattacttatgaatgcgaaaaatttttcgttatgaaaccaaaattaatataaatgtatttttataaaatttattcactttaaattattctagagtggttccgactctcggagatgtcccttcagaaaatttgtaattactttttcaagtatatacacttaaaatattaaaaaaaatttatagtaaaaattattcgtctagattcggattattcgagtatatgacttttatttatataaattaaatatttcgaaatttgatcgaaaaattatttcataattttttgatgatttatacatattaatatgcacaataatattgctaagtatgctattaggttttttctaaaataaatattattgattttgagaaaaagtacatttattatacaaatttacacgccgaaagatcatcaagactctaaaaactcacctttttttttctgttaaaaattctatataagaatttacataaactatattttattagtttgaaatatttatggatttcttctgctgaatttcgagaaaaagtagtatttcgcacgacggtttaaaaaccgtaatttatcattcaaatattttacggttataaactttttgtatggaaaataatcgttgatagaagaaaacatgttttatatgcatattctagcaactttttctcaaaactcagcagaagaatcttaataaaactttgatataatttcaatcaaatcataattataatcatatttgaaaatgaataggaaaaaaagggtcaattcttttatatttatgatttaaataatgtgttttttgttgaaaaataaatacattgtcacttttcattaatggaaaaacaaagagaagctaaaaaacaaaacagatcaaaagaatccacattgcaaaaatacattcaacaagtttatcagtcaataataatgttaatattatataaaatattcaagttaatcaaaatattctaacaagatcaaatattggaacaagtccaaaaaagcaaactcatgtaaaaaacatacttccatatcttaatgaaattgttgaaaatgtatatagtagtccaaaagggagaaggtggactgtaggtttactaattttatgttcaataatttatttttattctccatcgtcctattcgattttcaaagagcaaatgccccttccagcaatttcaacactttataaaatactaagttctgaaattttgaataacaatgaacttttgttaaatgaatctaaattacctgatatattgataatttatgaagagaaatttaaatataataattctatgccaaaagagaaggccattattgctgttgatgctgttagtgtaacaaaatgttcaaaaattctcaaaaattagacagtttcaggtatgtttaaaatttttaatgttacccacgaggaacttaatactatccgaaactcttatcaaaaatttgaacaattgataataaataacaccaaaaattctatatattctgcatttgtttctcaacttcagtcaattaaccattcaaatccttgaattttaattcatgtaattccttcaaattgtagtaaagccaatacagatatcaccaaaaaattagataaattaaaaattattattgaaaatcatactaatttcagtataattggatatgctgctgatggtgataattcttatcggcactttttaagaaaacaagttttgtatgaaaaaaataattcattgatattatttttttcaaattatttacacttattgaaaaaaggagatattggtttttaaagcatttaaatcaatatacaccagatatcaatcaattcaaaaatgatttttgcaataacgatcacatttctgtcaaaagtagatgtaaatatatgaaacttgaattgatgtattataaacaattgacttatatttatgataataatttgatgattgatacataaggcactataattagcttatcgaaattattaaaattcgagcaaggtaacatttctttaaatagacttagctcaaatcctttagaacattcttttggtgttttaagaatgaatgctcgaaatcatgattttatatgtaaatttattaatgacattaaaagggttaacttcatcaggttacacaaaagtaagtacattaaaacagtgatcagacacagaattaatgattttgaataaattatcgaacttgatggcactttttatgatgaaaatttgaatggtttatcaaattcaatcgtaaggtttatatatttaaatgtggaggatccactttttgaatccatcatggatgaaattagggaaatttttggaaaagaacaaaataataataatgatactatattcagcacaaaagacattacgttgaatccgtcttctcaatctaatatacgagaaagacaagaaatggatcaatctggaagaaaatattgtgcttggacaaaaagatttaaacagcgactttgatgatgatatcaatagattaatgaaatattttcctgatcactctttagagtcaataaaagagaaaataacgggaatgaacgttaagtaaaattcttaactttacttttcatttttttgtaagaattattagtcggaaccacgctatcatacagtgtttccaaaaacgataggtcagtggagtaaatgtaaaattttttttctatcgaaaaaaaataactttttgagaaacggtgatttattttatttagaatagttttttattcattcaatttcaatatccatttggggcaccctcattttcaactacctttcgaagacgatcatccattgaattatagagttttgaatcgttgaaacttcaatgttattccaaacatcaaaaacaatttgtttcaacgtttccagatcattcggttcgacctgttcaaccctgtctttcataatggcccacaaattttcgatagggttgaggtcaggggaattggcaggccaattcttcaatatattgcatttctcctccaagtaattattcgttaaactgcttgtatgtattgatgcgccattctgcatcaaaacccaatttttctcaccatatatttcattcattcccgtaattagctgagatctttgaatacaatccgaaacatatcgctgagcattaattgttcctgttaacgcaattaaaggtgtatgatagttataagaaatacctccaaataccatgattttttgagggtatttcttttgtggagaatatatgcattggtcaatctctcctcttcttcttcaaagaagccaccttctatttggcccgagaataaagagtgattcgtcagtaaacaatacagatttccaatctgtattgtttaagagatgatgattacaaaatgatactcgagcttgtttttccttttcagacaataggaatgtttttctcggcggaagataattaaaatggttgtcgtgtagtatattggctactaaacttttacttattggtgaaccattttcagtcacatttttcgcaatcctacaaagtccagcccttctatcttctgtgactaatctgattacttcttcttcaagctatttagttcgtttcgctggtgcaccaattttgtttttgaataaaaacatattatcaccttgttcgagttgcatttttactttacgaattaaatcacgtccatggccagtcaattggcgtatttgagaaatgttttttccatcatataaatgatgaatgatttccattctggcattgaccatggacatcggcatatgattcattgtggtcacgccataaccgtcatatcgactgacctatcgtttttggaaacactgtactctaagatttattcaaaaagttgtaaatatataatttgaatggaaaaatatggcgatttattttgaaataaatactcagtaacacaaatatatttgagaacttttagtaattcatattcaaaaaatggaaacgataacacagaaaaaaattacactttttgatgatgattcatttttatataatattagtcctatttccatcataaccgcaaaattatatcataatcaaaaaataagtaaagacaaaaatgattgcagtaatgataagctataattcatcaaaagcatcttgaaaaatgattatttttatatattcttttataattttttttaaaaaatattatcacaggtaatatataacttctgtttcctcactaacataaatcgatccactcaacgaaactgtattacttgttgttgtagaaacagtcatttccttttgtgtatatgagaattgcttatttgtagcagaattcgaatacgttttcattgtgttaattactgtgctcgaacgagtggattggactgcgtatgtaaatgttgtacttggatcagtgcatacatctctgaagccgacgttgtcatatccttcagcacctgaaaataattttgataaataaaattgtaagtatataaaatttatttctcacaataatttttgggaactaacttaatagttatagaaaaaatataaattatatatatatatatatatatatatataatttaaatatatatagtgtaagcttatatacttattttgcatggattgcattttttgattaagagatattttaattttgtcaaaatctaaaaaaaaataaacgtaattgtcacccgttctttatcttcaagaggttatacagaaatcgttaaattacttcttgaacaagaaggaattgatattaatgttaaaaatatttatttgttttatttaaaatttattttaataattttaaattaaaataatatttggatattattttttttatttaatgaggcacttatgatagcatctaaaaatggtcatacagaaatggtttaataacttcttaaacaagaaggaatttaattccatatgactaagtgaggaaaatgattgttcaatatttaaacctatattaggattaacagtaaaatatctaatgaatccattttattcactatattttcctttcgttttacttttggttgcaatatgtgccttgatacgttattaaaatgaagtgatcgcataaatgtcaaaacttctgatttttttaccgctaatataatatttaaattttattggtataaaatgacatctatgaaatccagtttttgaatatgatggaaaatgtcactcaataagggattttccgcatgagcgactgggaaacacttctatcaataagtcaagcaatttttggtttgaatgaagaaaattcctcgaaatctttaggtttaataatcaacaaatttgatgaaatccatcctgtatcttctgatttaattattattcaaatgatatattattcatttgtaattaaaaacaatgatgtagatttattttttaatattataaaagaaataagaaaatttgaagagagcaataaaatcaaatccaatatatttgatatatttgggcgatttcttaataataagcatacacatgaatcatattatcttcttgaatcgatgattgaacataattttcttgaaccaaacattgtaaaaaacaaccatgatgtttattttgcgcattatatgtctaaagataaattagcaatccttttaagggaatataattttgtaaatcatgaagaactttcaaagaatgattgggaacttcataagaaattaattagcgaaggaaataatccaaataaaattacaaaaataattcgaaaagatgaaatcgaaaaacttcaagaaatatcatcacaaacaaactttaattttaaacaaacaattaaaccatcactttatgaaagatgttctttagttaataattatgcttcattaattgattttgcagcattttttggctcaattgaatgttttaaatatttacttatgaatggtgcaaatgtaaataacacaggtaaatatgcagttgcaggtggaaatcttgaaataattcatttatgtgaacaaaatcattcaacatttgaagatgcacatgaaacagcaattgaatttcatcgcaatgatatctttaaatatatttatgaaaataaattaaaagaaattaataatttagaagaattaggaagacattgtattttatatcataattatgaaatattttcatttttacttaaagaaggaatgaaaatcaatgatgatattattaatgaagcagcaattattggaaatatttttttagttgaatattttcttaaagatcattcaattccacatgatattttgatattatcatctggatcaggaaatattgaacttgttgaatacgttttaaagcaagaaggaattgatattaatgctaaagatatttatttcttttattaggtatttattttaataatttattattttaataaaatctttggaaattatttcaaatttttaaaacagcacttatgattgcatctgaaaagggatataaagaaatggttaaattacttcttgaacaagaaggaattgatattaatgttaaaaatatttatttcttttatttgaaatttattttaataattttatgtttcaaaatagtatttggaaattatttaaattatttgaaacagcacttatgtatgcatctgaaaaaggtagaacagaaatagttcaattacttcttgaacaagaaggaattgacattaatgctaaagatatttatttgttttatttaatattggtatcaataatttattattttgaaataatatttgaaaattatttcaaatattcaaaacagcacttatatggacatctgaaaatggtcatacagaaatagttaaattacttctagaacaagaaggaattgatattaatgctaaaaatatttatttcttttatttaatatttattttaacaaccttatatttcaaaataatatttggtaattattttaagtattttggacagcacttatgtgggcatttttaaatggtcagacagaaatagttaaattacttcttgaacaaaaaaatattgatattaatgctaaagatattgatttgttttgtttaatatttattttaataatttattattttaaaataatatttggaaattacttaaattatttcatacagcacttattagagcatcgttaattggtaaaacaaaaatagttaaattgcttcttgaacaagaaggaattgatattaatgctaaagatatttatttgttttacttaaaatttatttttataattttgtatgtcaaaataatatttggaaattatttaaattatttgaaacagcacttatgtatgcatctgaaagaggtcatgcagaaatcgttaaattacttcttgagcaagaaggaattgatattaacactaaaggtatttatttgttttatttgatatttattttaataatttggtaattcaaaataatatttggaaattatttaaattattttatacagcacttattaaagcatcttcaaatggtcatacagaaatagttaaattacttcttgaacaagaaggaattgatattaatgctaaaagtatttatttgttttacttaaaatttatttttataattttgtatgtcaaaataatatttggaaattatttaaattatttgaaacagcacttattaaagcatctgaaaatggtagaacagaaatagttaaattacttcttgaacaagaaggaattgatattaatgctaaagacatttatttgttttatttaaaatttattttaataatttgatattttaaaataatatttggaaattatttaaattatttgaaacagcacttatatttgcatctgaaaaaggtagaacagaaatagttcaattacttcttgaacaagaaggaattgatattaatgctaaaaatatttatttgttttacttaaaatttatttttataattttttatttcaaaataatatttggaaattatttaaattatctgaaacagcacttatgtgtgcatctgaaaatggtcatacagaaatagttaaattacttcttgaacaagaaggaatttacattaatgctaaagatatttatttgttttacttaaaatttatttttataattttgtatgtcaaaataatatttggaaattatttaaattatttgaaacagcacttattaaagcatctgaaaatggtagaacagaaatagttaaattacttcttgaacaagaaggaattgatattaatgctaaagacatttatttgttttatttaaaatttattttaataatttgatattttaaaataatatttggaaattatttaaattatttgaaacagcacttatatttgcatctgaaaaaggtagaacagaaatagttcaattacttcttgaacaagaaggaattgatattaatgctaaagacatttatttgttttatttaaaatttattttaataattttatatttcaaaataatatttggaaattatttaaattatccaaaacagcacttatatttgcatctgaaaatggtcatacagaaattgttaaattacttgaacaaaaagatattgatattaatgccaaaattgtctaatatgttgtatttgaatatcaaaccaaccctttcttggattaagagataatagggtttataaaatattgaaactgtttatttgctgttaagcattcataaaaattaacattaactaaaaaataatttttgttataattttaatattatctatactttatgaattaataatctttcatatgaattaccaaatgaacttataagtatttaaagcaaaatacaaaggaacgtatttcaatgttgtaaaaacaatgagtggtgacaccaccaattgttattactaataatcgattggttcatataccgacacaacccatactttttgttagctacatgtgcatgaattataccatgtattaattaccccacaattatcaaggaaaatctgatggacaatattgagatataaaaaaaggtgaattggacttcttcattccattaacggtcacacaagatttacggttttataccaaaatgcaagcaaagctgtgagtacaattaatcattagtgttcttttatgctttaatatattcatttcacgaactaccaaaacttttactatcattttgattctttcttcattctggaaaacgttcttaaataattacgtttttactccaaaaactttacaaaaataaatttttattgtattctaaatcacttctttcttttgtttccattataaagttcttgatattttagctttttctttattataattttcaaaatgcatatttttttcagttttcaaataaatattttaaaccaattccaaaaattatttttaaacataaaattaaataaataaaccataaattatatcaacgaatattcgtagtagtggtgtcaattccatcttgttcaagaagtaatttcaccatttcagtacaaccattttcaatagcaatcataagtggtgaccaaaattatttaaatatattaaaaacataactttgaaactctaaatcattaaaatgaatccaaaacaaaactaaaaaatattatgatgatttatatcaatacctttttgttcaagaagtaatttaaatatacctgtacgaccaaattcagcagcgaaaataagtgaattattcaattttttaaacaaatttcaataattaatataaaaccgaaaattattataatgaaaatcaaacaaaacaaaaaaatatcttgagcattaacatcaacaccttctttcttaagaagcattttaaccacttctataaaaccatttttagatgcaacaataagtggtgtttcaaataaattaaataatttccgaatattatttggaaattgaaagttattgaaataaacttcaaataacacaaataaatatttcgagcgttaacatcaacaccttgatcaagaagtaatttaattactttcatattgcctgattctaaagagtatactaataatatattatttggtatttgattgttttgaataaaatgtttaacaagatataaatttccaattcttgctgattcgttaacaatatcatcattaatattcataccattttcttgaaggaacaaaaatattttataattaaaagatgtaatacatttctttcctaattcttccaaatttttaatttcaatgattttattctcataaagatatttaaagatatctttttgatgcaatttaattgctatttcatatcctttttcaaacgttgaatgattttgttcacataaatgcattatctctaagtttccaccagcaactgcatattttcctgtattttggacatttgcgccattaagtaattaaaatttaaagcatttaactgatccgaagaatgcagcaaaatcaattaatgtaacattcttttgattaataaatgaatacctttcataagctgatggttcaatattttgattaaaattaaattcgttttgcgttgatttttcttgaagtttttcaatctcatcatatcgtattattttcgctaattcatcaggaattaattccttcttcaatggtgacatctttttgcatatggccagcagcgaggatccattcctcatcagttggaaggcgatatgagtgagaattatcttgtgatgcaagccaatcacaataagctaatgcatcaggaatggactactggatagttatctaatccttgttcatagctaaagtccgatttaaatgctgcatattcggcattcgtaacaggcgcatatgatatgtatgcattagcagttgatgagccacgtaagactaaccatgagtcattaggatcatcatctgatcaatcaatcttaggaattgtttctccaatcgaatctcacgattttcaaccatttcatctacaatagcttgcatttctgcaatgacgtcatatgttttggcttcgcgctctaactctcggagcttggctttctttcgtgcaactttgtccttacgattatatatacagtataatcctttttcttccaaaaattctaaaatttcattattattttttttaatacaaaaatttaaaaaatcattggttttatctttagatgttcgaaattttttttttgaatttattctcgtaaatattatttaaagatatcatttctgtttaattctattgcagcttcatatgtatctttaaagaatgaatgattttgttcacacaaatgaataatctctaagttaccacctgcaactgcatatttacctgcattaaatatatttgcttcaattataagtaaatttaaaacatttaactattgaaaaaaagctggataatcaattaatgaaacattttctttattaacaaaagagcatctttcgtaaagtgatagttcattgaaatcaaagtttgcttttgatgatatctcttaaagtttctcgattcatcaattgcattattttcgcaatttctttttctttcatttgaagttcttttaaaaaatataagtaattttcaaatacgtgctttcgtgacgaaaatgaattataaactatcttacttataatggtattaaatgtatcgggaaaacatgaatcaaaaaatttagatacttttatagcagaaacctggtagttttcctctgtcaaactgaatatgctttctcaagttcatttaggaattccaagcatgttgactgtttattcaaatttttatctcctgtgtttatggtagtaaattcatttggcatgcgctttggtgaaatcatataattatacaaaatgaattccggtccaataaactacataaaattaagaactccttcacgaaaggaaattttacaatcataggcgctcatcaataaaaacagagcattttccagaaagtaacaaaatacacaaaatatgaatgaaaggcagcttcatggtgttgctaagttaagttttcaaattgaaaatgaaaaaattaactatcaaataaatattgatggtaaaaagatgcaaaacagagcagtttttgaaacaaaaaattgaaattgtgtataagtgaacgcaatagtttagagattaagttaaaaaaatttcattgaataacacaaatttcgtgtttcttcaaagctttttccttgtttgcaaatgctaaaagaacgatttgatctaaaagttctttagtcccttctcctgtaagcaaatttgtttcaaaataatgcattccatacaattttgctttttcttctccttcttctcttgaaaccaagggaaagccatatgaacgaatagaatttgcaactaaaattttgacccacctttttgaaatatcatgagaatatatttgaaatcgagtatccaattccttgaaagaagttatattacatacatcataagtaagaatgatagccttacattggttctgcatcaaagacctaagtgtattctttatttcaaagccattcgtgtccaaaataaaaacccttatttgttgaccgtgaaaattataatcaacagggatccaatcagagctaattgttccatgtttaggtttttgaggttttccaataagataactagcaagcccagattttcctgtcaaaaaagctccattaatgattacataaactgttgtttcattatcacttgtttccattctttgttaaaatatatgttttggttcaattttaaatttattcctttttgctgatgattccgaccaaatactaattgaaaattagataggtttacaaaagcctttcacaaaactgacttgcaatcttgcaccatcctatatagcaaaacaatgattcttggtttgctaaaagaaaatgattgtttaaaatgcattaaatttataaaattcaattttcatctaaaaactgcaaataatattggaaatttaatgacatgatatattaattccaacatatgaattctaaattgttaagtagtgatactgaaaaatatctattttggtaaaaaagacgttaaatcggcacttttttacatgtaaatggaaaactagttttcccgaaatttacgaggaatcgtatttccagggcataacggtcgtttccattgaattattgtatagtttatgctttcaaattctttattttttttcgataagtgactctttacgccaagtgaaattaaattaataaaattgaataaaataagtgccgttttgtatcatataaaattaaattaaaaaattgaatgcaataattgtcgttttgcattgatcaaaattgaataaaaaaatcgaataataaaaaattcaattttatgaattatcgtgtatatctaagattgaaagaattttattgtcgtaacatgtgaactttgtttgtgtgaatgaaatcaaatatatatttcgaatattgatataaatgcagcaaaaaatcctctctctaaatcttaaagagtaatagcgtgattacgaatccattgtaatttaagattatctgtatatgatataggagattcaaataattgttttgtgatatcaattttggcggggataatattattggcggtttttccaattttcggcgggcttttaccactgatgcgaccgtttatgacgaccgttatgttctggaaatacgattcctagaaatttcatagcgaaattaaaattgttttcattttgcatcctcaataaattcataataacaaccataagaccattgtaattcgttgttaaaaatggacaaaaaaagcaatgatcttaaataaaatgataataattaatttatgaaagctaatattggtatcccgcataataagttacacttgtacagttaaatcttaaaatgagattttttctaatgaaaatttttactcatgctttaagagcaaatttaactggtttaagatatttcgcacggcgggcagctctcttagtaagtttgttggcatatttagctggaagaatctttcgttgagcttttacttgttttttgcgaatatcctttggaatcaatttcttgccctgatatttttcgttaagtgctttgcgttgttgttccattaagactgtcttaacgcgagcaacatcgcgacgtacattcagaatttctgatagcttttggcgtgatgatgatgttgctatttgtccacgaagttcgaaaagcttcttttctaatgttgcaagttcttcaagaagatcagcacgtgatttttggatgagttcgtgagccttaagatgtcccatttgaaaaggtcgaccaatcgtcactttttgactttgtatatataacgatagaatattggagtaccccgtaattgtgaataccgataaatatctttcgatatttgaatgatttatacgtatcgaatcgcacgttaattcggttggcacttggacggttaactttttgtcactttatctttcaaatgaagcattcaatatatgaaaaattcatggatattgtgactccatacatgaaagttcagcacacatcaacactcctcaaggatggcaaattaaccccagaagaatttgttgttgcaggcgattcacttatttctgtttgtcctaattggagctggtcatcagcagaaccttcaaagtgtgttgattaccttccaaagggaaagcaatttttgataaatagaagagttatttgtcaatctcgtgctgctgatttcagcaaagtaatggctgttgaaacagaactcccagacttagatggttgggttcaatctggtgaagcagctaaggaagaagtcgttgatcttgacgatgatgaagttattgatcttgatgaactcgatgttgattcaatcgagccagatgaaccagcagctgaacctactgttgactttagaacctacgatgtctcaatcgtttacgataagtattacagtgttcctcatgtgttcttgtttggagttgattcgaaaggccaacaattaaaactcgaagatatgtatcaagacattagtgctgaccatgcagagaagactgttacatacgaaaagcacccattttatgatatgaaatgtttatctattcatccatgtcgccatgccagtgtgatgattggattaattgagagatcagaacatcctgaaaccttctgtgctccattatatttcttcaccttccttaaatttattcatactgttatcccaacaattgacataagcacgccaaccattgaaattaacagtgagtaaaaatcaaacagttaaaaccaaatcgatctctttttccaacaacaacaaaaaagaaacatcactagaattgactaagtttgtttgccataaaattatttttgatttcaaaaaagaagtttttattgctgaaataaattgcattcaagaatttatttcttttgctgcttgatcagttccattattttggcaatagaatcacttaattttggaactttgtctgcgccaaatttcgatataagccttccaggaacgacgtaagaagcgctatttcccattttctttgactcttcttgggaaatacaaacctcattgatgttgattgaaggatccacaatatctttatatgcacgaatgacatctccattacttgcagttccctcacaaacccaatttacgtgtccgacttcatggtctcggatcatatcaagcgcaagaggaacgagatcgttcaagacggtcattgatgatttgattgaattgatcttactaaatccaaggagctttccgataagagaagcggaagtgatgttgtcgttgaatggaaaaagtgcccttaagttaagaacatgtttgattgctcctgtttcgttaagaatttcttcgagacaatttctcatttggtaatagaaattacataagttgttaggcttatcagattcagtaaatccgactccgttttcgagtgtatgtgtttcatcataatgataaaatccacatgtcccaatgatggtgaggtgtaagccaagtttaccacatatctgggcaatggcgagttggcctgtaacattggcatcgattgtctcgatgcgatggtcattgcaccacctcgtgttggggcgggtcccaacccccgccgatataataaccgaaaccgatgggtgaatgtgaaggagttcgttttggattgcttcgtgttgatgaagtcggcttcgaagacggcaccatgtgtaaccacgagcctcgatttcgcgtacgaaagatgaaccaatgagtccattagcacccattattgcaaacattggacgtggtgttggaagagattggcgtggatcggcaactaagagactttcctttgtggtgtcacgggtagttttcattatttcataaatggtcttttcttcatttgtggaaacaacaaggcttactccagggtgtaacataaggacttcacctacattaagttctaaagtttgttttaagttgggatcattcgaatcaataagttgaacatttagttttccttgtaccaaatacaaaaattcatcgttgtggcttttaaaagttcttggttgtccttcttttttggggtaatagcattttattgaagatactgagcatgaagaatttagttttagaatgtgaaatgcttcataaagaaatccacgagagtctgggaaaacaggggagcgaatcaattcagcaccagaaatttcaagcttttcttttgtaaattgtttgataatggtcggtttaagctccattttatgattgaataactatgttcgcctggctaaaaatcgcacgtttattttgattaatgcaaaaagtggcattttaacaatgaagtttcattcttttcactatacaataaagttaaaaataaaatcaaaacagttatgtgataatgtttcaaatatcttgaaattaatttgatattcattttgaggaagttataacttcaacacaatgatgttatcatacatatggaaatctttcattcctgatttaaacaaaaaatcaaaattattacaatctaaaatttctctctattttttttattcattaatgaaaccacttattaaaccatatacaaaacatttcatatagttgtttgatttcaaaaaaaaaaaaaaaatcatatatatatatatatatatatatatatatatatatatatatatatatatatatatatatatatatcataattattatcgcattaatcttggttttattttttctgtaatctgataatattaactcatgaaggtagttattcattaatgaaaataaaaatatattaaattattaacaaaataattcatattgttcatattatatgatatggttgtataaacacatacggttctaagatatctaaaaacttcttcataagaaattttatccgcgaactcttgtttttaaaatggaatgatttctttttgtttgaaaagagaacagagcaaaaaatagtaaaacaaaatcaaaatttttgaaaaaaatcgaaaattaacggatccgtttattcgtgtaacttttgtaaaatggaaattaaactataaaaaatttatgtatgatctttgtaatgttgtttccatcaattttttgccgaagtttttcttacaatgcactttgtaatattattgaatttcaacttttgttctatttcatcatttcgaattattttagcaatttcatatggattaactccttctttaattaattgtttatgaagttcccaatcattctttgaaagttcttcatcatgatctccaaagtatctttcttttggatcacacccattaaatgccacacatgtttgggtttggttttctttttttgctttataatgaaaaaaaaatatttcgatttaatatttttagtgatatttttatcaattaaattgtgttcaatcactttctcgattaaataatatgattcttgtgtgtttgtagtagacataaattttatctgaatgcataagcttcataatatcaagaattaaaaatatccaaagtgaagagtaaaaatcaaatttttgttctcaaaaacaatcatcttcaaagcattcaataaattgaaatagctcagaaaagtattcaaacgtacgaatattttgcatgctttacatgccgataaaataatgatatcacatcaaacttaaagccaccaccaagttcgaagcatcatctaaaagtattctctgtagccattggcccatcaaataactgttgaattcacgtttcccactgttttgttaatccaatcacaattctgataacttgtaacatttaattcaatttgagaatttaatttatttctcattgaattttcagatatctgaaattcaaaagcgaaacttttaacctgtcaattttattcataaagttaagaaatttgtgaattgaattccatcgtgccgatgtaaccgctagtgacttcacttttataaatggccagtcttcgcaaagacgcagagcaatatctcgcagtcgaaaccaacccagaatacatcgacaaaatcaagaaaatcctcgacaacgaagaagagttgaaaaaatactttggaaatcgtccagtttttggcactgccggtattcgtggacgcatggatgcaggctacaactgcttaaacccaggaatcatcctccaaacagcccaaggttactgcgattatgcaattaagacacttggcttagagacaatgcaacaacgtggtattgttgttggttatgatgcacgccacggatcccgtagctatgctgaaactacagccaacgttttcttaatgaaaggaatcaaagtgtatctcttctcaacaattatcccaacaccatatgttgccttttcaatcgtcaagctccatgccgccggtggtgttatggttaccgcaagtcataacccagcaacagacaatggttacaaagtttactgggacaatggtgctcaaatcatcgaaccacatgacaaaggaattgctgacgccatccaacaaaacctttctaaatgggaaggatatgatgtttcactcttcgccaagtccccactttgtgtcgatccattagatgatatccgtgaagcttataacaacatgattttcgagaagttgtgcttccaccatgaagaaaactcaaagccttcaggtctcttaatcacatacacagctatgcatggtgttggtcataagccaacattatgggctttcaagaagttcggtcttccacttccaatcccagttccagagcaagtcgaaggtgatggcaacttcccaacatcagattttccaaatccagaagaaggtgagaaagtattccgtcttgcaatgcgcacagccgatgcacacaactcagatttgatcatttgccaagatcctgatgcagatcgtgtcggtcttgctgtccgtcaaaaggatggctcatggcgcatccttcatggaaaccatacaggtgcacttcttacatggtggttcatggaacattacaaaggcgatcactccaaagctaaattcttctcatcaactgtatcaacacgcttccaaaaggttatggctgagaaggaaggattcttacatgaagaaacacttaccggtttcaagtggcttggaaatgcagcacttaaggctaaggctgaaggtcttacaccattgttagcattcgaagaagctattggattcgaatcaatcccaggagaagtcccagacaaagatgccatctcaacagcagcagttgtagcagaaatggcacatcatttaatgcgcactgaaaagaagtcacttactgataagttggatgatatctatgctaagtatggattcttcttattcaacaatagctacttcatttgtcacgaccaaaagattatcgctgatctcttccaaagaatgagaacttctggcccagatggaaagcatttgatgaagattggcgaatttaaagtcgatagaattagagatatgactcttggctatgactcagcaactgcagaccataagactgtacttcctaaacaaggaggtaacatgatcactttctacttagaaaatggctgcgtagctacaatccgtacttctggaactgaaccaaagattaaatggtacattgaaatcggagctgaaaataaggaaaaggctgagcatgaccttaacgaagtagttacagcagttcaagacgacctcctccaacgtgagaagtataactttaagcaaactgagtaaacaaattactaactcatcaaacgtttgatgtggcggttttttgttctgaaattgagagaattcgtttgacaccagaatatgaaaacgttaactctttcccactccacagtactgtacgcactgataatgttgttattgtttggcttgaaatcaattctacattggaaatattaaataaataaataaataatttgaactgaacttggtgtggatgacactttcgctcgtttttttgaaataaacgtcttctttaaaaataatcggaagaactgtcaatatggagataaagcagaaacctcaagatgagtttataaactttcttcaaatcagtaatatgttttttttgcttaaaagaagaaactattgaaaaaacagtaaattggttaatgagcaaatttgatgatacttattcgttatcttttcagttatttattagtcaaatgttatattcatcttatattgctaatatgaatgatcttgatttatatttgtgttttataaataaatttgcaagcattaaatccaattttcttgatgtattttcgcattttcttcttaatgaaaattcaaaagaaactttaattattttttatcatttatttaaacaaaatttattaaattctaaaattataaaaaatataactgaaaatattgaaattccatattttattcattatattgtagaggaagaacctatgaatctgaaaattaatcggtatctaggacaaatctataataattatgaagaactttcagaaaacgattgggaacttcatcaaaaatatattgaagaaggacatagtccaaatgaaattgcaacaataattagaaatgatgaagtagataaacttcaagaaatatcatcaccaaatgattttgacattaatcaaatcattgaaccatcactttatgaaagaagtgattttattaatggggaagatgttacattaattgattatgcagcattttttaaatcaattaaatgttttaagtatttacttatgaatggtgcaaatgtaaataacactggcaaatatgcagttgcaggtggaaatcttgaaataattcatttatgtgaacaaaatcattcaacatttgaagatgcacatgaaacagcaattgaatttcatcgcaatgatatctttaaatatatttatgaaaataaaattatagaaaaaaataatttagaagaattagggaaaaaaatgtatttttgtattgtaattatgaaatttttgtatatcttgaaacgaaaggaatgaaaattaatgctagcattattaatgaatctgcaagaataggtaatttatatcttgttaagtattttattaataacaataattttccaaatgatattttggtattttcttcacaatcaggaaatatagaacttgttaaatatatattaaaacaaaaagttattaatatcaatacgaaagatacacatttgttttatttgatatttattttaataattttatatttcaaaataatatttggaaattatttaaattatttgaaacagcacttattaaagcatcttcaaatggtcatacagaaatagttaaattacttcttgaacaaaaaggaattaatattaatgctaaaaatatttatttgttttatttaaaattttttttaataattttatattttaaaataatatttggaaattatttaaattatctgaaacagcacttatgaaagcatctgaaaatggtcatatagaaatagttaaattacttcttgatcataaagaaatcgatattaatgctaaagatatttatatgttttatttaatatttattttaataattttatatttcaaaataatatttggaaattatttaaattatttgaaacagcacttatatttgcatctaaaaatggtagaacagaaatagttcaattacttcttgaacaagaaggaattgacattaatgctaaagatatttatttgttttatttaatattggtatcaataatttattatttcaaaataatatttgaaaattatttcaaatattcaaaacagcacttatatggacatctgaaaatggtcatacagaaatagttaaattacttctagaacaagaaggaattgacattaatgctaaagatatttatttgttttatttaatatttattttaataatttgatattttaaaataatatttgaaaattatttaaattatttaatactgcacttattttagcatctttaaaaggtcatataaaaatagttaaattacttctagaacaagaaggaattgatattaatgctaaagatatttatttgttttatttaaaatttattttaataattttttgtttcaaaataatatttggaaattatttaaattatttaatacagcacttatattagcatctgaaaatggtcgtacagaaatcgttaaattacttcttgaacaaaaaggaattgatattaatgctaaagacatttatttgttttatttgatatttattttaataattttttgtttcaaaataatatttggaaattatttaaattattttatacagcacttatatgggcatcttcaaatggtcgtacagaaatagttaaattacttcttgagcaagaaggaattgatattaatgctaaaaatatttatttgttttattttggatttattttaataatttggtaattcaaaataatatttggaaattatttaaattatttaaaacagcacttattaaagcatctgaaaaaggttatacagaaatagttaaattacttcaatataaattctcgaaaaaagtttttaaaaaacatttgtttttgagaaatgctattagccattaggaaaaccttattttcgaaaatagatattttttttctaaaaacatttgttttaggaaaatatgttgttttttaggaaatggtgaaggaattttaaaatgtttaaacaaaacattaatgttgtaatgtttttttttttaaatgttttggtatgaaaacataagggtttttcgcgaattctatagttttttaaaaaagctataatttttttggaaagactaccgtttgcaatatatatttccttttctgaaaatatttctttcccgaatacataaattcttatgcttgaattgcttttcaatattcaaaatataaattacatgaaaatctttgtgagaaaaatgctgaatataccaaattactaataacaacagaaacaaaaaagtaaattaacgttgagtatattcattgtttaaagtcactttttaatactccgattaaaaatatcactagaggttttaaacaaagaacaaatgattctcaagatgcaattgatgctcaactgcgatgccaagttttacgttttcaagaagagggaaaaaatttaagtcaatcatttaatttacattcatccaaatacaagcaattatcgaaagaaaacgaaaaattaaaaaaagaaattcagtctttacatttcaaaactgagcttttgcatactatagaaaataattgctttttagaaatgcatgtcgattctcttccaacaaagagataaaacaaaaaagctatacctgattacatttgtatgtctaatatggggcagtcgttatggatgtcaatggagtgcaatttgggattcctatgttggacaaacattaaaaaaaaacataataaccttgcgaagcttggtgtcacacaaactcattcccaaaaatccgaaagatttgatgacttttgaaaggaattcaatagtttattcttagtgatttttaggttgagtaaactcgttaaaaagtcaaaataaagcattaaattatagtgttttcttttataaatttcgaactaggtgtgttgtattaatggtctattaatgctttggaatgagcgtccgaataagaactttcagcaaactacaaattttggtgatgtatggttgacaaaaaaaaaaattgatatttttcgaactgaaaacaaagtacttttgccgtgtactctccttccttgtttcaaggctatgtcaatgtgctacagtcagtgcaatgcataatgtgcagcaacggtaggtatataatgcggtcgggaatgatcacgaggaccctaggggccccgcccccggcggggcccctagggtcctcgtgatcattcccgaccttaagttttcactggggggatttccggggtcttcggcctccggaggtgcccttcggacccctccggaggcctcagacccctccaatcccccgagtgtgcccttcggacccctccggaggcctcagacccctccaatcccccgagtgtgctcgctccgctcgcaacaaaaatcaaaatgatttttgtgagccatacaattcgtctgaaaatttgaatgtgcattcaattttgagagaacgcgaaactttttgataggaacgatagcacttttagcaccacttttcgcataaacctatcaaaaacctcacataaccaacacgaattgtcctcggttatctttggtcggacatttattttattcaatttatctttgccaggaggttaatagtcaaaaaacgacgaatatttttgaatgcatggcaaactttatttcgaataataaataactgttataaattatcacttcatttttttcttcatgtatgcgaatattttttccattgctcaaattgcagacaatatcaaaaataaggatcttgatgctattgatgttgcaatattctttgatcctaaatataataaaatgggaaatcacaacaattttattatcaatccaattgggatgataataaaacatagtaattcttccgatttttattttattcaaagagaaataatagaattctttgacaacccgatactaatatcaattccaattactgaaaataagaaactatatataaatcaaaatgttcattatttagaaatagacttatttccattgaaatgtaaatttggacgatggtatgcgtcatatatctatgagtcatataatgatgaaattaatcgtacattattagataatgtaatcgttaatagtcaacataaagacaaaactcatcaatctgcttttgatttaaagcaggatcttttcaagagtgcctaaaaaataaaaaaatgattttaattttttttatttattttgattttata

SEQ ID NO: 25 - DNA, 519561 bp, Histomonas meleagridis
  misc_feature: contig_94_att
ttcaaaaaaattaatatattcatatcttacaataaaatgtgattcggacatgaatttatttttatattcttattacgataattcattaaacacattacgaaattaattaatttttgtcattttccttttgtgttaaatccttcaaaaaatgctcattttctccgtttcgttgagggttaacttttaggttagaattaaccctcaaaattttaatggtactttttgataaaaataaacatattcataaagcatcatcatcaacttcatcatcaactatttgttcttctaatttcttatgatatttttcaaatctttcatgaacttctggcaataaattatatactttagatacttttccatcaatcctttttgcagaagcatttccagtgaattttttcatatttgcaataaaagtccttgaactgcaactgttgaatttatttttttcaacaaaatcacaatataaattaaataaatcaggacctgttatgtttttgattttttcgtaattgtctctagcgaatatttcataacttgacattgaagcttcttttatatttttctttttgctttactgttcggaattcttcttaaatttactttcgacacatcccttaacataaagaatgtaaataaattttcataaaattcaggcgtgaatattttcgctaaatttgcaaaatatttgaaatcttgtaaatgcttatcacttgtttttgttacaacatatcttctatcataactttcaatctttattggaacatcattatttgataccattataaaattagcaacattttctgtttctctcatcggttcatttttttgaattatatttattgttttatctgttataatagattttaatgcatcagaatttaaaaatttatttgtatcaatactttgtagttcatttaaaaccagtaattttttgttttttaatgttgcattaaatttaccgactactgattctatattcgtaacattttcatttgcgtatcttgccattaatttgcaaattacatctgtaaagaatgtattttttcctgttccttgatttcctaatataactaaagcaactccagttttgaaatttggtttttgaagaatgctcgcgacccaaattaaaatatatctataaatttcttcattaccatttgctattacttctctgacgtgatctaaaaatggttgtataatttctgtttttactttatcaagctttttataatcataacctctaaagtaagaaaaaatttgaggatcatttgaataaaattttaatgcttttaccgtaaatatttctgtattttctaaatataaatcccaagcggaaacgttttttgttttatttccttcggtccttcttccaataattattttctttagcttttgtttcgcaacgttttctgatgtataacttactttaacataatcattcactgcgtcataatctttaaacataaatacttcaggtgttgaatcacatactaaaaaacatttttttaaatcatttattgcttcatctccgtttaaattatagtttttattttttctaatgtccattaaacagaatttgtcgtttatgtcgattgtaacttctgacatctttttagttgcattaaaaaatcaaattactactttaaaactagacttaatttataacctgtaacgtaacgtaaccttgatttttgtatctcatgttctttattcttcttcttttttccaaaatgtcaaagttacaggtaacgttacgttacaagttatagttagatttttcgcacatgcttattttaaactcgaccgttaatcctaattttcaatcatcctctatcgttaatgctttcttttatgtagcgcggcttgaagcgagcgtatcacgcgaagcttcaatagcgctgtgtgtgtgtgtgttaagatttctattggattaaggtcgggcgagtttggaggccatcctggcgcaattagaacatcattgcataaccaattaattgtgtgagttgtattatggaatggagccccatcttgcataaaaaaccatttaaaacgtccgtatttcagatcacatgttggtatcagttgacttcttttcaagattttgatgtactcatatgaatcgacgttttatccttgcccagctgttatctggactcttttcagaacgagattcatcagaaaagatgatattctcgaactgggattttttgtcaaaataaaagctttgtctgcggacaacagttgagaacgatatctttgttgaaaacttttcgtttagagatgatgttatatctccatcagttagtctggcatttgcatatggttgagttacgatgtaatcaatcatttaccaagttaaagctgatggacgaccaatattatgattcatttggaatttttttttaactttagatattttttcggagcaaacatataagaaatcttgtatttcttcataagtaaaatgagaagcaagcattctagatataaattcatctttctgcttctgaaattaagtactgttcattctacaattttgacatttttcggatttaaatgagtttattgttcttctgagttctgatttccagtttatatggtggaaggggaattgaattaattttttttatcggtcaaaaattgagttactttcgatccattatatgaattttaaaattccgacatttttttttgtcgcataaatattcgattttgcgaaaatgccactttttaattggaaaaaatgacgtgttcaaaatggtaacgcttgtaaaacatacaaaatgccaataattcagaagtttattttttcatttttcttgttttgaattcaagccctcctactcccaccaaaatatctgaacttcttcaggcagctaaaaagaaacttaatatggaggatgccatgacaaagttagaacacgagttccgactaaatcaatttgataagcttacaaatgaaaatatgggaaaaattttaactcaaaaagtatactatgttttaatttattatttatatcaatctatttttactcaatccccatttccacatactgtcaaaacattaatcgaaaaagaaaccaaacttttccaaaacaatttaaacaaccaacaatacgactatacccaagaaagtcctaatatcaaagcacatgaaatttttggaaatgatgcagatgatttcaaacctggttctttagaattctttagcatattgcaacaacaagaagaccttaccatgatagacatatacacctttatgttctggccaacctatagtcattattttatggcaggttttgctcaaattgattttttaaatcaaattttctattcagggcgttttaacaatatccaacgaatgttatattcacgcgcagcctttttttcaccattatttatacgttatatatattcatcattttgtcctattctatctccaattttaccacaaatcaaataccaaaactttgataaccaaattggtgaaattcaagagaaaattctcgcaaattgtcgatcacattctaatctctttcctcaatatattcttgacattttagttgttgaagccactcaagaacaaggtagcaatgtcattttcctccgtaatgtatttattaactatgctttacacccttcgtatcacaacatatcctttttgcaaattttagggtttatcgaatcgcatcaaactcctaacgaacaattctatgaattccttcacaaattatttacaaacaaatttttgcgtgaattaatcaaaatattttcagagagttacaacgaatcagaaatcaaatatattgaagggaaaaaccgcgaaaatctgccgtcaatgttccaaccgtcaattttgactaactacgacatcatttcactgcaaaacaatcggaaaccgtttgaacccccaaatgaacttacttttcatacaatttcctggtggacaaaactacacacatgggtcgatagcgatactgatttaaggaagtcgcaatcagcagtgttcaaacaacggattcgagaatttttgatcgaaactgattttatccccagatgtaattatggaacgtcattagatgattatatgaatgaattggttgacaaaggaccaattaataaaatcgaaagtcgtaaagtagaagcaaacttcatcaaagaacaattacaacaaaaatcagaaaacgaaatcaagaaattattagatgatattatcattgatgacaaagaagacttaatgaaactgagtgcatttacacccatgatcttccaacttcaagatttagatgaacaagtcaaaccaataatccaacgaatgttttatatcgcaaaagatttcttattgcggtcaactatcgaaaagtatttcatgaacaaaaggaaattggaacttaaagatgtcataaataatcccaatttgttaaaacaagaattaactgatttaatgagttatgttaaacatgaaaatgacattgttaaagagaaagtcattactgaagaatcaattacagacacatgttattcttatcttacttcctcatttaattataacgaattcattgaatttaaaccagaattaaaagaagaggattcaatggtctacgaaaaactgtcaacatctgaaaatgaaattatggaaaaactcgaaaatttattaccagataaaaagtatctggaaagggcgaagaagttacttaaagaaaagaatatattcagcggaatgaaagacgcttttggaataaatgatatatatagtttcggaaaacaattaaatgtcgcaataggaatggcaaggttccaattcacaaagggattctcggctatggatgttggacctgatcaacttatgccgttctttgttacgttctattcattgtttcatccaaaagattttgcatcaagattcgaattcttgaaaatgttttacattggcttcttccctaatgagacaacaacgttcacatgctaccaatcagcgttgaagaatgggggactggatattcaaatttgaataaatctataaaccgttatatgaacgtttatttggctgcttaacacaacataatcaattcaattattcaatagctatgttatgttaccaattttttctgtgcataccgatgaaaacgacacttttgggaaatgattctcttttggataatattagtttgattatcatcatgcccgctaaaccgcccgaccaattattaaaagtttttcgaattctatgatgttattatgtgtaatatgatccatgttttcataaccatcgttcttacccacaacggaaccgcccacgaaatttgaattgaaaaaagatatcacttttttgatggagaaagtataccatcaaaatgcatacaaatttgattgaagtaaaatgacatttgattaatcaaaaagtaaaagttgatttgtgaatttgtgtttcgggctggatgaattgctgtattctgtgtttacatgttaaaaaaaaattaaaaaaaaaacatagtcttggcattgaaaaaaattaaaacaaagaatatatatattttagataaagatgaatccaattcattataagacaaaaatacgattcatattcttaactcaaataacttagaatacttatcactcgtttcaatttttttcaatttgattttgagtgtttcattttgacttggaatttcttgaatagggaaaatacgctttggttgtgttgatgccatttctaaaagagtgaccggatttggtcgatgaaacgttgttgcagctcttactctagtcattgtgctttcttgttcttgtaatttctttttaagttttcttgttttattttcttgagttacactttcaggtgacggtagccttctttttaattgggatcttttttggtttcttggtgaatctctgattttcttattcacagaatttacattgttaatataatcggaattaacattattaatattttcaccagcatgatcaacgaattttgttagatgcctagtttctgttttaaagatattatttctcatcatttttaaaaaaaatgatctttaacgtacaaaaatttatttaaatagtttacatctcacgaaaaagttttcagttttgatttttgttttcccacaaagtctttaatcctttatcatgcacaaacaatatttccgctattttcgatatctgttctttaatttcagttatttcttcttttaaattttgtatttctgattcaattgaatcatctttaattaattgtactcttggttgtataacaggcaaacgcgactctattgattgtattcttttagtcaatgccattattggcgttgattgcggttcttcttcgaatggaataaattgcgctttttcccattttatttggttatctccgcacgaatgaagaagtagttttcgtaagtcgctttcggaaacatcaataagaacatttacaagttcatcgttatcgatttctatgtcatctacatcatcacatctgattccatcaaatacttcaagagatggacaaagatgttttgcaaactcggcaactttgatgtcttcgtttttctcttgcaaactcgtgttcaagactcgtaattgttggaaaactgtaatgaatctaagattaaccaacgtgtcaaataaattggaacttacatcaatttcttcaatatcctttgggattttgtcttcaaaaaaatcgagattcgagatctcgttttgcgatatgttaagttcaataagactttgtggtaaaggaactgtaatatcagatattttgttgtgagaagcatttagtgtttcaagattaatgagagattcaacaaagtctaaattagtaattttattgtggctacaatcaagtttacaaagtgtttcaactttgcgaagtggagtgagatcactaatacgattatttgacagattgagatagcgaaggtatgtaaaaggagtcatatcatgaagtgttttaataagattgtttgaggcttcaatttgaattaaaagatttggtttggaaattggtggaagctcggaaatttttctatttgagcagtcaaatgtgtcttgacgtatgctgtttccagaacttcgtattgatgaatttgagtgcttgtgattgcttagctccatccagcaatcgatatgtaaagcattcaaaattcaaagatttgtcagataattggcggtttaatatcaatcaggatgaaacattttaaatgattgtttttattgcaggaaattattctaagagtctaattagaccacaatcgaaacatagattttgtttttgatgtgatcctatataaatataagaaacaaaaaataattccaagtttaaatgaatcattttgtccatattttttattgtgattgatactaaataagttattaataaacctatgtaaaagaattgaataattatgaaagatttcatgaggtttcacatgattcaattagtcatattttttatcgttcaaaactgtaagtgaccaaaaaaaaaaaacgttatccttcagaaaaccgtctggtggtatttgaacgataggaaagtggcagtaaattgtgataattatattcaaaaatttaccggtaaatttctcaaccttgtttacattctaaatgtcttctgtgacacctcacccaagcatatatcgcgtttcttgctatggctgcggtcaaatgtatgttaggcgttcagagaatgataaatgcccattttgcggccgttcgaccatcaagtattatgaatgcaaatgcgctaactgtggtcacactgtaactgtcaactcatttgatgacgcctgcaaatattgtgctgcaaaaggaaagtggactcaaggatcttacgatggaaaagtcttcagatatgtaatcgtaaagcaagcgccacagccaagaactgaaacaacatatgttacaaagtatgtaacagaggaaccaaaacctgttcgtacaacaacaacaaaaacaacatatgttacaacatctcgtcctacaacaacaactaccacaacatatgttaccactaaaccaactacaacaactaagacaactactaccacaacatatgtcaccactaaacctggatcaacaactactaccacaaccacaacttcaaagaactcaggctcaaaggtttcagtcaagttcgacatggggcaaaggaaagaaggaccagaaccggattgtcttatcgcgtaaaaacacagcaaacccatttttttaacgttttgaggcgaaccttttgagggaattgaattgaaattttcaaatttcaaaggtttggatttgtttcgattgaaatataatcaattatttggtaaagaataatattatatcatttcgaatagaatttaggtgtttgaatatggaaggagtatacagatgcccccgacacgggttccttggatactcgggatcagttccaaccgcattatatactgtaaatttagcaaacatattcaagaaaatatttttgaatgtgtattaactatgtcaaacgttaaaatgcttctgaaataaagagatagcaggtttgaatttcatgttatttataaaatatgtatcattgaaggatatgtaaataaaattattataatgatttggaaaaattttattattttgataaaaactttttctttgtatctacctgtttttgtcaaaattattttattattttattaatttcaaaagtatgctaataatttttactatcttcgttccaagtgtatgcacgattatcatcagatttcatatgagaaattttaatcccaaaaagttacttgttcttcaaattctttaaatgttttataattataattgctcatatgcaaagacaaaacaagagatgcatgaaatgattccaataaataagaaatatcattttaaaacatcaaattataataatatattttaaataaagcaaactatcatttctgttaggtgcaacattaacgccttttgcttttagaattaattttactatttctttataattttttgattttgctttattcaacgctgattggaatgattataaaaatttttcaggacttattttgaaatattaaatcatgaaaacaaattatatataaaacaaatcaatatcattccttcttgttcaagaagtattttaacaatttccacattgcctttgatagctgcaataaaaagtgctgtatcaaatattttaagagttttccaaatattatttttaaatatcggatattaaaaaaaatttcgaataaaaataaatatttttagctttaaaatcaataccttctactcaagaagcaatttaacaatattgatatgatttttttttcaattcaatcataagtgatgttctaaatattttgaataatctctaaatggaatttagaaatactaaatgatgaaaacaaactctaaaaatgttaaataaatgtttttagcattaacatcaattccttcttgttcgaaaagtaatttagctatttctaggttacctttttgcagattcgtttaatataaaagtattaaatttatttccttccttttctaagaatgataaaatctcataaccacatttaatacttaaagttatcaaagaattaaagtttcttctaatttcactttctatttgattttcataaatatatttcaagacatcattttgatgaaattcgattgctatttcatatgtatcttcgaatttcgaatgattttgttcacataaatgaatgatttcttcatttccacctgcaattgcatatttgcttctattatctacgtttgcaccattcataagtaaatatttaaaacatttaactgatccaaaaaatgctgaataatcaattaatgaaacattttcttcaataataaatgaatgtctttcataaagtgatggttcaattgtttgattcaaatcatatttgtattgtgatgatatttcttgaagcttatctatttcatcatttcgaataattatttttgatctttcgtttggataaacttaatctttaattaattgcttatgaagttcccaatcattctttaaaggttgatcataattttatgaaatatttataaaacataattttacttccttttaattgttcaattgtttctgtatcaaaataatgagaaaaataaaatgattttttatttttaattaaatttggtgatattaagtttgattcaatcattttatcgaaaaaaaaaaaaaattagattctttaggttttatttgaatgtttgctaagaattttataaaaatttcaattgtattctttgggatgataaaaatgaatagtaaacaaaattactaatgaataaattaaacgagtatgagaaaaaaggattaaataatttcattacacgattaactgcatcattaccaaaattttcaccagttaaattaaaaaaatattcttcaagttcaaaaactgatttcatacaagattacagagaccacatcacatatcgacaaaagtttattaacaaaaaaagccaccgacggtaatcgaacctgcaacactaaatatgggctgccccattttttgtacgtttgtaataagcgagatttataaaatgagcgaattaattcttaaagcatggtccatggctcaatttgatgacatagaaggactaaaagaattagtgccaagtcaggttaacccaaatgcgtcaactcattctgaagaaaatcatgttcattctttattgatgtgtgctgcagcacatggttccatagaatgtacaaaatttctaataaaaagtggtgctaatgttgaacaaaaaaactttatgggttttactgcattacattggacggcttttacaggacgaattgaatgcgtcgatattttattgaacagtggagcagacatcaatgccaaaacagaagacgggaaaacggtaatgcatattgctgcatctcgtggtcatatttcttatattgaatacattcttgaaagaggtgctgatttagatgctgttaatagtgctggatggaccgcaattttccttgcagttgttgccaatcagaaagctactgccaaatatcttcttgaaaaaggcattgaatatgattattttgatgcaaatctcaaaaaattgaccaacattgccacaaaatacaacagaaactggttattcggcctccttgataacaagtccgaacataaattcgaaacagatcaaattgactcaaaaatcttgatttcgaatcaagaatctaattcagaacaactcaatcctatgccctcacctaagcaacctaaagtaaggaagacgattaaaataattaaagatgctaatgaagatattgtaaatgattcatcatcagaaacgtcagaatcagaagagaaccttgaatacacatcaccaaagaaaccaatcaggaaaccatccaagaaacccaagcaataaagcaacagtaatttgatttatttactcgtatttaccaaaaagattctgtgcgctttcctttatgacctccaagtattgtcttgcacacgacgacttaacagttatcctaacgttggcctgagtttcgacgatttcaccaacgaagatgatgtcagacgatagcgcgaacgatacatacaaagaattaccatttttacccttgacgtaaacctttctttcgaataacgtttcttttgatgcaatttgtaaaccgttcaaatcgaaagtaattgagttgtaaaattgactgaagtaattattgaaatcatccacgccgatatcaccgtcatttgtcaaagcaatttcaattggtaaccgacaaatggcgaatatgttttcgatgttagttcttaatgctaattcaaactttgtcttgtcgaaattaccggctttggatttgtctacctctatttcagtttcaatttcgacactttcgccaaattcgagtttttcaggtaatgagatttgatctttgaggacaatgccaagtaagttattattaattgcaatcgcaaagttcgataatgtattgtgtgacttgttaacaatctttaggttcatttgatccacatagaaatcaataaacatcgagatgagagtatcatcagaaacttttaagggcgtccaattctttaacctttctttagacttgtcatattcatctatgtccggaatgtatttagcgcgatggacaaattcagttggtaaaatgtgtaatacgcctgcaacatttccagtgttttcgataagttccgtaagaacttcctcttcaaacttcggtttgatgtcttggttcatatttttctcaaatattataatttgttttgcaacttcattatctgatgacaataaccgccaatataataaagcgcgattacggacatcagggatagacgtctctttggtggcttcgtttaggacaaattgaagttgatctttggtttcttcaggtttaatgagatatatcttcgcaagtgatgtaagcatctgaagttggacaagtggttccgagtcatgaaagctatcaaggaatgggtcaataagaagatcaacgttttcgattatatttgaatattcaccaagcaaccaaattgctgaagcttttgcttctggaagacttatcttatcaagtgaagaacaaatagttgacagaactgactcaaaactaccaggatgtctacgaagaatatcgcagaaaactatgatcgattcttcgattgcataactagccttactagtgatacaagagcacaaaatatcaacacaacgtgatgtagcaacaggtagtttgatagctatttggcctatgcatcgaattgttttgcgaacgaacgatacatcaacggagttaacgtactcagtgaattcatccaaaaccgcctgagcggttatcggttggacggttgtgacgatgatgtcaagtttttgcatcttaataaaagacggatcattatacttgcagaagaaaaagcgaatgtgacgtgagagtgcctttggatacttaagaacaaagagagacatcgctcgaagaactacatattgaatctctgggtctgctgacgaaattaaagataaaaatgatggtaaaatttgttcaaatattgaaacgggatcgcgtttgtcatgatccatatagaggaaaatacagcgaaatgctccaatgataacagatggattactacttttgagatatggtataagacgctcgattaaagaattggcaatttcgctgctttcagggatataacgagatagacaatcgaatagaacagtttgacaccattcattggaactggaaattgagtgtattaaaggttcaattgatttggaatcaaatgtaaaaattggtgttgtgcgcctttcgttgatttcatatatagctgcagctgtgttagaaacaactaatggattgtcatcgttaagatgtgaaattaaagctttaaataattcagaattttcaactgtctctggaatgatgtcatataacttaacaacgccaagaacagctgtcttcctgacgtatgggtctggatcttcgagtgattgctttaatggagaaaccatatattctgcaacactttcaactcgtattcggcacatactacggacagcaagtgccctaacaagtgggttgggatcctgagcgtcaagaataaaggtgttaacagtcaaaattgattgttcaggttcgaagagtgaataatgaacaaggtataaataaattaatcttttgagttccatgtcagatgttttgacacattgaagaattgatgaaaagaaaacttgtacattttctcctgctcgcataagattaattacttttttgatggcaatttttctttcttctggcgacccagaatcaatgtagtttctgagtgttcttacgtcgtttggcatatcgcgtacaaagaattggttaattttggaaagcgcttcgtgcattttgttccttttgggcgacgatcaaatgacactttttgataataatgtgttataattttcatcgacattacatcattaagcatatttctgaaaataaatatgaatatttgcattaggatataaaatatgagatagtaccatttgaatatagataatccaatattttaaatagaaacattttcttcaaaatggatatcaatagggagtgaacacaatgaaatatatttttgctagcgtgtaatttcattcttctatcataatttattttaacaacacatttttatttttccggaaaagaaacatttcagatgcatgaaattatcttataaaatttacataatactcatacacatagaacttattcttcattgctgtttttccaaatttttttttaatgttattgattatatatttttatcaaaagaattacacaaaaagcattatttttaacttatttttgtgcattcaaatcaaaatgatacattacatatttttttatattcgtatcaattgacgtaataaagtttgtatctccataagttattacatgaacattgagcaaattgattcttaccaagttgagaccgtttaaaacccggtgtaccccaattttttcgaacatataacgtattctggcggttttgtgctttattggagaaatgtgaataaaccattgagttggaacagttaacaaatgaaaaacaagagaagcacctacaaaatctagtattaattcaaaaaatttggtttaacatttgcatttgactagtaagcaatatttttttcaaatatatacttcatacaaatttttgttcattaacaagatttaaaaactaacatatttaaatttttattatcaaattaaatcataacgattaaatcgcttaaaaaaattaaatgactctttattaaggaatgggacgaaccagatataaatccactttttaaactaaaatatcataggaacgaataatttatatgctttctttgcttataaggtgtgtaatggttttttgtttttaactttcattttcttttataatttgaatatattaatgcaattcttctaatctaacacttagaataagaactaatatcataaaatcatattatataaaattttatttaacaaagataaataattgttatagtataatatctcctaaaagtgtgtaaattttggaggtaattctttaattgtaataatagttattattaaaagcatttgaaaatttttccttatctccatctttgttttcgttttaataatttaaagaacatctttaagatatttttggtaaacactttctgattttgctgattcaattttgtgtcaacaagagataaaagctatttataattggtataaagttcttttgatgatctaagattccgtatttcagtatatatcatagaactctttatcttcttttgatgaaattttgatatcttctttctataaattcgattttattaatgaaatattataatgaatacagttatgtataaaaagtggtaacggcaaaaaaatatggtaacgacggttattccgttaaatgtgaaaattaaatgaaaaaacaaaaatttctcaaaatatatgtaataatttctttgttaaccaacttaaaaatattttatattatattttttatattaatttagatttttgaatcatttttttttatcacattatttgttaaattaaaaataaaaaaattaattaattgatgatttatttttcaccatcgattgttttccgaaatttttcagaaaaaaattgtttgtttatccatccccatctttgtgcaatttatctacaagacatggattcttctgagtagttataattacagatttctttaaattcatcataattttcaactttttgacgatttaattttaaataatccacaccatttttcatatgatattcaaatccagtatgcttaaatgaagcatggatatatgttgaacatgtgcttaattcataagttctaaacatcatatatatatgctgaagttttggatgaatatcatcattatttggaatatattttttgtaattttttaaaataccaaaaagtaaacgatctaaaacttgaaataaatgagaagtatgagggggataagtaataactaaaatcataagtttcgctaatttttctaataatttttcatcaagatgacataatcaattatcaaaaaagagaatcgccggtttttctgaacaatcaggtccatttcgatcagatttaatatgcggaacatatttttgtagaaataaagccagtaaatatttcttttgtaacataagatgatgcttcaacccttatacttagatcaacatcccttcttattggtatattaaatatttcttcttaatttggatcagatgtatttattagatagaaataagcatcgccaccaccatttattgtgacaacaagggttaaatgtcttattctcctatttactggataatgaagacttctattttcatattcctttgggactacaaccattttcggttttctatcttcccaatctgataaacccacctcatcgatattatagattaattctgcgagggtaatttctataactttttcgatgaggtcaaggtactctatcaagtacttacgcggaacttttaaccttgtgtcttcttgtggttgaataatggttaaactaatttcagtagaatgacgatcaaaaaaactatctaaccagcccctcgttagacgtacattatatttttcttctacaaatcaaagtacctccgaaagggtcatgtattcataagaatttcttcttgataaaatttcttgaataacaattttctcctcttcttcggataaacttaacggtctcccaatttcttttctttttttgttcgctttgcatagaattttccgaacattcccttcggtaatattaaagatctttgccattagtttagcattcgctgtaataaaacaatttgtttttaagaattgacgaataaaaagtaattgttcatttcgagaagaactagttataaaaccatcatttcttgtaattgcccgaacatcaattgggcgaatgattgtcccaatgcatctctcacaaaattcttcttttgataaaggaggagctttcggcggcatgaaaaaaattaaaaataaataaaaaaaaaatttaaacgtacacctatcggcgttaccatgttttataccgttaccactttttatacatgactgtaagagaatctaattattcatcttaacccatcttttgaaacaatagttttacaatattttcaatctttatattactgctttcaattgttttcattttatgattaacaaaaagcaatatttatatctaaaccatgaaatttctttttctttggatataaactagttccctcaatatcttaacaatatccaaaatgcaattgaaaacatatgtcccaaattataaacgatgtatagacatccaattgtgctcttctttcctctaatgtggtgtttaaacacttcgtttcttgtggttatttcagcgaagtttttgtgcatttgcatttgaactaaaatttttgatctcaccgaaagtaccaattctttaaaatataaaaatatttttaaatgatcaaactacaaacaatttttatttatatcatccaatagttcgcggattgccttgaaacgggttatgtctgcgttctgttgttgcatttctttgtggcccagggttgtattggaatctttggaaattattttctgcataatttacgccgggcggagttatgtcttcgtcttctccatcattgtcagacataaatggaatcaatttcttcagggaaaaactttggaaacctcttcgatttccattctttttgatgaagcgaatgtatatatatgatagaatcgttccaaataatgtcgaaacaaattcatcaaaagtggtaaaaatggaaaaaattaaagaaatgattagtattgtaaatggaaacattcgaatatagattgggccacacatggaaggtattcgcactgggaaaagttggtgagcaagagtcattgatattgcagattgacacgctgatcctgtaagaattggtcgatttaataattcagaatttttggtaatcaaatagataattaaaacaaaaattacaattaaaatatttgtataaaatccggtcataataaatactcgtaaaaattcttttgagcctgtgattggctcaattatttttccaagcattaatatcaaaattccatctataactccttttaaaagcgtatcataataaaacattccagtgaataatatccaaagcttcggaaaaggaaaactaaaagattgaataactaaacaaaaatatggtctaaaatttggaagataacctagaaaagatatgattcccattgctatgcaaatgccaattgataaatttgtaactttcggaggaaggagggtgtttggctgcataaattttttgaataaaattctcttttaattttttgaggcacaaaatgccacttaaagttcttctattaaaaacgcacaacaaaattaataaaacatattctaaataattaaaatgaatagctttagcattaacatcaattccttttttctcaaaattttctaactgctatataaagtgctgtttaaaattaaaacatatttcaaattgttctgggggcaaatgttgaaccatcctatgctaatggggggaggttgtgtggtctggattagacagatatcaaagatctagaaatatattataggctttataaacaagattattgttttgatgaatctgattggaaacaaatttctacatataaaaaaggtgaaaaagtaatagtattaaatatttatccaagtcatataacgggcagactgttataaacagaggtatttttcatataaagtatatttaaagtttgctaatgtcacctacacttaaagtttggatggaaggaggaacaattatagaagacggaagagaaaataattttactgcatatggagtggatcacgaaactggtggtcaacaaacatatttagatataatgtcaaacaatgactttgggcaaaatgtagcaatagatccaaattttatatataattatgatgttatattctttggaatatgggaatgatgttctgaatattcactcaaaacaagaacagcctccaaaaatattcgtgagtatattgaaagaggttatggatttatagctggacatgatattatatatattttttcatctcgaaatcatagtgaagcaacaagtttacttgctatcagagatctatttggaataaattctcgttatgttgatgatgatatacaaattaatgggataacagttcatcctaattattcatctatctcttctgataagatatccatgcagccaaaaggtttattaacgagatatccatttgagattggcgatactggaacagagtcaaatatttaagaaacgcatacgttttattattcttattcaaatgaaataactccttaagataataatactaaattgataattattataactgtttgtattgtagttttaattattataataattttgtttgctttgttgttaaaaagaattcaaaaatataaaactaatgataaagaaacaaaaagcagtgaagaaagtgatcaagaaaacaaatatatctgcaacaggattttatatttctcatattgatgaagatccatttgcagaagattttaaagaaaaagaattcatatacaaatataatataatgaatttatataagcacataaagaaaaagttgtctcgtaatagaaacattttagcatgttagtaaattcaatttgtaaatattcctaatatgttaaacaaaacttaattttgattttcattttaatatctccgagcacagaagtataaaaactattttttttatttattgttgcttaattaatttttgttttcatttcatggcaaaaaatatatacttactaaagtggttgcgaaaaggtttcccaacgatagaatcaaatgaatgaaaaatcatcggattcatattcaaaaactgaagtgtttgggaaaccttcccattttaattgcttggaaatgatttacttctaaagattattatttaatctatgaccttaaactattcactgttttcagatggaatatcataaaaacattcataaaattttatgaatatcggagaaaaaaaaaaccaaaaaataaaaatgtttgcgcataatttttagttatcatgttttgtaagaattatcatcactgtttctgtgatgaagggaatcaaaactttcatcatctgttaaattgcttttggtggctttatacaatttgtacatcaaaaaaagtaatgcaaaatcgccaacaacacaatcaaattcaattccgttgtcatcagactgaccataaggttcttcttctgtttgcaacatggactcgactgggtctgagatcgaaggcatttactttgtgaactgagttcaactgataatttcaaaaagtagaatgaatttatctgaaacaaaaacttgtttcaaactatcaaaataatgtcacacactctaaattataattttattttctaagtatgaaaaaccaataaattagtcgcatttattttaaaaatacattttgttaattcaactatttcactatatattttagttttattaatgaaggcctgttcggttgttcaattttcaacattcaaatttgagataatatttcaccaagaataaaaagtgaactcacctttctatcaacattcactcaaatttaaattgaaggagaataaagtattgatcaatgtcaaatgataactgtttctttgatatttgaatgtttttataaatctaaaatataacggttagtttagtacgatgattttttttgtttggaaatttcataacaaacggtttatttacgatgactctcaaatatcttttttctttttatggcatcatgatgcagtatctaaaattattgtttataattttatatttttatgaaattttatattgatcaatactattttttctttatttaagatattttttggttagcttatatttcgtttatatgattaaaaaacactcaaatcattaacctctgatactcgagtttgatatgtatttcactcgtatcattaatacccaaaacaaaccttataattttagtataattaatgcttcgataggaataattcaatacgaaacttcagaagaaggaattttttaattacaaccaattggttttgattacaaatgcattttaagaagattaattaaataacatattagaatttactttaatcaatttttagtttctgttatttaaagtcaatacgatatctaaataacgattacaaataatattacttttaagctgacaatttcagtgacatcattataaatcatataaaacatgcaccaaacccaacttttacccatttcattgtactaaatgcgttttagcaaaggatagaaatctatttcaagtttcatttaacaaatttttttgacaatgctgcaatgatacagattctttttttattgtgaaatttaaaaaaaaaaaaattaagataagaaattttgttttatcgagatctgaaaaaagatatcaaaaagtgtgtgtgcgacaaagcttcaaaggtatcacaagcgaagcataaccgccattttcaaagtgaactctcactttcaaaccggttttcattgaaaaagtgttcgtttctatgtcgggcaaaacaaaaacgcgaacccactcgaggacaaaaggtatctcaactccatacggagggtcacattcaatgatttgcatcctgcaaacttcatttgaaaatgtttgtggatttgatcgatcgagagaaattatttcatctcgtgcataagaaacagtacaacttgttacaggactctctgattcaacaaaaactatgcttccacgaggaggatgtgttgatgaagcaactggagtcggaagatgaattttcgctgtaaattttacttttggtgtattgtgacggatatttgtttcgttcataacaatatctactggctctccttttggtatattttccgttttgtagacaataaagaagggtttttgaacaattaaatcttgtgaaaaaacacctcttttgataacaatttcaacaaagtaatcaacactaatatattcaccacggatgctttcggtaaggcctttacctttaggtattgtaaattgaaaagaaaaattatatccattttctattgcttttggaaaatcatgtttaattggtattgtcaaaatagtgttatcattattgtgttggatttgcgtgtcgaaagaatagttatgtttgttaatatcaacagttcgaacacaataaacattaaataaaatttcttttggttttataacttcatttgttcgaaatgttcctgtacaattgataggctcgtctgggagataagtcaatgcaagtcgatcgaatttgaaggagacaactgatggcatatgcaactacttaaaaccgttgcacgatggttatggcggtttaattgaatataaaacgatagctataaggcaaaaacagaagaattaagtcaagaaatgactttaacttgtatgcatgttttacatactaaaaaagtcaattcaaacacagtgtcttaaaaatacaaaggtagttagtataatttttattttagcaatgctgaattcagtccactgttgtgaaaggaatgtaaaatcattcaattctttctttatcaaataaaacaaccaatgccatgtttagtttagagttatataagttggtgttttcatgttcaaatacagtcttaataaataaattaataaacaagttttgtctgacgctctttttcttgattaccatatcaaaaataaacggtcaaacaaaagtgctaatcaaaatttgacacttttatataataaatgagccttgatacagcaacaattaactcaatcgtagaagcacaacttgcagcatccaaaggtcaagaaaaaattacccttgtgattactggccatcaagatgatgctgctgaaaaagcaacatttttcaatatccaagcaaagaaatacgatacatcaggtgctgttgttaaaacagctgaagggaggttcagatactcacaacttttcgattttaatgaacgacttatttttttctatggaaacattcgaatgctccgtgtattccctccaaagaaatgggttggtaacaaagcgttagattttgttactcaaaggcaagaagctcttcagaaatggttaaatgaattagttgaagatgaagaaacatgtgcagatccaattattttgaagtttttcaatttaattgaataaacaagaataactgcatttaaaagcaatgttataattcataaaataataacattatttgtatttattgtcattttaaatccttaattcaacaacattcaaattgcggcggttaattgattatgtcttcagaaaatttcgcggttattattcaaaaccaaaaaatcgaaatgcacaaaaacgtaaaaaactttatacttgcacaaattctaacttaatcatagtttttcttgctgtcacttgttttgcaggggtggtgtggtctattgttaattgtgctatttggtatagtgattcagaaggattagttttccatgattatgaagataatgatgatgatgatgatgatcacgatgatgatacaagtttggattcatatttattccctttactgactttttcatcacttgaatttttatttggaatttcaacattatttattcgttttaaatgtaagtcaaagtgcgcaactaaagtattcttttggcttaccgtcattgctgctatggtgtcatttattttacaaattgtatccattggtaatgttcctataaagattgcatcaaacattacatcaaacgaaaagacaagaatacgatcacactatcaatggctgtcttaaaccacgttcaagggctgggcttttggtgccattcttcttcataacacatttgttatttatcatttcatttgcaatggttttactcaagaaaagaaccattcgcctctaaatcaaacgccactaaaccaagaacaaaccgcatatatgaatgaagaaaagaatcaatacattaggtatactgctggtgcaatgccacaaaactattacaacccatattactaaatatatgtataaaaaaatatttcatctttttcatcaaacattattttaaacctattcattgatttcaattaaaggtaatgattaattaattaatatcatatttagtgattaaactttaattttctaggaaactgtttctatcaacattaagcacaaatttattttctagtattcattaaagataagttttaaatgataaaaataaacaaaaatctcatttacaatttattgtataactccacaataggcaggggatagtgtcaatttaatacaactaatgaaatatcaaaaattaaagaaataaaaattaattacaatttattctgtatcatccttaggacgtttttttggggattttggagctgaaataagagatatagtggaaaggaaatcagcatcggtgaaaatggatgctcttgctgatgcaatagaagaaggcggatggcgtgaaagctcgagcatctttttggaagctttacggagagttttcatccactcttcatctctgtcctgagggaggttctgatattttttgcggaaccaaagctccatatcttgagccattacgtatatcaaagtgccttcgttattatatatcatggcattttcccatacttggttaacatcttctgcccagttttcatatgatttgtattcgttattatttaatttcttacgaattgttgtgagatccattggtctttgaacaatagtaagataatctggagcaccatcacgaatagggtcaactttgtctttgaatggccgacataggtccattctcagcattttgtttgtgagttctatgcatttctgtttcttgaaatcattcatatatatggggcatcccaaaaacgtttaaactgaaatgaatttgtcacttttagtttatttcttctttaatgaacttgttaaagaaataataaaaacaagaagatacttttgtgtggtatgcaaaagaattttttgcttcaaaatatattttttttgaaattcaagttcattgttttcatttctttcatataaggcataaattatagatcaatcatttattttaagcaaataatgtttaatcatattgttaacaattatataatacatttcataggatttaattttagaaaataatattaaagattttttgtaaacagacttcaaatacgaaatccgcatgagaatttaaatcttgaatgaggaccaacgaagtttccaacattattcataagatcaatgcgcaatacattttgataataattatattttaaaaacataaatttaaacaaattaaaaaatagaaacattttataactacaatttcaattccgatatttcctcctttatacaatacattttccctattacattattagggatttctgcgatcacgtccgccagtgtcatattcaatctttctttaatttcatttacgaccaaaaatttttcattttcgttgtttaaatatttcgatattttctgtgatatttccgtctgatacaatttcctaaagcagaaaattgtaccttcgaccgccgattcgatttgttttgttccataactaccacgagcctttagatttagaatcgggttcaacaaaaactgtgtcacacatgttgataaagattgaagtttaattgaaattttactttttatatcatttaaaacattaatttttatattcgacgagaaaatgtttttccattttgaagtaattttatatccaataatttcataatcgaattcctttaataagttatataaatttatataataattcagtaaatatgaatcatgttcaatttcgttttcgatttcatttgacgtgttttcgatctctgtaagttcattacttataagttgaaatgaacaatcgttaaatagttcattcggtaatgatatataaagtaatggaagataatatataacttttcgttgttgtgaaatttgtttagattgaatgttaactataaatgttaagcgctcttgaataaatagtaataatgtttggacttttttatggactttatcagaacaaaatggaattcgataaatgttttgttcaattcgattacttttaagctcaagtgacaattgacataattgatcaatgtcattaatctgatacaattgcgaagataatgtcgaagaatatatcgaaaatatctctaaaataagtgactcaaaacatttctcatattctttaattgtcccataattaaaaaaatctttcgataatttatactcatcttcaattaaattaaaaatgattaaaatagaaataatgttttcatttttcataatagtcttcgttataattgtaacccgtgcttctttataagttaataacaaattattaaaatttggaaatttctcaaataaaagaaaaagacgtttaattgagggtgcgatagatgtaaacttttgaaatgagtctttgccgttttcactggtgaatatgacacgtttaaatgtgtttgaaatataaattttggctttttcggcagctttagataaaagagcttcatattttaagcgatgtaactgtgcttctttcaataatgtgttttgtttaaaaaactcaattccatctgatatctttgaaataacttgtgggaaatctggaagaaggactgagaactgactacttttcaggtccaaagatattttatcaagttcgtcataataaattaaaattttgtcaattgcattaacaaatgttgcgagtctttgttcttcagtaatttgtgactggcaagcaccattcattagctcagcgtttgaagctatttcaattctctttttttcagctgaatgaattaattcctcacaattttttatgctatcgataagaagatgcgactcatcgagcattagttccgctgcagttttagggataattttcgtattctgattctccttctgaagaatatcataaaaatttgaattatctgtcggtttattacgcggagccgcttccgatcgcgttggaactgtcaaaaattcggccatcgcgcgccacttcggaggaatgtcggaaactacaaatttcccattttcccccattcctatggcgtcacttttgttacaatattcgaccacaaacctcaaaatatgaaatatttcgctctttcacaaataacaaatacaaagtgttcgttagcgtaaatttcttttttcttattgtcatttaccaaatatgatataaacaatagcaaattcatcctcaaaatggttgcttcaaatagaatcgtgttacccagttgatcgattctggtgatacccaagtggtggcaatcggtagaaagtaatgaatatcccaattcataatccatgaaaaaacatgtctaacaaatggcttcacgttcagaaacgcttctttcttcccatcgtcaggtagtgcatcatctggcacgtgtggtaattcgtccaaatttgtaccttccataaataaaagtgacgctttggagcacccccaaaatttccaattcataaatttcattgaaatccaaatttaatatcaattatattactataatattattaacatcgttctctgtaatgtatatgtctgtaaattataaatttttaaaaaatcaaataatttgaatttttgtaatttttttttttcaaaattatttttctttttttctgaattaataaatacgtaaacatattctaaaatatgaaaatgtgaattgcgtgttccaatatttgatttttttgattttttcacttttcaattgaaatagaatccataaaaaacgttatctggatggggtgctcatcctccagagacacacgtgtcactccccaaaagacgatcagactgtctgaggcaccaagcacttccagcagaggtgagaagaagtacaacccgaagaaaatcatcaaagaatttcataagcattttgtcaagatcacctccgagatccaagcaatcaaatgcccagaggagatgcaccctccgctgtgcattggggaggatgcatatccgatattactgtcgccaatatatttagaaagtaatgagcccgtcaatattctgatgccgattgtttccatatcatatattaacaatgttcgcattatgtgtatttcgcagatacaatttttatcacttttatatttcgatagttgtgatacatttaagttcatatcaagttgtttggtatggctttcaagaggaaatcgaatcattggatcgccaattctcttttatcgatttccagagaagtattcccaagatgcaaagaaatcattttatcgatctggtatcaaaatattaatagtcaatactccagaaatcgatttctcgccgtaccaaataattttcataccgagtaacatcgaattagattcagaagaaagaatcaaattaaaatcattcattaattctggcggtggactcttttgtttttattgtccagtcgaattatttccaacagttgacgtatcgccgacagctattaatgactttttaattgattatggattatcattttcatgttgtaaattggcaccaaatccaactcggaaaacagcggaatttatatatggaccagaccgacttattcgacatcatcttttatatcatgttaaatacttttgtgacatgatggaaagtcttcaacttgatgaaggttgtttagatgatacaattacagcattaaggtattatatcattgtatgtgataatcgacatttggatttgttcattcagattcttgataaaagttggtcatttttaaacgctacgaatttcgttaatgagaatggtattggtgaacatataacacaaagtcttgtaatagttttaatgtgtgaagtattacgtttaataccaccacaatttctaactaagaatccactttcgaagacatttccaggtgaaacacttagagcttattgtaccaattataaattggacattaaaattagagatgaaagttggatttcaacaggactttggttaccagcaggtcaaacggcaattataaaatgtttaaatcctccattaggtttacatgttcaaattggttctcataatatgtcattattatcgaaacaaggtccttggaatcgttggcctgaaatagtaaatgtatatattatagacaaagaacaaattactgtcggatcttcttttggaggaattgtttatgtttatttctcgtttagtgaaacagaatgtcgatcaggacttatggatgaaactgatcaaaggattttaattgaattcgaaggattttcacaatatcctcgttatgtatatgataaaccagaagtatttatgaaaactaaagaattcgaaattccttgggctgaaattactaccaaaacatttatcattactttacctacgaaaatgcttatgttaagttcccaaaaagtattaaatgaactttgtaataaacttgacgaatatgtaataactgttactaattatatggaatataaaattggtagaaaatttcgattagtttttgattgcgaagattcaaataattattcttatggttatccaataatattacatttaacaaatatcgatgatataattctaaagatttctcaaccttcacttggaatttttaacttaattagagctgttgctgttttgtctttacgtgaaggttactttgatcctgaaacagaagtaggaattggtacattaattgctgcaatgttcttcaagaagatgtggccggactttgatatgttttcaattcctggaataaaaattccccaaatgtttgaaccattatcaataatacaaacaaaagttagtcaatcattaattacttctataattagaagctcacaaaaagctttatttccttattatgaactaccagaggatatgtgggtaagatttgtaagggaactttgtaataatgctaaaatgaatttgaccccaatgttaaggagatatagaccaattcctataagcgtagtaaattctttgtcgaacttaccacagatgcaaccaattttgtttgcgtaaatgttatttgaagtttatattttcatttttaaaaatgtcgtttttcattagcttcttccattttggttgcgcgatcaatttttcttcttcgttttgtgatgagtttcctaagttttgataaacttttctctaatttatcaattcgattgatgttttcttgtgacatttcatcaattttattaatggaatcttcaaatgtttcggtttgactacttaagagatcattgaaatgttgaacaactctttcttgtgattctttaaagatatcttcttctgttttaattgcaccaataaaacctggtggttctgccatgattctaggatttcgattacagattcgagttggatatgttgtaagatcttttggaaatcttatgtcattatccataaaaacactggtaatatccatcccagaatcatttcctttttcattgtttggaaatgttgttgcatcatttgaagttgacatatgaaaattatttaaaacatcaaaaatttgatgcgatgcacttttttaagttttaaaattaaaaaaatataaaaataagtaaaaatgatagaatttatattttagataatatttatttctatttaatttagatcaaaatcaccataaagataggaattgtcgatgtcccaaattgtattttctgtttctgcaaaattaaacaaatagtccgaattatctgaagatgtattagcaacaagttcgttctgaacctgtggtacatttcccatttctggaaattcaaatgtttctggaatttttgtggatacagttttaattgctcgttctttggttttgtatactttctttggatctaattctcgtacactccattttttgagttcgatcggataattttttatagcaggatatttttcaattaatgtattaacgaaatttgtatttcctaaactactgttatatcccattttttggaatgaaccattgatagagcttttgcacttaagtattaaaatgcttagttgacgtgtattaagtaatatagcattgtcaagccaaaatataccacagttcatacatctcttccaatcatttccatcacctcttattgcataacttttaatcttttcaagagattgttggaatgtactgattctctgatttctttgattcttagcttgcatagaaaaggaagacttcaacatgtaatactgatatttgctttcattgtccaaaagttggaaataatttgggatcgcattaagttgactattcatcttcaaagtttgattgctgacctgttcatttagcggtttttaactttttatattgcattgtaatcaacctgtttcctctcaaataagtggtttatactcagaaaactgtaggaccactcgtcatttcaaaaagctgatttttgaaatgctgtcaaagccgttttacaaaataatcatcaaggcttaaaatatgaatatcttttttttgaatcaatgaaaaatgaaaataaattatagataaataaacaaggaaataaagtatttaatactatattcaaaaatttatattatacgtaaaaatgatgataatttttaataataatataaactaaacatacttcaacatttttgttggcttgcactaagcaaaaagaaagtttttgtggttgaaagaaaaaaaatttgttctggaacggtttgtttgaattttgcatgcaattttcggttatcatcagattgcaattagatgtaaaaaacttgcaaaagcaaaaccaaaacaagttttattcgaacagcggcgtatttacgtaaacaaaaaaatcaaaacatataaagattattatttatttatttttagtttgatctattcaacgataaaaaacattttctaatatcattttttgtatacatttttaaaacgatttatttttgttcttgagaaatcttttgttaattctctttctaatttcggatcttttactaattcatttctaacaacttctttaatctgtgcaatctgttcttcgtttatattataatttgccaattcttgtttatccattacataaacataagcataagccttcagtaatggttcgtaagcatctccgaaattatctttagataacttaagtttcaacaacgacgaaataatatttgatgtaacattggtttccttagggaaaggaattgattcgataatactaatcaaagcattcacattaaatttattggatattgttacagcagaacaataaagattcattgctgatactaatgaatcagtaaccattggttcttcttcatctgaatcacttttaatgattattggttcaataagttcaatgatttttatggaatttatatgttcgcttttacgattacaaatttttgtaagtaaattaaaaactgaaattggttcttctgttatttcactatacatatcaaatgatggaattaactcaattaatgagtccgataattcttgtacttcattatcattaagtaaattaagttcaaatgcttttgttaatggttctattattgatgttatcatccatgaagggacaatcgatgaatatttgataagtggcaaaattataaattgtgaattagttaaattccgtttgatatatgatttaataaaatgaaaaataattgatttactatcagccattgaataaattggtaaattatatgtaatcgagagttgaccgtttatgatcttctgaacaaagtctgtcaaatccgttaacggattttgtttcgaaagtttattcaaaacgtcaagtaaagcattcaatatgtcgttatttgtttcttttaatgctaaaatttctatttctttttgtaagtcaataatttgttgttcattaagtttgttcattatagcataaattatagtacagaaacaaaatattatatttttttcagcatttttaatattatcaaaaacgaaattaattaattttggaacaatgttttgaccgaaattaaatgaagttaatgaagaaagtgattgtgcaattgcagctttttcttttggactcgaagtagtttcatttgatattatataatcagcaacaatttcaacatctttcgaaaatatcgaaatcttattttcgccgaatttatcagcaataacataaagaagttcaattgcatttgcataaaaatttgttttttgcttaagaacgatttgatgtatagttaaaagacaatcttttaatatgtcactaataaatcgttcattaattgaacagaaaaacgcaaaaataggaagtaaaaatccgtcaatttcaatatccgatttaagtttcgttattgcaaactcaaaaatgggtttgaatgtgttaatgtcagctgattcagtatcatcaagaaactttaaaataagtttaaagaaaagatttcgttcttctgtcggatatttaggaaattgctcaattaaacgtgaaatatattcaggtgtatcaaaaactccgcattctataagtcttcgtaatgatttatgcgctctatattggatagatttatcatcatgaagtaaaagattataaatgttatcaaacaaatctgttggaataatttgtggattttgaccgaattgataactgatacgttcagataagaaacatgcggaaatgatttgaggtttatcacctttaaatagtttggagagcagatttaaaaagaaatacgaagacccatcaatatggtcgataaaagctgatgctaatggtgcaaaaaatattgtggaagaaacaattttatctgtttcggatttggtttttagtatggaaaatgcttcttcgtaaactttttgattgatagaagcagcttcaatggtatcaatgtaagaaacatattgatcaaaattatttatatcaataaaatcaattgaggaattaataagagatttggcattggattcactaatgaaagggaaaagggccatgagaacttcaaatgtatgaatatcatttttatctgttgttaatttagcaattaattctgaaatcttctgtggattagattctgaaaatgttggaacaattgaaactaagcattctaaatattgaataaaaagaaagaaagattttgtatttgtttctgcaatttgaattatactgttccatatttctgtaatttggtttgagtcgagttctactttctctgtttgacgacatgttttagataaatattctaaaagattcttttgttccatctgacctcgaccaaaatctgtcatttttgttttaattcaaaattaaatgtcatatttgattttttggcatttattttttcattcaataaaaaacgtcataattgttttattgctggttaatgttaaatctgttgtttatactaagttcatcattatcacaacttactgaccgagaattcaaagaaaatattataaatggaaaagctaaagagccatggtttgttatgtttactaatgagaattgtccaaattgtattattgcacttcctgaatttgaaaaggctgctgaattagcacgtggatttgttacattttctactgcacaagttaaagacacaccagaaatggcacgtcgcttgggtgtttatgcagttccatctttctttttattcacagaaaacggtgtcaggccttattcaggtaggcgcgtttctattagttttcttaattttattgccgatgttattggcgagaatattgatgaggcagatgaatcatggaatgatcaaacagataacagagtcatattattcacaaaaaggttcaagccgccattttcatttgttgccacatatagcgtcctcaagaacaaaggaatcacatttggaatttcccgcgattcagatgtaatcgaagcatttggcaatcctccaacgccatcaatttggttcctcaaggatggaaaaaaggaacaatataaaggcaagcaagatttcactaaactcatagatgctatatcgcagttctatgatgttgaaaaacaaacagacgacggattataggtgtaattctgagaatgaaatacgtattgactttcccataactatttttttttaaataaatattatattatattagttaaattactttatttgtttcttttgctctgtaactttgtttatgaattaattttgcaaattcttgagctcattaaattaaattttaagagagaaatcataaaagtcatagagaaaatatcacatgtttgatttagaagttatgttgactttagattataaaaaaaattagtttcctttactgcaaattgtttgttaatttacattccttttacaatacaaaagtaaaaatagttggtttcaaattatccctacacatataatatcattataatgcatttttatcacaaaaacaagtatttgaaatttacataagttttttaaacacacttcaaaagaaagaagaagaaattaatcaaaatatcgttaaactaatatcaatttttatcaaacgtatatctacaaagaacacacaagaatcatattatttaagcgagaaaatgattaaacaaaatttaattgaaaaaaatatcactaaaaatattttgcacattataaaacagaaaaagaaaacaaaaaacaaaatcattcagcgtatgggcctagaaatgatccaatagaaaaatacttcttggatcattatgaagaactttcaaagaatgattgggagcttcataagaagtatgaaatggaaatgaagcgagtattgctaataatcaaaatgaagatcaaatgtacgcaaaaaacattctaaaaaaagtaccaaaacaaaagttgatacaaacatatgaaaatcatcaaaatcgcaatatacattatacattaaacataaaaacagatttattgatatttctgaatttcaatttgtagcatctgctcaatttctttcgttttttgtttattttttcttattttactttttatttcgacaattttttcattttttatttgctccaaattttgcactctttggtttataattttaagtgcttcttcttgtttaattctttgtttctctatgaaatgtttttgctgctttgtagaatgttttattgatgcgcacaaagattttaatttttcttcaatttcattcatttcgtcatcatcttctttttgaggaatttctttattttcttcttcaattcttttatttatttccaaaagtttttgctctaaaattaaattcgtttcttgaagtttattaattatttctttgttttcgtatttcgtttggttcatatccatccataatgttttagataaattaatttcattttttaattctttgatttcttgttttatgtttttgatattgtttttacagtcagaaatttctttagtgtttttattaaagttttgttcgatttttgtttttgtatcaatttctattttgattttcatttcttcttcattttgcgctatttccattactttttgttgtaataattcattaaagttattatctaattcttgtttaactttatttattatttgttgctcatattcagatttcattttatctttatcaatatgttcaattgaagatttataattatctaaatgatttctaagttgattaagtttttcattaaaaatattttcttctcgaataatagtggcttcaacttcatctgtaatcatttgaattccattttctagatcttgattaatttcattaatctcagattgaatctttcctttcctttgctggaaattaatattttctttttcaatcattttattaaagagttcataatactttgcatcgcctgatggaacaaaaatttgtttggaaaattttgaaaggtttacattacattctctttcaattttctgaaggttcacttcatgttcatttttcagttgttcgatttgctttaaatgttcatgctgcatttttttaatcaaaaaatcaatcttttgtgaatacttttccttcatttttgcatatctttttttaagaatgtcatctgtttgtttggaaagatcaatttcttcttgttcttcaattttaatttcgtttggcgttaaaagcaattgcatttcttttgataatttgtttagattggttgttaatttttcattttcaacaagttgaattgttattttagattgaatttctgatatttctttttgatatttattagccatctctctctttttacgatcaagtttcatttgaaacccaatttttcttttttgtgatttattttgtagatttgcaattttattaatattattctgtatgtttttttctgtttctgctatttttgtgcatatcaaagacaatgctttttgtgctgattccattatatccggcgacttattcatttccttttaaggaaacgaacgaaaattacagcgaccgtttaatgattggagttgcgaccaaacaatatgagcgacgcggagaatctcgacagaatcatcaaaagaattatacgctcaacagattattattcgatacttttcttaaaagatacatgcactcaagaagaaattgaaagacaataccaagcaattcaaaagcttttagattccaatcattgcaagcatgaacaagcacctgaagcactcgaaaaagctaccaaagcatatttaacattacatgatccagaatcacgtcaaacttataaccaaaatcgtccaccaaagcaagaaccaagacaaaacaacattggtatctttgatttactttttggtgatccagttagaaatgtaagaagatacaatcgtaacaataataatcaaagtaattcattttgtggcaagttttcgaaatttttaatcatcgtagttattattgttgctccccttcttactaatgaattagttttttcaggtgtcagggaaatattttcgaatcccatatctcgcaaaaacctcaaaggcattatttcatttgactcaatacctgattccagaaagaggaagacacacagttaccgtgcaccttactacattccaaattggtgggtgtcgcaatatatcgaacagaataatatgagaaaacgcgtcaaagatatggacaaacttgcggataaactctatgctgaagagttggaaatcagatgtgagcttgaaaagaacaggattgggcatgaagggtcacaatgctctgagaaaaagagaatacttaaagaagaataattttcttattttatttttttgtgtcacattaaatcgttttaatgttttggtataacattcgatttcaattacgttaatgttttctttacaagttttatctcagtaaatcactggaatatgaaaacaggtttacttagttatttcattttggtaaaacgaattaaaacatgtaacaaaacttttgcagcctttctcgaatacatttatatgttcgcacactttcgttttaatttgcacttcataaatatgttccgctttgattgacatttgggtaaaaacgaatttgaatctattcaaaatatttacaaaaattattttatcttcggaaacgtaatgtgcactcttgctgctgcgctcctcagctcgcggaatatttcttccattagctccttcgcgctttgctttgcctttgggttcattgctgtccacaactttccgatattcttcacgtcgctaatcagctccggcaaagttcgatagtattcgttttccattctcgcggacaaaatgtttaagtccattggctttaaagcctttgcaattaacttgctttccttgaaccgtttattaaccgccgtaaacatagaaaattctttggcctttgaaatcttctgaattatcccggcggtttgcgcacaaaatttctgagcttgtgtcaggcagttcctcttttgcggcagaacaatgtcccacgggctgatgaccaatggcatcgggtcatgatcaattgttagcgattcatatgggtcttcttcccaatcatctctaatgcctgtgatacaactattgaaaatttcttcatctgatttaatgtgttcaatgtctcgtccaatagttaacgttcgacaacatcgaatagatgtgtcaaacgtggtctttaatatgatgaatggtggcgaaagtggtaaaggataatagacattacatttgatggtttgtcgtgaattcaatttgatcgatagtgtaagcaaaagtgaagtgaccataaactctgtatcggagacgatacagtgaataaactctggtaagtttttgattcgtttatacggtggctcaaaagtgtcgactttacactcttcagcaaactttttgtgcgctttacgtatgtaaatcacttcatcgcctttttgtggtataaacgttttctgtttttgtttgtctatataaacccaatcgtcgaatttcaatggaatttcatcgtcttcgtcttcaattggctcatcgtcttcttctttaggctttgttttacgtgttaacttcggcggaggcgatattcgtcgtgatagaagtgacgtccgtttggtgctttgtttccttttgtttcgtttgactttctcaggtgaatacttccgagagacaattgatttccttgttgagtactttgcaatttgttcgatttccttatcacttttcgtgtcacgctttgaattcggcggacttgttcgagatttacgtacataattccgcttctttcggggagaagtctctgcgtcttttgaagtgtcttcgattttagtccttttatgtcgaccatgtttacgctttttgcgtggaggaggcgaaaatgaacgtggctgaacagtacgtcttccagttaatattaatctttgttgttgatcttgttcttcattttcgtttttgtctatttgttcaaggtcaaatatactaatggaatgtcgagttgacattcgactgttaagtattgagaaattactatcttcattttcatttgtaatgttttcgttttggttggtctgtgactcattatcttcatcgttcgtttgctcagtactaaatttttctttatcaacttttttccattttcttaataattccttttcttgaataatcatataacttgagatctgtggtgggttaatatctattctaatgtcttgaagattcacacgctctggttgtggtactaaagcttcgccttgtgcatcatatataattcgattgctgtgatcgttaacatgcgtatcgttcaattcaaaatcaaaaaattctgttaacgatacaaatttgctgtgagtgaaaccgtaaaatgtaaaaccgcccaaagagtcagcggctataacgtactgtccatcgttcgaccaaatactttctgtgagttttgcggtttcattgaattgtagtgcaacgataatgttgcccaacttggtgtcccatatcgaagagcgcccattagaacaacctatgaatgctacgtttggcatatatgggtgcattgacaatactgtgcaatgttctgtaaatattgggtgtgatacagatgtaattaatttttttgtatgaagatcccaacaaaaaatagtatttgatgaaattgctactaaatttgtttcatcacaattcatgtaacatttgaccacacgcattttttgaccagttggacatcgtaatgaaaatgattgttctaattcccataaattattcttagctgtccatagcttgactgacttttctttagtggaataactgattatgttattacatgaaagttttgagaagaataaataatccggtaaattttgatgaccacttaatgtaatagtttcatgttttgtcatcgaaaagatacatacatctgagggctcactagaaaatgacaaaaattcaccgccgggtgaaaaacttacccatgcgctagcttgtcctgatggcgtaataattcgatgatacaaagaataatccgatgtgttaaagatgtctacagctccttcttcaagggccgcagctaaaaattcgccattcggcgaaaagcgtatcgagtgaacttcactttggaattcaattttctttatgagactgccgtcgtggagcgagttaattgtgatggtaaagtcatgagagcttgctgcaaagacttggtttgatggactgatttggatatctgttatgacgttgagatgggtattgattgtatcaattaacgtcatcgaagggattttccagattttaataagagaatcatcagcgccagtaattagaagttgtgatgtcgcatcaacagctaaacaaaatacaaaatcaaaatgtccagtaacccttattattggtgacatttgggtgatttgtgtttgataaaatgggagattggatgataatgcttgtgggatcgttaatggctcttttaaggttgatgtattgacaaataatgaaggctgatgggatttgggacatgtcattcgaacaattcgtaatagttgatcatctggaattccgggaagtgctgttttctcgagttgttcaaaagaaggtttcgaacaaaaaactgatgatggaaatttattttgaatttcgcattgatgaatgaaatcttctgctatttctggaaagttagagcgaagaagtttagccattaggaaatataattccctttttagcgaatcatcattcattaatactgacatgtgatatgaaatttggcttgatgcgttttattttgatgcaaagacaacaaaaaaaaatgttttatttataaaatcaatataatttgcataaagaatttgttagattttcatggctattgttttgttttgggaataattccaataactcaatctcatggagaagaataaaatatttaaacggtctctagaaggagtgaactggagctatttcacatattttttttcgttaatcatttttttcttgttttttcccatactcattgatataataaggtattattacagacaataaaggctcttttttggccaaactaactcatttttaacgtacaattttttcaagaccttgaaaggtgatcacctatttcgaccgttacctatagtgttttgtgatagacactttttgtaaataactcaaaaaagcgcggtattaataaataatgtcaatttatcaccataaatattaaatgtaaatttttacttttttgttacatttatttcgtaaaatggcggggtggttttaagctcattttatttaatggcacgcacaaaacagacagcacgtaaatctactggtggtaagacaccacgtaaatcactcggtgctaaggcagctcgtaagtcaacaccagttgttgattcacaaggtgctaagaagcaacatcgtttcagaccaggtacagttgctcttcgtgaaattcgtaaataccaaaagagcacagatcttttaatcagaaagcttccattccaacgtcttgttcgtgaaatcgcatctggtttccgtggtgatcttcgtttccaatcatcagcaattgcagctcttcaagaagcatctgaagcttatcttgttggtctctttgaagatacaaacctttgcgccattcatgcaaaccgtgttacaatcatggaacgtgatgttcaacttgcacaaagaattcgtggcgaacgtaattaaacataaaatatttttaattcttgcaggttattataattatgatttttggcaatgaaacagatttatcttattgcttaatttttcaggaactttttagctgtgaatcattatcagatgacttatttttggcacatattaaggaacctccaatggagaaagttaagtttttcgttaaagctttgaaagacaacgcagacagtgatttgaaatcacttattgaaaataaaagaagtcgggagtttaacccttcgccactagtaattttcgactacaacgaaagccccatcaattttcgttctaagactttattcaaaacaaatcaagttgttattacaaatttaaatcatactcaataatttttttcataaacctttccaaaacagccacaataaaaccacatacagtggtaccacaaacaatattatggatgtaatgtggatattttgcatgaatctacgtagatattatatgtttaactcttgataataaaataactatcatcaaaaataaaataaatacgtgagcctacatcttttttccttttctgaagcatattacaaatttcaattaaataaatttatttaatattctaaataaaagactatctttacaagtaataattttaaagtatatcaaacaactttaaagaatacttgttggatttcttgtttgcatcgagaattaatatgactacaaaacagagaataaacggtcgaacgatgtggatttattagacggttatgaacggtttggccgttccttttcctcatgccacaaaagagaagaaattgcggacgctcaaaaatgaacgctggacgcaagaagattgttaactgcatgaactgcggccgtatggtaccacgtgataaggccataaagcgtttcatgacaaagaacatggttgacagttcatcagctaaggatgttatggatgcatccatttacaaggaatacgaattcccaaagacctaccaaaagtgtttctattgtgtttcatgtgcatgccatcgtcgtattgttcgtgttcgcaatgccaaccttcgtcacgttcgtgtaccatttttcttaaagcaacaacgtgaacgtgctgaaggtcgccaacaaaaacaagaataaatcattatttcgaatcactttcttattttatcttgtaatattccctcaattaaaatatgaaaaacttttaaatataaggtcaaatttcagggaagaatatgtaagtaatcaactttttttgaatttgaaatttcaaatgaatttcagaaatttggattttacatttttacttatatgaaaattgattgtctttatacaatagtgtaatgttgtaagaagatactgttcgttttttaattatactttcaaaatattaaaatcagaaaaacttggataaaacacaactcgattttacactgcttctaattgtcattttcatttggatactaaatttgaaaaaatttgatcatgctgcatttcgaaattttatgatactttcaaaaactttatggcttatataatttttcaaaaaaaattaatcattttgtttatatttaggaatctcatatcagattttatcaatttgtttccaaaaaatcaatttatcctagaaaacgtttaaacatctgaaacgaactttttgaatgaaaattttgtgatgtgatgcatggatgataatttgttcacattcatgaaattccttaaaaattttttactcagcagctacacccggatttgtttgtgtttgaagtatattgagtaggtggaggtaatgggtttttgactccacgtctgaaaatttgtgtagcaactctaacaaatgcttcacgaacatttgttccatcagcagcagatgtttccaaatatgtaatttgctgttgttgtgcaagctgttctgcctcagcaagagttataactcttttacttgctaaatcagctttatttccaactaaaagaataacagctgttggatcgcatagcgacctaacgtcggtaagccacatgttaacttcgttaaatgattttctttcggtaatatcaaaagcaagaataacgccaattgcatttctgaaatatgccttagcaatggacctaaagcgttcctggccggcagtatcccaaatttgtaatttaacttgttggttatcaatatcaattatagttgaatcaaattcaacaccaattgttgattgcgattgttgcttaaatgtgttttcagtgagtctttttagaagggctgttttcccaacgccactcgaaccaatgataatgaatttatagctgagcaaagttgacatttacaaaattggatatactgaccaagtaaactcagaaattgtttgtgaatgacctaacgatagagaaaaaccgccaaaaatttttatacataaaaaatgagtattttcataaaaaacataataatagcagtttaaaaatcttggcaagactaccaatgattgaatgcatttgtaataaacgaaaaaaaattgatgaatttttacttagagcaatctaaactcaagcatcttggtgacaaggaaattgactgataattgaatagaaacgtttgttttctactcaatttttatgttgtatgaatgaaactgtacacaccaataaaaatataatcaaacacatttaaatacatataatcattatcacacaactcatacaaagtttagtagtgtgataaatacagaattattatgagaaatgatcgatattttcagctgtgtgttttatcagcttttgaggggcatattttataagcaaaaatagaaaacaataatttatatttattattaatatcttatttgtattcatagggtaatgcttcgatattcacatttatgagtaaagaaaagtgtcaacagatggtgtcacttttgtctcttcgatagcaaatttccaattaaaaaattttaataatttttgaggtgcatcttcattccatcatgcaaaaaaaaaaaaaaaaaaaatcaggaaaatttgaaaaaactcattaattaaagttaaaaaaccattaatatgtatgagaaagaaaaaataaaacaccaaaatagcatagataattgtttctttttctttggcattcataactcggtggattcttgccggttatgctccagaacttgcattctctgtaataaaaattgtcagcaaaattgtgaccaaatataatttgaaaaacttcattgattatatttgactttaaatgtcggtttgtcatccaaagcctcataaaaattctgcaggcaaaagaaaaattgccgcacataaaaaggggttagaaaaattatgcaaaaataatcgtatcgtcattgacagaaacaaattcatttaaaaagtgaacaatatctgtacttctcaatgcattaatacccatttatattaatgaaatcttgtgcaaaaatcatccaaatcaatttcttttttaaaaattttaatcttttgcactctcattaatacaaaataacaaaaatttgatttctgtcatcaatgtcaaaaatgtttccacacaatttttcgaacattgaattccaatattgacgtttttaacccccgatctctattcaagatcaatggcaagtaaaatcagtgctttcttcatcatttccttgattatagctattgcaacctatgcatttttgaatagcaatagcatctatattcctaaagaaatcctgactttccaaattagaaataaaagaatccattccactaaaactattagtggcgactttaaaccatttgcagatgtagcgattccacaagatggggaaccaccttcgccaacatttaaatattatcaatatttaccaaataattcatataagtgcatagataggaaaccatttcgtcatctttttgcccgtatttttagaaaggacattacaaaggaagaactctctaatccacaaattcttttggtaggtcgtaacacagctttaggtacagctataagagaaatattcgaccaaaaaggaatttcatatttgggtttaaaaggaatcaatcatttagacttttcttctgaagattcgtataaaattttagatttaattaacataacatctgttattattgcatatcaaccaccacttattcgtcatacatattctgatggttctctttatatgaaacatatgatcaataattatactaaaggcttaatatcatatttaaatcaaaaaaatataagttatgtgttttgtcctacacaaccaatatttaaagaaactattgatattgttaaaagttataaaggaaatataatcgaaatgccgtttttgattgattctaaaggttttaaagacttagagaatccaataatgagagcaattagagaatgtaatgaagttggatatagtaacattgattattcgccgtatactaaatatcaaagtattacatctaatgaagcagccgaatatatacttcgatatcttcatgagaatcatactaatgaacatatattaataaaagggaattcgcaattaaatatcgaagaatcagtaaatttagcgttaaaatcatttggactcgataattgtaaagttaactttaggaaatattcacatgacttaagcacaacaattaataatgaatatgataaaatccaaatcattggaaatgaaaatgcaaatattgaaacaatgatcaaaaatgaatatacaaacaataaagatattataatggatcaaatagagaaacataaaaataatacttatatatcattcacgttcgcaggtcgtaatgatggatattctaaagatttcacatttagaatacaaacatttcttgatactataagttattgtatccaaatggtaccacttgtccaaatcgaaattgtattaattgattatgcaactccacgtggtaataagttattacatgaaatattaaatataacgccatatcttcataacaaaatccgatttgttatagtgccaccagaaacgcatgaaatgttagagaagaaatataatcggaaatatgcgttcttcgaggtaatctccaagaatatgggcatacgaagatgtaaaggtaaatttgtgttagcaacaaactctgatatcttatattcgactgaattatttgaagaatttgctgcgcaccaatttaatccatatataatatatcgagctaatcgatggaatatgttggaagatacgttttcgaaaagttttaagtctgttgatgaattaatacatagtatatcagatacttggcaaatattaaaattagatatggagtttgcgagtcaaatatatacaaatagatttgctatagtcgattcgtttgacgcattcgcagctaaacatggcccacgttcacctggagacttccagttaatatcaaggcgttattgggatgcattaaaaggcttcaatgagatcccttgtaacccggaagtcgatagtgtattcctagcaaagcctatgaaaatgatacaaggctttatgaggatgtataccttcccaggactcgtgcacttgtatcatgaacgaataaacttaaggagagtcccatactatggaagaatttccgctcagagaagctattcctgtataggaagatgtccaacttgtagaccgtacttggacactgagaattgggggtatccaaatgaaacttttcaagtagtattaaaatgaattcaaaagtcgggaagtgtggagaacactgttcgtccttagtaaatatattataaatttcataatttagaaatacttttgataattcaaaaagtaattcaatgaaaatacaaaatttcactcaaaaagtagagaaatgttttgaaaaagttcaccggctaagtaaacactttgtcgattgatataagattatcaaaaagttttgggtttttgtacgaaatgggggttatcggatattgaaaaaatatatacactctcaattatgttcaatatgacttcatcatttttaatgtgttgagcaaatgctacaaacggttaaggaagactgttgaaagacatagcgcattagagttgtccctgttgtaaaatgcacgttaaagtactatgaaacttgcagaacaaaaattcttcaaatatatgacataatcgagaagcgtacgtcttcatgatttcggaaacaaatcgacccagctagtgtactatgcatgtttgattaaaatttcatttcatttcgtcaaatacatgaacatgattcacttaatgataagagtaaacactattaattgctaagtaaaaactcatactacagcataaaatgttgaaaatagatcagattttgcgaaaattctcataaaaatttcagatatcgaacttttatttggattaatgaatttgtagaatgggaaacaattacatgatatagagattatctattgataatacaaaatcaatacaattcacactatttctattgacaaacgtggttcacattatgtaaatataaaaaatacaagtgtttgaattgaagataatgatttgcaatatatatttttcatatagtgaattatgacctcactgtaagttcgaatcacagatttaatttggatgtcaaatcttgcaatattaaaataagaaaatggtgaattcattcattattgattcactgcaatattaaatgcaatttgtcacactagtttattaatatgattaaaaataacatgattttaaaatcagattcattatgtattaaatttttgccactctcattttttcttgaaaaaacgatcactaggtgatgaataaagttatgaaaatatcgcattaaatgatataaaacgaaatgaacttctggtggaaattactcgtaacaatcattttttattatgtcaaaatcacaaaggatacaaaatacattcaacatgacagaggcaattcgtgatcgtcttgtgaatcttgcagcataccatcgaacttgtaaactttgttcagaatccatctctttccggtgtacgctttgttgaaggttagaacaacacctcaaaaatttcgaaatcggagcatgcttgacatttatggctaaaaaaaatcgtttcaataattgctgtgtttgttttcgaaaaatgccagccattttattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattatttattattattattattattattattattattattattattattattattattattattattattattattattattattattattattattattattattattattattattattattattattattattattattattattattatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttatttttatttttattttttgaaacatagcataagcaaaaattactataaaggtaaaaatcaaaaatatgttaacatgtattactatccaattcaaaatcaaattaataagtattcgtttatttattcatctgaaaataatcatttaaaggaatggagagaacgtttattctgttttacaactttacatatttttcaatcagtttttggtcggaactttgttgtattaaggaccccctcttaaggggtagcaaacctagtcaatcattttatcatgggatcggcctcggccgcatgacttaggcatacaattctaagatgagtgatctcatagaatattttgaatgaacaaaatgggaagttaccatcaattttccctttttatgaatcactacatttggttttaccccagcagcatctactgctagaacgattttgacattcttaaaatcattgtgaataaaatattcgaataacttttaaatactttgtaaagaaccattaaatagatccatagataaacctatacgacaaaaattcttcttttgtccatcttttaactgttttgtaacttggaaatcccattttttcgacaaaaaatccccacattgatttgccgatcattgacatttatatgtagtagctttacattgatttgtcatatcttttcgaagacaataacaaaacatgttggttcataaaacgataattttccaacgatttaattacattattattattgtcctctttgttatttgaatttgatttttgctgaagttcatctttataacttttttcaattgctcatttttcttttgcagaatcgaaatctttgcttttagattggcctcaattgaattacagactggtgaattcctgttttggaatcctcttgtacacggaggcgaaaaattactcataaatgaaataacgggttaagattttgacgacgaaatttacctcaaaatgcaacaaagtaacgtgttttcaacaatctttcaaatataaatacctcaaaacgttatgtggaaaatccttagatattatgaattttttatagataaatatcatattataaagtattattctaaatttataaatagattttcaagaccattttttttgtcccatgttctgatgttacaaattggccatatatataaatttacaaactccgatttatatagttagctataaatgaatttacagggcgccccttataacaatttatggcaaattattgtcaaaataagtcaaatcgttttgcatcttgatcggttttgactgaaaaaataaacatttcacttatgatttcataatttttgcttgttggtactcaccatctgatttcagaagttttttaaaaaacaaaaaacacaaaactaaaaatgatttactttagaacacactatattttattatatatttatcttaatcacatttgcacaatgaatttgtcttctttgaagtcatctgcaaatgggtcttcttcaatatttgatatagatattcctgttgtgaatgtgtttgttgtttggttattatcattttgttgttctgaaatttcattttcaacaatttcttcttttttatttttaattcggatcaataatataattagtaatgaaattataataataacaacaacaataacacaaacaattattatgataattgcaattttgttgtcatttgtttgaaattcgttgttataaataaatgtaaagaagttcgaataataaatataatatgtcgaataaataataactgtgtaatcataataaataaattctgtttcgatgtaaatatacgacgaattaattgtaaatagtgaaagtgatttcgtttgcatttcataataagtaaacgaatgtgtaatagataatgtgaccgttaataaatatgaaaaagatttcgttaaatcattttgaaatgattcagtaaatgtattcgattttgaatatgtattattactactgaatgaatgcggcgctgaaaatgcatttgaatcagaatatgtattacttcgactgaatgtgtgtgatgaagaaaatgaaattgttgcaatcgggctgcagtttccttctgcgttgtctttgtcaacatcgaaatttccaaatttacttcctacatatgttggatatgtgataacacttgttgtaacattataaaatgcattatctccaatttctggttctgtatctccataataataaatgcattcaagattataacaattcccaaatgctgattctccaatttctcttattccaaacccaagtgttaatattcttaaattagaacataatgaaaatgctgaaccaccaattgaagtgactgaatttggaattgtaatgcttttgatggatgaacacaatgaaaatgatccaccaccaattgttgtaacatttccgccaaatataatcgtttctaaattagaacatgacgaaaacacagaaccaccaatatctgatatagaattaccaaaattaactgaaataactaatggccatcctgaaaatgaaccactcggaatgtaataaattccttcactaatgtttataaatttcgtgatgtctttatattgaccaatttgttcaaaatcatttaaatttgttattattaatgttgagttattatcatataatatttgaaaggaatttatgaaaaatataacaaaaattaaaatatttttttgttttttcttttcgcatgttttcaattcgtaattggtcaacaaaaatttctgaagaaaaagtggttttttctgaaaaatattgacataaaccactaataacattgaaaaaacggcggttaaacgagtaaaagcattgaatttaagtggtcggtcttttttatcgttttgcatcaatgaaaaacaaagaaatttactctgggtcaaagatagattctcataacatcttttcatggtttgcattgatgtattaccttcagtcagcatactggctataaaggatttattttgggtaattgtaaaatatgattctgataattttaatttgtcattaaatatttgaagcacaactaatgtattctctgtaacagtcaagaaatctggaaataaactggttttaaaagaaaaataggaatctttgttaaaatatatcgcactctggtgatgaatttcaacgaatggatcttctgcactgcgcccatgcgcaagtccttctttgcaaaggatcttttcagatttgatatttttatagtcctagggcgaatgggctttcggtataatactgttactaaattgctttgtaatggacgaaacgagcagcaaatgaagaattctcatgattcaagacctgatatagtcgaaggccttaaccaaatacacatcggctaatacaaaagttaaaaatcatacggttaacatataagaaatttgttgttgtgaggtttttcaatttaacctgaaattttatttcaatatttaaaggcgcctacaaaaggtggcgctttaaatgattataaagtcacttttaaataatataatgaatgcacgcgataaaactgagtctggtggtcgtaatgatacatctttgttggtggtaaacatgttataagttattaaatttcattaatttcaagaaatatgaatttttaatgacatattaaacatttccttcaagatttatcatatttttaaatgaaatatatgaatgtatgtgtgtaagtactaaggtccatatctaaatacttctaaattaattggaattatatttcattgactttgtaaagttattctcgtttacttttgatggaatttcataaatttcgaaatatatttttgaataaccaaaaattcgtctaattctttaataatgcttttaatataataatgtgaagaatgtcaattaatattatagaaaacaaagagaagaaaaaatacttcagctcataaaaagtattaaattttgtgactgtgtgtggttgtgtaaatgaattagaaattgaaaatgtattcgattttgtaaatgaatgtgttgaaattggtgaacacgcaccacagcatattcattattcactggaaatgtccaaatattgttgaatatgtaataactgatgacaatatacggttctgaattgccaaaataataaaaggttacgtcattcggtgtcgctggcttcttttagttatgttccaagtgttaatatcgttaaattataacaattagaaaacgctgaatctcaatgttttgaacagaattcggaagtgtagcatttattagtgatggacaaaatgaaaatgctgaattacgaattgttgtaacatttcctccaaaatatgagcatgataaaaatactgaatttccgatatgatttacagtgttacaaaaatgaatatatgtaactgattttgcaaatgaattcatatgaattacctattaaaagtgtaaaattacaatcatcgaaaaatatttgaaaagaattcatgaaaaatagagcaacagcaaaagcatttttggctttgtttcctttgattttcaacctaagccctgaactaaaaatcgatccgaagaaactatttgatataaaccgctgttagataattgtaaacaattgaatttggaagattcaaaatattttgcaccaatgaagaaaataaaaactcccaatgtaattataatatttatccaaggtttgtagaggaaggttacgttcatcaaatgtaatgattttaaatgatttttttgagaaattgtgagatctgattctaaaaagtttttttttcaatactaaaacacgcttcgccggaatcgtacatattttgtcggagatgggttttacatttaaattgtaattagtgacatctgtagaaataatgcataaaattaataaaaattattgttaattatttcaaaaattggaaccttatcattgcgtagatggtaaatgcctctttatttctgtcctttatatataaaaattttgtgtatttgaaaaatgaatctcgaagcttcatttgagttctgaataatttcaagatgtacaaaatgagcaggaattgagtagctttcatgtttcaatttgaaatatagctgaagaccttagtcacattggttaatacaaaacttgaaaatctcacatttaaatgataaaaagtttgttactttcttgaaatttttctatttgcctataaatctttcgcttaatgtttgaaaacaacaatgataacaagggaacaacaaggtgataaccgcacttttatataatattatgaatatactttgtgttcgcatgcaaacattgcaatgaagaaacttttttgtttatgaatttatttagaaactggatgagttttgcgcgttgttctatatcgcttcgaaatataattcttcatcttgattatatcaaataaatgaggaatctacttgcttgtatattaaactcaaaaatgtaaacatttatgcaaaaagaaaacattaaatatttgtgcaaaattaatcatatgtgtttcaagttgaaatttcaacaagcatctaaaaatattatcagcaaatcataatattaatatttataattattgttatatttaaaaaattgataattaaataataaccaatgatacaaaaagagtaccaaaatttgaatttctattacaaactataaatcatttagtcaatgaaaagtgtctgctttaatataatcacattttttacctcaaaacaatattattatatataaacaaattgttaatcgattaacatttcaaatattatcatttctcattacgaatcatttcatagtttttaaatatattaattatcaaataaaaaatatattttattttacatcaaattatagccaattgtcttcatcttcttgaacaatatcttcaactaaagtattcacttcctccatttgttttgtacttgatgtagttgtatccttaaattgtaatttcgatgtcgattttacttttttgttattactttttattaagaatataacaattccaacaattattaacacaaatgcaattgatccgcaaacaattccaatcaattcattagttgtaagtccatttgtttgtaaaatgttcgtgtgaaacattgtaatgaaatttgaataataattataatatgtcgaatacataataactgtgtaatcataataaataaattctgtttcaacataagaaaatgttgaattaattatggataatgaaagtgatcttgtttgcgtttcagaataagtaaatgaatttgtaattgtcaatgtatatgttaatgtatatgaaaatgaaaatgttaaatcactttgatatgatccagtgaatgtatcacttcgactgaatgtatgtgatgaagaaaatgaaattgttgcaatcgggctgcagtttccttctgcgttgtctttgtcaacatcgaaatttccaaatttacttcctacatatgttggatatgtgataacacttgttgtaacattataaaatgcattatctccaatttctggttctgaatatccataataataaatgcattcaagattataacaattcccaaatgctgattctccaatttctcttattccaaacccaagtgttaatattcttaaattagaacataatgaaaatgctccaccaccaattgaagtgactgaatttggaattgtaatgcttttgatggatgaacacaatgaaaatgatccaccaccaattgttgtaacatttccgccaaatataatcgtttctaaattagaacatgacgaaaacacagaaccaccaatatctgatatagaattaccaaaattaactgaaataactaatggccatcctgaaaatgaaccactcggaatgtaataaattccttcactaatgtttataaatttcgtgatgtctttatattgaccaatttgttcaaaatcatttaaatttgttattattaatgttgagttattatcatataatatttgaaaggaatttatgaaaaatataacaaaaattaaaatatttttttgttttttcttttcgcatgttttcagtttgttcattaaaagtttaatttcaaaaaataataaaaatcccaaaataaaaatgttatacatcagaacttgaataactttaatgaatttgaacattttctttatgaaaatattattcattgaaaatgctaagtgttcttttaatgtaaaatgattaagtactaaagaaaagaatttgaaataatgtttaacatatgaaattggtaattctaataaagggaaatgccaatgatatttttctgcactgatgttaaatgtataggtttcattatcttttagaataataaaatttgttactttaatggatacattcgctttttcatgggatgaggatgtaaagtatatgtcctctttggatttcgaagtaaggcaagtgtaatgtttgaaagtttgagaaatagataattgatcatcaaaaatctttaaacctgaattttgtggagagatttgtaacgagcaaaagaaatgcatggggaaagccaagaagaaataacacattcgtaagaaaacttgagaaacttattgataaatcagtcaaaaaaacgatacagagagcttcaaccgcttcgcttttttagttatttcattggttaaacttttgctgatgcatgttttatagtttttgcgatcggaagatgttcacaaagctgaaactcaatattttcttataaaaagtgacagaaggttccataattaaattgtatgaaaatactgttaaaaaaagaagacatcgtccgcaaccaagaaaacacgatgaataaaaacatacaaaaagtttatttcaatacaattaacagatcacagtgaattttgaatgcagcatttctccaaacaacggtttgattttaaacctgttgaaaaatcgatcttaaccaatattgatcgttcgaaaccatagcacttttgaaaaagtgtaaaatgatttcaaaaaatttggcatttcttatttcctttgaattattcgtcaatgattcgcctcaggcgagaaattgagagaaaccatcaaaaaacatgattgtacagttattgaataattggacttcgaactgaaattttttctgtaaagtaaagaaaattgggttttattcaccaaaaaaaccaaataagaaatttcagtttaaactcacacgctacggtcaacttcctaaaattccaatgccccttgaaaatccagaagaaaattgtgtcagcacaagaatatgcacagaaaacaaaaaaacattaaatattttgtgttatgtagcagttgcaaccattttgataataccctttagggataaatttcattttgaattagttcgttcttaacacagcaaatttacattgtgtttttttatataaaaatatattaaacatattaaacattgaagaacaaataattttattttgaaatagaattgtaaccttgttattattttggcatttttacgaagtcactcgaaatcttcaactgtaggtaactatcatattcaaaattacttacattttttactcagacattgatataaaatgaaatttaaaatcatgattccatggaacattaattatgtaattgtgttcgaacaaatgctgttctaaacttcttatagatggataaagttttagaacaacgaataattttgaaaatttaatattaggaataaacgctatctatactttattcaaacattacatccattgatcatcatcttcttttgccatttctcctattgtttgtatcatttcatattgctgttctttttctaaattggaacttaacgaatcactaaactttccattaagttccgaatctgatttatcttttttactaattctaaataaccaaaccataacaccaatgatgattaacaccaaagctatagatccgcatataatcccaataagagatacactgtttaaaacaggttcatcactaatacgatataaagattgaaatacaaatgtataataatctgaataaaaactaatgattgcagtcatgtgaataattgaatattcataaaatattaatgtcgaatcggataaatactgagtgcggaaaatttgggtgaatgaacttatgtcagatgaatatattgtgagaataaacgaaaaactgagtgacgcaccaaatggaaatgaagaagtgaaagaattggactctgaaaacgaattagaattgtttgactctgaaaatgaatttgattgagtaaatgtattcgactgtgaatatgtattcgattgggaaaatgtattcgtagagaaatttagtcgaactgtagtgatatttcctgtgatatttttattatctgttggagcaacatgaatatacatttgatccacaacatcattagttgtaaatttaatagtattatcgtgagttatatttgttaaatcatgtaactcacaattagcattagcgctaaatgtataattataataagcgattcctttagtaacattaacaacaacttctgactcattgatgctttggcctgtactattatatgcaacaactttaaatgcatattgtgtaccaacatttgcttcaattgttattaaataatttgcttgatctattactatgtcattaatttctggttgcgatgtgtcaggcaaatttagataatgatcttcaaactcagtttcattagttctttgcttaagataaaatatagtgttggcaaggatttttcgttcaaaagatgttgccgaaccagtgtgacctgtttgaaccattgctgtgtttccaaatgtgttaagatagaaattatctgattcattgcagttggttgtattatattcgggggtactagcaaatgaaaaccaaatatccatgagctttatgatgcgaagtgtgagaaaaattaattgactcatcttcttctcccctattaatgaggttccatgtatacattaatagtaatccttgcttgtgaactcctattttgtcagactgtatgtaattgaaataatctttatcatgttctttaactgtaacattaaataactttcgaatagcaactataccttcgacattacctttatcatcttcaaaaccagaggtgatcgaatcatgtccagtaataaagccatatccttttttgatgtaatcactgataactccttctgctgtttctgttttgattgactagcagtcactataatcccaaaatccaaaagcaatgacatcaaaatggtacaaccatggtttgattgtacttttccaactcttttccgaaatcatctatagatttgagtgttacattaataatttgttcaccattagaatcagcaccacaagcatcgtaattatcgttttcaataaagccaccttccatccaaacttttaaagaagctgatttgggataatttgatatagaaccagacgtaaagctcatatatacttcatcatttgttaaaaaaggttcgcattcatcaatgttaatcaaagctgtaccattgatactatttgatggataaatatttaaaacatttatagtagttcttcatttgtgcgtgctaacagattcccagccgctttttgtttccaaaaatattttataataatcagtttgatttttttcttgatcattaattgtccaattgagataaactccaccagccccatttgcatatgttgcattgtattttgcattaagtattagttcttcaaaaaatatgaagaaatagaagaaaataaacatttaatttttttcaagtcccggaaaacgatagaccattcaattttgtgatgtttttgaattgtttatttatgattgaaagatccatttatgccgaaaatatttcgaaagatatcattacacatttaacaaatcaaacagcaaatcatgggagatcaatgaaagaacgattcagttatctcaagaatgaatatatttttacaagatgtcatcaaactgataaagaatgtgattgtggctggaataaatattatacaaaaatatatggtacaagattttcttgtatacatgaaattgaaatgtttaaaaaatgtccagaatatccaaaactagttctttccaggtacaatcaaatgaacataataaaaatatgttaatctgaagaaagcattaaattggtaataacaccaaaaaataaagaaataaaaattcgtccaaatgaattatatagctttactgataaacatgttgtcgaattgtctaaaggaccaaacacaagatatgctaaaattcaaatgtggaaagttgtaaatgaaatatatttcattaatcagaatgtatagaatagaagatgaaaaacagtaatagatatagtagtagataattttgcagattttaatctaaacaaagaggagtgcgcaaatgaagagaatattgcaatggagaaaaaaattgcgctaaatttaaataataactttttcaatgtataaactattcattccaaaattgtatacctggatccaggtatccttccatcggccttacaagcataataaagtctttcttagacttaaaagagttttagaaatcggttggacgggaaatggtcccatttcgttgtaaaaatacgatacagtgatttctaaacatcgatggttattttcttaagacgacgatcacgaaggttttacgtattcaatattccctatcgtaaatataaccgttgctagtggacgatagatttttttctgtagattaacgatcatttgctctttctgacaaacacaatatatatattcgaaatccggggaccatttcccgtccaaccaagaaatctccctggtgattttcctgtttgaaatttattaactctatactttcgggtgtaagggcaactcataattgaatagtttacaaaattctgcagctaaatttattggtattgactttcattcagcatcttgaatgaaaagtacacatattttcttttcttatgcagaatattatggaaagatatttcacaaaaaatccagtaatgttcaaggaataccttcaagtctgaaatttgagccggtttgttagattttaaagtatgttttttctgactttgggtatgcacaaacagtttatcttttaaatattttaacttgggcggagattgactccattcttgggcagaataaataacctcataataaaaattaaagacttttatttgttgattgccgaaattttatacggcatgtttttacaaccatggacccatgaactttttgaacgcttacgggtaaggaattaatataaaaagccgataagtgagggatttgagttggttgaacgttgatagaattgagtgggggtttgtacgttttttagaggtgggaatgggctgcgttttttccgaaccagatttccctcaacgaaataatcgtgtctcaccatcagcatttagaagcaaaagacaaaaagtgttaagttcaaatgaaggagatattcttcaaaaaggtgttgattttattttacaaggaatcacctcattgcaaaatattgaaaacatagtacccgttgtttctctttccccaacgtcaattccaataatgttaaataatttcccaatcaacgaagatcaatttattgaattacctgttgcagccatttcaattgttggtgctgggaaagtatttgcaataggtactccttattttctttcgcatgaagcacttatggatcctgaaacatccacatttttagagaatgcttttctttggggatcaggaaaaaggatgccacacatattaatatccggatttccgaactcagtttcttctcgtatttctgcagatttaacatcttttgggtattttgtcgaatcacaaaatccaatatcagatgcatcaaattctaacattattattcttcaaagtgacgtcaacgtcagtcgtattgcagatttgatcctcgatttccttcaaagaggatgcgccatttttatatttccggcgcattttaaagtgcatgaaaacatttacgcgtttagtaattatatttctgttctcggtcttgaatttcttgacaatggacttcattcagagaatgctacaattgaagtatcggattttaaagaacttaaaagttataatttttattcaatttcaaatcgatatatcgaattaattcatgggtcaccaacacttgaagaacttgacaatgtcgtttgtaagcttcgtttttatgtttccaaactcacttgttgtttttttgagacttctttaaatctattaaatgaatcatgggattatctcatgaaaactggtgctaagacagttaatgggtattgtcctaaagaagttcatgagattgttttcattttaatccttgaacttcttgcgaaaatccctgttgaatataccccagtatttgatggagttgatgaatttcctggattagtaggcgaagatactaaaacaacgagcaggaccttaaagctgtttttgcgcaaaggtaaatgggcttcgagcgggctctacttgccgccaggtcaagttgcacaaattgaatgctcgtcgcccgttaagataaaaatcggttgccacactaacgttctcttcaccaagccgggcccatggaagcgttggccagttatttcgtttgattatgaatatgacgatgaaccgttgtacttagcaaccccatttggtggtattatgtacttttgttcagatgtctcatgtgatgttacaatgatttgctcgggattcgctagatttccttattataataagcaagtgaagtcgatttgggaatctacaaagtcagtcaatgcaccgtggtcagaaattgatatgattaacttggtattaacaatacctacaaaatatgcaaagaagattcgcaatcttgataaatatgtttcaaatatgcattcactcgtggactatgttcattcattccttaactcaaaggtcaaagaagcacaccgagttgtttttgatattgatttggcatatgattttcaatcagatttcgatgcaatttttgcgaaattgacggcactcgaaggaatcctttgcgaaaccggaccaacaaaggatctcttaaacctattccaagtaattgcagaagcatcaattgaacaagacttattcgatgaagagtttaaggtcattatttcattggtagctgcatgtgcagctttcaaatcgttgtggaatgactttgagccaaaagatttcaaatctccaaatccgccagaacttttctttgacctatggcaagtgtttcttgagttcggatggaacatatttaatgagtccataaaggctttcgctgcttcaaaggaggaacataaagattcactcgatactgaagcttgggaagcttttgtgaatgagcttgaaaagagggctggaaagaggctagaaaggcttcgggataggttcactcaattagacaaacttgaaatgaatttttcagaagatttgtcagaatacagaattgttaattatatatgaataaatagaactttcggaatatatttgatgatatttttcttgattttaaagtttccagtaaatacttgaatttttttgttttgcaaaaagttatgcaaaattcgcataaaaattatacaatagttggattacttcttgaacaaaaaggaattgatgttaatgctaaagatatttaaatgttttatttaaaaattatttgaataattttatatttcatcataatattcggaaattatttaaaatattttggtaacataaaattttaaaataatatttgggaattatattaattattttatactgcacttgattattgcaaatcttgatgctgaaatagttggtttatttaataaattaaattaaattagggggtaaataatgatccctcccgttttcactcaataaaacgaattcgattttcattttgatttatttggtaaagtattccgtattgtactcaatgaccctgttaaatcgtatatatttgattttgtgttactttagcttaaactctaaatgtttttaattatatagatttagtaattttataaataaatgacttattgaagaaacttttaaattcaataaggatgataaaaacaatatttaagtaaagagttgataagtttaaaactatttctatggaaaagcattttgcattagacaacatttttttctaaacggctctttttaacggtctctttaaaattgtctttttgtcataattgtttccagagaaaatttctggcatagaaatttaacgcaacaaaaatgggaacaatttgaattttcaatatggctaaccgcaaatgtctagtgcgaacacatccataatcgaatcggaagatatacattctcataaaaaatctacatgcttggaattacttactgaacttgagaaagttatatttagtttaacaaaagaaaatttaaatcttacagttcaaaaaataataaaactatttgatacaaattttccttatacatttaatactattatatgtaatttagtatacagtgcattttcatcacaaaggaattcatttgatatttacataaatcttttatcaatgattcaaacaaaagaagaagaaattaatcagaacataatcaaaataatttcaattttcatcaagtgcatatctaaaactaaaactcacgaagcatataatataatatcacgacttattgaacaaaatctaattgatgcaaatatcaccaaaaacattaaatcgaaatattttgcacattataaagaagaatacaaaaaacaaactaatggatatgaatttcatagaatttatccatttaaaaaaccctttggagatccaatagaaagatactttatggatcattatgaagaactatcaaagaatgattgggaacttcataagaaatatattaaagagggacataatccaaatgaaattgcaaaaataattcgaaatgatgaaatcgaaaaacttcaagaaatatcatcacaaacaaaatttaatattaatcaaacaattgatccatcactttatgaaatatgttcatttattaacaaaccaaatgttacattaattgattatgcagcattttttggagcaattcaatgttttaaatatttacttatgaatggtgcaaaattagaaaacacagctaaatatgcagttgcaggtggaaatcttgaaattattcatttgtgtgaacaaaatcattcatcatttgaagatgcttatgaaacagcaatagaatttcatcgaaatgatatctttcattatatttatgaaaataaattagaaaaaattaatcatggagaaccacatccaatgccaaataatttgatctttggaaatggaatgcaatttaataataataataacaattatgataatgatataaatattttagtaagattttgtattcagaaagaaaattatgaaattcttacatttttagaaggaaaaaaaatgaaaattgataataatgttataaatgaatcagcaaaatctggaaatttatatcttgttaaatattttcaacaaaattatcaacttccaaataatgttttagtttttgctacctattcagaaaatattgaacttattaaatatatcttagaacataaaggatttaatatcaatgcaaatactattcattttattaatatttggtttattttttccatttataattaattttaatattttaatatttgttttattaatatgggatttaaattaattatttgaaattggttttattgatttggagttttttccaataattttttacatcacttctattagcaataagagataataatttagaaatagtaaaattacttttagaacaaagtggaattgatgtaaatgcaaaaactatttgttttgattatatagaaattgctttaattatttggcgtttatttaataaatttagaaattgattctttaatttagaaatcgttttgaaattttggaaatcatttttataatttggaatttaaattacaaatttgaattttatttcaatcattttttacatcgcttcaattagcagtccaaaacaataatatagaaatcgtgaaattacttttggcacataaagatatcgatgtaaatgcaaaaactgtttgttttaataattaagtaattgctttaattttttgggacttatttatatgatttagaaattgattttttaatttagcaatcgttttgaaattttggaaattatctttataatttggaatttaaattacaaatttgaattttattttaatgattttataaatcaattcatttagcagtccaaaacaataatatagaaatcgtgaaattacttttggcacataaagatatcgatgtaaatgcaacaactatttgttttaataatattttatttgttttaatattttggtatttctttttatgatttagaaattgttttaatattttgttatttgttttattaaattaaagtttactataaaaacttggagtttgtttgcgtaattcgaaatatgttttaataattgtatacagcacttcatatggcagttgagaataacaatgtggaaattgtgagattacttatagaacatcaaggtcttgatattaatgcaacgactatatgttttaaaaatttataatttattttaggaatttggcttttattttgataattagaaatttatttaaatgttttaatgttaaattataatcatttcgtatttattttaataacatttcacagcacttcaaatagctcaacaaaaaggttataacgatataataaatttacttcgcgaaaaaggtgcgaacaagaattctaaggaaggaccttcttccaatgaactcaactctttattttcaagaagaattgaaaaaaatattacaaataatcgaaatcaaactgttcttcaagtgaataaaaaggaaaacattaaaaaaaaagttgaaatgagcactcaaactcaaacatgtaaaaatcaaattcacaaatcttcaatttttcaaataaatttatattgaacgcattggagatgtaaatgttgtctcaaacctaaattgcatcactcaaaggtttatcattaaatcttatataataaatcacagttgtagaacatttttgttcaatcatatcaatattttttggataattataatcatcaaatagattatgtgttgcgattttgttgtattaaatattaaattcattaaacatcttccaatcatttgatgatggtattggagttgcagaaatgtgttgaacattgagctaataagctttactctttgaaaataaccaatgaaatttcatcatttatacattttatggtttgctattgtttcgaaaagtgaaaaatctccataagaaagaagcaacccaaaattttaataattttttgtctgttcagagggggtgacaatcacatcagacgatcaaaatttattcatttatgcacgataaaacgtcaaatataacacaaaaagtaaaggattggaatcttacaccgaatatttacgactcaaaaatctcgattatcgcacaataattgaatggtaccaaaataaactattcattttttccgaatgaagttttattttacaacaacgagttctcaaaaattgtcaatgtgttgctgaatatgagttaaacacacaacgatcaaaactgattcgaaaagtggacgtcatacaaaaagtgaaattcacgatcaaaaacaagtgtaaaagtcgctcgtttgaatactttacattgcaaaatcaaaaattaatttttctcgaaattagtacctacgatttttatttaactttagtatattcatataaatatataatatattaagatattataattaaaaaaattctaccgactaaaattgataatatagtaatttgataattcaatatatatatggtcaaaacttttgctcgaatgaagtgccttcttcgaaaaaaaaattccgacttcatccgaaagaaaattttttcaatgagctcatcaaaaaattgaatagtttatcgaatagggtttctttcatcgttttcctctcaaatccgattgtcatcccctctgtctgttcgaaataatttgaatggctcgtctactaaaaaaacgttatattctgaaatttaaatgtcactttttaagccatggctacgtacaggtcctgtattcgatttatgaacaaagactcacaatttattccgatttcatattatgcacgttgagttttattttgaggcttggtatcaagcaggtttgtaggttatagctagccgtttattaacggtcatcaaagaaaacacgtaaaagtgccaggagatgggctttcaaattattaacgttcaaagatctctacggttttcacttcacctggggcgttttttgttgtgcgcggcgcttttgtgctgagtggtagcttaactcatgaaacaataaaggatcataaatttcagaatgaatgggaagtgttactagtgatcaagaagctcgtttttgatttgaatgaagaaaatattactcaatcagcaaaatcgataattgacaaatttgaaaaaaatcatactatttcattatatttaattattatccatatgatatatactttatttgttctaaggaaaaaagattatgatatatatttgaaatttttaaaagaaattataattttagaagatgaccaaacaaaattacctcatgcattaatacgtttcatttctcttaaaaatactcaagaaaaaaattatcttatttataaattacttgaatatggatttatccatccaaaaatcacaaaagacaaattttcactgaatccatattatattcaatatgcatcaaaagaagaaattgaaaacccaattatttggtatttcatgaaccaaacagaaagagaaaaatttgaagagaattatgaagaactttcaaagaatgattgggaacttcataagaaattaattgaagaaggagttaatcagaatgaaattgcaaaaataattcgaaattatgaaatagaaaaacttcaagaaatttcatcacaagaaaactttgattttaatcaaacaattgaaccatcactttatgaaagatgttctgttattaataaagaaaatgttacattaattgattatgcagcatttttttcttcagttaaatgttttaaatatttacttatgaatggtgcagaagtagataacacagccaaatatgcagttgcaggtggaaatttagagataattcatttgtgccaacaaaataattcatctttttataaagcatatgaagctgcaattaaattccatcgaaatgatatctttaaatatatttatgaaaataaactcgaaataattaatgattttgaagaattgggtattgaatgtattgtaaatcttaattatgaaatattttcttttttagaaaaagaaggaatgaaaattagtgattcgattattgatgaatctgcaaatattggaaacattttacttgtaaaatattttctaaaagaaaattcattaccaaatgatatttgagtttgtgcatcggtttcaggaaattctgaacttgttacatatattttaaagcaagaggggattgagattaatcaaaaaatttatttgtttttgttaaaatttattatgatattttgatatttcaaaataatttttggaaattatttaaattatttaaaacagcacttatgtttgcatctttaaatggtcatatagaaatcgttaaattacttcttgagcaaaaaggaattgatattaatgctaaagatatttatttgttttatttgaaatttattttgatattataatatttcaaaataatatttggaaattatttaaattatttaaaacagcacttattttagcatcttcaaatggtaatacagaaatagttaaattacttattgaacaagaaggaattgatattaatgctaaagatatttatttgttttatttgaaatttattttgataatttcatatttcaaaataatatttggaaattatttaaattatttgaaacagcacttacgaaagcacatgaaaatggtcatattgaaaacgtttaattactttctgaataaaatcatatttaattttttttttaacaatttcaaaatgaggtcaaatggcacaaacgatcacgatttgcggctacactttaaattccatataagattatgaatatcgaaaaagctttggaagaaaatttctgagcaactataacaactgctgagctcactcctcagagaacttactattgatgatattcacggcatttaatgatttgagtttcaaccatttgatcaattttcaaattacttttgaaacttcaggatctttttatgctctgatgaattatttacaagaatatcattaaatattaatctatttctttttatcgaataatattttgattcattaatgtttttttctcataaatttatgttgaattcaacatgattcagatctagatacaggctttattctgtatagaagttccattgcttcttttggataagaagaaaaattatttttaatatttattcgaagagatttgtgacatttttttgatttaaatttttacatgtgcaaatattacaataataaaaaataatatttgagtgaaaattggttgtatttataaaagcttaaatataaaaattcaatatttttatttgagtgatatattaatcattagaaaaaaaaatattttatgtgattttgttctaaggatatattagtgaagcaaatataggaatcttctttaagtaatagagcacgagttttgcttttaatttaagcatattgttattacacataaattcacaataaaaatataaataatacaaacaaaatatttatttcggatatgccgtttgtgaaagaacttttctcaatccttcatatttacttcgaatagattcatattgttgtttataatatgttgcaagatttttgtcattcggtggttgtgctttccctttgcgaacggtgatggttggacttcgaatttgaactggtttaagttcaggattattattattattactcgaaatagcattattactattatgtcctcgtttgttttgtgtatcattgttcatagtaaatgaaagttgttgttctaactcttgaatttgtttctcaagaagttgaatttgaacggttaagtcaatgctttgatgttctaaatctaaaacatgtgaacgtagatatcgcgtatcttcatcttccgcaagcgatggtaatggtttcaatccattcgtatgaaaccgtcgttctttagttcgtggtgaacttgaaagtccagtaagtttaattggttttggaagtgaaactgggtcaaataagatagaatcattatcttcaatcgtttttaatttcttttctaaatgaatttttattttgttgtgtcaaatcaagcttgtaaaagggatgatctatcggctaacactctttgtctatatttccttataaacgtttttttatatattttgaaaattaaaatcatcttcttttgctatttatttgaaatttctctctaaattttttctttttttttttttttggttattattaataacctgatagcataaggtgtaacttggttaccaaaatataatttagaacttcaaattaattttcaaaaaaaaaaaaaacttcattaacattccttaaaaaaacaaatggatatgttcagttctattcaaagaaaaatcaaaataaaaacataaaattaaatcaaattcgcaaagtatttagtaatattgattatagtagttttgtgggatttcatttgatgaattttcatctctttgatatttaccttcactcaaatttgtggtttgttcttgtgttgtttgctttaattcttgagaatcaccatagtcgttcattacaaacgcaacgataaagaacaaatgcgttatgaaaaagaatgggatcaataatgcagtccttgagcgtggtttaatacattcatcaataagtgaagtataatttttggaattttgtaagcattctttaacaggaacaatactgactgtcatatcttgtaagataaatattacaaatgcaataatgacggtaaaccaaaataagacttttgttgcacactttgaacgacacttatttcgaacaacaagtgttataattcctaatacgacttcaactgatgatacaattattattgcaatagagaatgcaccaaaatctacttcaacaccactaccatcttcatgtctaaaaaaaaacggttctggagaataagtataccaaaagccataattaacataagtcaatactatcccgacaaagcaaatgaagccaagaaatattgtgattattttggattttgtgcatgtgaatattttctcgtttaaaatcattttaaattaattagtcacttttgaatacagaacagaatttttctgaggtttaattgatcgttaaaatcttgaaattatattttaaaaaagaaaaaaaaaaaacatacaaatatttttattaatttattcttttattctatatcaaaattaaaattttgaatctttttgttgctttgttcaaggaattctttcatttcttttcgatcatatttaatttgttcttcaatagttttatctaaatattcttcaactggaatattttctttaataaatggatttaatattgtactaatttcaagaataatccctgtgactgttttatttcgatttaatcgttcaatccattgattaaatgatttagatttaataatccctttattaaataaaaaaagaatatgtaaaaaaattgtaatacctttttggctcgtaattatgacgacgaaaatatttatgaaatcgttttaatgtatgaatttggatattatcattgttatctcgaataaatttttgaaatattggtaaatatccttcataataatatttaatttcttcaaatcgttttttatcaagttcaagattcgtaatatcttcaaattgttgtgttaatattttatcataaagatattcgatgaaaggatcaattaaactttttaagattcgtttagataaaaaaatactttttaatccaatgttttcaatataaataatcgtggtgtgaatatctttaataccttttaaatattgataaataaatccataaataattaaatatggaacgaaattactaatatcagtactaattaaaagtcctggaatttcttctggataacgaaaaaaacatgaaataaccatttagtttgaaataatttgtgtagaagataaaatatttcattcgatttaacaacactatgaatacttgcaataagataaataattaaatattctgaaaaaactgatggacgaaatattgatatcgatttacgaactgatttatatgatatcttttcttgaataattaatgtagtaagtaattctaaaaattgtaaactcgtgggaactaaataaaataatttactttctgaataaatacattcttcaaatatattactaataacattaataagtgtattactaactatattaggaaaatttaaatttgaagaataatttggatttaaataacttaatattgatttatgaaaaacactgttctctaattgaataacttctaatattgcttgcgttaaaaaatattcaatagttcgttgaaataatgtggtggataatatatttttattaaaaaaacataacttaaaaaaatgatgtttgtgtaagatcttctggaataggtaatcctttgtttttaagtttttgatattgttcttcaatattaaaggaatgttcacttaaaaaaagatgatattctccacttggaatatttcgtgcaaatgacaattcaattgaaatacttcgttctggtgatttaagtaaaatattatgattcggtgaaacttgaagaactgtttgacaaacagaattaacttcataataattatctttttgatctaatgtaattataaatggttcgttacattctgatgatttaattttaagaaatgttggcattgatttttctgtatatggatcattcctttctttcattattattgtggatgttaaataaacggtctcaaaacagaatttgcaaattcagatcgagaaaatcgaaggattgatcatgtatgcattttcattgaaatgccacacaaaattcaaaaaatatggtaatataacacaaaaaaaaatttacactgcttttaataatcatttaaatgttttggcatttcaaaacccttttctctttcaaaaacttcaacaaatgacctcacctacatttttcgaaaattaataataataagtaaaaaaaatttaatggataatatgcgaacgaagaatgaattcaaagaaatgaatttctactaaaaaagtatttgaaaaagtatgtttgcattttgatataaaaccgtaaatttccaacaacagataacagaaggaaaggaaaattttctttacattcaatattgtacatcagattttcctcgagacatggggcttaccattcgaaatttcactgatgtatctttttcagcaaaaagaagtttttattttgatatagaataaaggaataaatgaataaaaatatttgtatgtttttttttttttgaattaatataaaacagagttacttcaactcccaaaaaacagatttttttttccattccatatgtaagcattccatgattgatacaataattaatattttaaattaaaaaattttataaactcatgaaatatattttttaatcgatttttttaaaatttattttttccagtcacccatgattaatttatgatggattttatatcgtattgatttgacaacctgatacccaccagggaaaaaatattcattcaaatttttcatcagttcccattttttaaaaaaaaaaattgatgtaaaaaattatataaagtggtgacctggtttattttagatatttattttcagcacaacttagaatcgttgttttagaaattatataaataaattttattgaaaaataagaatgaaaatattttataatcgaaaaagtgtcgtaattttcaaaatatgaaatttttgcaataaataatgaaaattaaaatataataaccaacacaatcgaattctattatgtcatcgtattataatatatatatatcagaaaataataaatttttattttcattcataaaaatgaaatgatcatatatatttatatgtttttaatattttttcactttgatgataacataatatgttgaaaattaaatataaataattttgttttataacataatgttgtagatatattttcattttttaatttttgatgaaaaaattatgagtaatagtaatcgacacgaagtgacgtcacttttgtattcgacacgtaagttttatcccaattaaaagtgccaatatgaaaggagtttaaaaaaattttaatatcaaatttttaaaaactatcaaaaattccgaaaattattacaatctttcttaaaatattcaaaaagtacatttggtcatcaaatatgatagaatcttataagttcagatgaatggaaaacacaacattagatgaatgggataacacgactgatacttcagaaattataggtcctgttctacctaaaaattgggaaatgtcgattaacttacaagagacttccccttctgatatacaagaaatgttcaagcaaaatgttggtcattattcactcacaataacgaaggtctttggccaatttgaatattgcgatttttggtgtcgttttggaggacgttgcaaaacaaaaaaaaaaccgtacgctaaaacaatatgatcgcaagagcttcataagattgaaagttgatcataatttatcaaaagttatgtttgttgaaggcaattttcgacaaaaacatccaatatcacaagatttctataatagttggttgggtccatcaaattctacgcgaaattaatgtataacttacactaaacaacgagaaaatgctgcataaatcagaaggaaaataacataatctgtcagtgtccggaaattttatgatatcagaagttcttatttaaaatcaagaaatgttgatacaatcaaatcaatccaatctattattcaacagttatcaaataattatgaaacgagattacatttgaacagagcagataatcaaattctcacagcaacatttgtttcaaggaggtttaaaaataaaataatatctatagatatattgcaaatagataacataatgatgactaatgattttgatatgcctattctaaatttcttattcattgatgagaataataatccacagatactagcattttcaataatgtccagtaaagaaaaggaaatatttaaacttgtatttgatgatataaaaatatagttggcataccaagagttgtaatcattgatagactaaaagcacaaaaagcagtaattgaagaggtaatgttaaatactatgattgttttttgcaaagttcatatgatgagatcagttgaacaaacatttggtcctcaatctataatatataagtcatttcataaattcattgaaaatcgaatatatcgtaaatgaatatattaattctttaaatcaaaccattcggagtactgtcaaaaaaatacaagagctattcaagcattaattgatgatgccgattgttatgatcctagtttcttattttctggaaattcgagagaacaaagaacgactaatgcgattgaaggtttaatggtaatatacgggaaagattagatgtgaaaagagatattgagattattataaatatattggattatttatctacagaatttgcttggcgaagtgagagaatgctcacagaaattgacaataatatttataaagataatattataggttcagtagcagtaaataaattgaaaaatgtagtcgaaattgctaagaaaactaaaaaacaaataatggatggaagagctaatatcgaattattgtaatgtattaatgagaagaattgcaaatgtattacaaagattgaatatggtctcccttgtgttcatgaaatcattaatcgtttaaataagcaaatcccattaatatcacaaaatgaaatatatgagatttattttaaaaaattgtaccaaatacaggagaacaatttatttataaataaaatcataaaacatgtaattcaagaaatacctcattatgatctgagttactactctttatttacaagagcattcgaagaaattgcttcagttgtataaataaatgatagagttaaagtactagttcttaaattatatgattaatctaaagatataaattcaaatttattctctggaagaaaaaagacaagaccagcatattcaataagaaggtcaggaagatatagtcagaaaagacattattcatgcagtatatgtggaagatcaggtcacaataaagcaacatgtccaaatctacatgaagagaatataaacgaaaagttaacatttaaagaagaaaaaataaatgaaaacaatattttagaaattgaaaaaaaataatagaagacaactattcagaaatggaagaggaaagcacaagaattgatattaatattgaaaatggagaaatgttggtcaatttaacacctaaaaaacttgaaatattagaatcactgtcatcaaatcaattaaagctatttcaaagataatttgtttttcatgtgtttttgtttgctataggacgaaaagaaaatccacgagacatagaaacactgtatggaatttatcatattcaatggaaaacaataaaagagattatacaaaatcagtttatggatgtctcagatgaaataggaattatacaactaatatatataataaattatggtaaaaaattagaagacaattttatgttaaatcataatatatcttaattgatattatatttagaaacaatacctgattcactataataaaaattatattaatttcacatttgtttaataattcataaaaacatatattctaaatgagatatgattaaaagggataaaagaaaatagttattatccatcaattccacgaaattgtcgaagtataatcaaaatttcattttatttatgatcttgcaactaagaataattgacattttattatttattgtgaaattcttgataaatgacattgaattatcataattaactttcttcaatcttcctaaaacatgtcgattttttttaatttcctcatgttagcacttttaattgaaaaaaatttcgtgttgaacgcaaaagtgacgccacttcgtgtcatttaagattccccatattatgagtcttctatttatatttagatttttattcgggatcaattacacaaccgcagaccaaatctccaaatcctctcaatcgattttttaagggtaaatttcgaacgataggaaacgatcccgctttttcaaagaaattatcattctttcaatttgattttcaataaaaatataattgacacgtgttttaaatgaaaatagaaaatgaaaaacggtttgacaaaatataatccgattaaaaaacattaaaaaagtgatatatgtcataataattcattgaatactttatgataacaactttttgaatgagttgttttacacatgtgtgcttgtttgtgatgtatggctaccatactaacttttaagatacatatgcataaatcaagctatattttgaatacttaaaagatcaagaaaaatatgattgacaatattgaaaaacaaatcatgaataaaaattggaatatgaataaaaaatgtaatatgaataaaaacaaatcatgaaaaaaaatgaaatatggataaaaaatgaaatatgaataaaaaatgaaatatgaataaaaacaaagcataaataaacaataaagcacaattaaaacgaaatataaataaaagtaaagcatgatcaaaaaataagactcattaaaacaataaaaattataaataagaatcaagataaaaattgattttttattcatattgaatatctctaagtgctattagaaaagcattttacaaattttctttgttttgttttagccaaataaatctaaataaataccctccaatatatttttgatttttataaactgaacacagtccacacttgataccattccatgtttcctcaatggtattggtatgtattccttcatcggatttaaatccttcggaatggttcacttgtttggatgtgtaattacaatttagatttttgtttaaatattcgattgctggcatgtatgcactccaacaatctgtatatattattgatcctttttctacattaaaaaaaattatattagataaggtttcaatgtttctactgtttaccttttgtgcgaatagtttcttctctggagttctctcaactcctcccactacccatgatccttctactggatgtcctctatggtgcttatttttccgaatttactttcatctatctcgacgataatgttttcaccaccaattttctgtaaattatcctttatttgaaatgaaattaatcgatcaaactcatgataataattacaaattgttgtaaaagaatgtcctatttgattctgtacagaagttacattgattttatttatccaattatataaaagacgcattatttcgttaattggcaaatgacaattgtaaagaaaagtattttttgtaatagaatatgtttttcgacatctaggatttgtacatctaaaaattatgaaatgcctggtgcaagtgcctttgcaaaaatcgcatgtatatgtatcaggtaaaacattgtaaaattggagatatctgattgcaatttcttcattaacaaaaattttactaatttcatcataaaaggaaatggatttttgccttgattgatgttgttgtaattgttcttgtgtataatcatgccgtccttccattgttttttaagttttatccaaaaatatacgcattctcatatggtattcaatggattattgtgacatatatcacttttttaatgttttttaatcggattatattttgtcaaaccgtttttcattttctattttcatttaaaacacgtgtcaattatatttttattgaaaatcaaattgaaagaatgataatttctttgaaaaagcgggatcgtttcctatcgttcgaaatttacccttaaaaaatcgattgagaggatttggaggtttggtctgcggttgtgtaatcgaccctttatttgaatccgactgctagttttttttaatttgtgattttattttaagtgcttcttgatgaaacctatcaaaaagcttttatcatttatctcaatttccattttttgaattgccgatcatgtaaaaacgttttcattcaaaatattccgaaattgtgtaaacaaattattttttattagagatagtaatcattatttgcaatgttgaattcaacatatatactaagaaagggagttccaagggttcgaaagtggtagtttccgtagatttaatatgaaaaaaattattatcaattattgataaaatttcacgaatggtattcaaaaagggaaaaataagtttgaaaataagtaagtgttactttgtatatttgaacttatcgccactaaattttattttaaaaatcaaacaattcttcaataagttcattccctgcaaataaatcgtgcagcacgaatagatcttgtggattaatatctattgtttcatttgggaaagaatccatctccaatttctttttcaaatgattgttaaatctatttttaatcccgttgttagtccttttatttttaaaatgttctgcaataagtgaccagttaggtccgtatcttctgtatagatagagaataagttgatcttcttcctcagaccatggatcttttgatagtcccggtgctaaataatgctgatatctatctctacattggcgacatgttttgcctggtatagattttgcaatttcttgccaatttggaaatttttcatttccaactaattcaatgagttgtttatcttcttcttttgtgaacttatgcttaattatttttgctctcttgtaaggcgcttcttgggagatatatggttgaaaatggacacagttttggaacgtcatcgcaatttgttatgtgataaaaaatgtctaaaaacattgaatgcattcaaccacagaacatgtcacaactggaaaacaagcactcaaaaatcgtactcaaattcataaacaacaggttaatcaactgttgttgttttgactctttcaaaatttcaattcattgaataaatgaattcattcaatttgggtcataaaacatgtcacatttgtaatcattttaaaattaaaaacatgaatatttaatcgaatattcaaatctacataataaaacataaatttaattatcacatatattacattatctatgtttatcaaaatataaaagttatcgcataataaatgacaagatatttatatttgataaaatgcattttattgcatttatttaaatatcggtttgactctaacctcctaaatattcgattgaatttacaattatttgtgcgaattatgaggtacacatactttcaatcttccctcagacatatgatttttcattcgcttgaatataaatgtggaaaaaagcattattttcaatcgaaatcataagatataatcgatatagatatagaacattttttgtattactttcgatttacttagtttactaactctattttccctaatttcgaatgagccattatgaaaaaatgctttttttattctgtaaactttcacaaagtgaatagcataagttatagtaaaaatgagataataatttttccccatacaagttggtgataaactcgcacacgtgcatttgcagtctagaaacattggtgtcacaaatttggtgacatgataagcacaaaattcggaacgtcacccttaaaccctaccagtttaatcatcatagctttttccatacgatattatcgtgtgtagccgttttttgaattaaccgttataccaatccaaccgtagagtgtttttaaagaaacatttatataaactattcaaaatatttattgacacttttaagaagatatcttttaacggtccccaatagctgttcggagatgaaattcgttgttacttccaaaaaccaaatgaaaatagatgccgtcaaatcagtcattcaaaaaatccttggaagcaatgatgaatttgttgttgaaggaatttcttcttcatcagatgtttctgaacaaccactttctcttgaagaaacaaaacgaggctcagttaatcgcatttataatgccaacgtagatgatgccgatttttatgttagcattgaatcaggtgttgagcgggagtttgattcattttatggatttacatttgcaacagtttgcgataagacaaaaaacaaatttggatttggaatgtctactaaattcccaattcctgatgatgtttcattcggtcttgaacaaggaaaatctctctcatcaatttctcactccgaaaatggccttatttccattttaacggacagttttattaagcgttctgatcttgttgaagaagccacatgcactgcacttattccatttcattttttcccaatttcatttccaacaaactctccaccagaactcacgcgctttatagacagcatcactcaagtcgagaagaacaatctagcatctcaattacgtcaacttgatttccgagatcaaaagatagttgattcctctaccacagcttcttctctttctgttgtggaaccaccagctgactacagcgaagtttccgacgacatatttgataatggagtcgaagccatcaaagcgggtgaagtggcggttgtcatcatgtcgggcggtcagggaagccgtttatcagctccagttcctaagggaatgatgcaacttgacattccctccaactcgagcttacttgagcttcaactccaacgtgttcgtaatctggaacgtaagtactgttcagggaacacgtgtattcctgtttatatccttacatccgatgctacacattcgccattagctgcatatcttataaagaatcaaaacttcggagtgaaacatttaatgcttgtcaaacaaaagacgcttccagctcgttcagctgatggacattttgttctcagcgaacgatccaaagttctcgctgcgccaaatgggaacggcgcagtctttgcatgtcttaaagactccggtgcactttcagagatgaaaagcctcggagtaaagtacgtcgatatccatccgatcgataatgcgcttgcgaagcctgcagatccatcgtttgttggcgcaatgatatatgaggatggcgatgcagcgcttaaagtcgtgcggaaagttggcggcggggaaagaatgggaacagtctgtacccgaaatggtaaaacagctgttgtcgaatactcagagctaccgcaaggacaagcagagcaatacatgtacggaaacacagcaatgcatttgttcgcaacagagataatagagaaagcggcagaagccgagttgccatatcatgtcgcgataaagaaggaaaaggtggtcaatgaaaaaggtgatatagtagtgggtgaagtgaggaagttcgaaagattcattttcgatgcattggaactctgcgaaagagtcgttctatatgaagtgaaaagagatgatgagtttgcgcccgttaagaacgcgcagggtgccccggtcgatagcccagaaaccgctaaggaacttttgcttaaacttcataaaaagtgggcaattgataacggggtggtactaaaggagaacggtgtaatagagttcagcccattaacaacttacgcgggtgaagggttggaatacttcggccttgatggaaaagtggtggataagccaatggtcatttgaataataaaaattgaatggcaaattcgccgattttgattttatggaatattccaataattggtgagtttggtctcatttgaaacaatgtaaattggtattcattaaatattggaatataattttcgtatggataaaaattggtaaaattagctagaaacaagctttttctagatataaaacttcatgttgtatagcaaatatttaacttcatataaatccatcgatcgattatcatcttcattaattgcataattttttttaataattacaagaattaaaacaagaattgcaattgaacaacatttaatacaaataaaaatttttgttgtgatcttattactattgcttttatttttattactattatcaaatttgataataagttgaataaataatattaatatattcataataaataattttagtgaaaccacaataaaatgatgatttaatcataaaataattaaggaattccatgtgtgaatataaggtgttgatttgtattcatcaatcacatcttaatttgcaaattttccgaatatattggttatataattgcaaatgttattaaaacattcactttcaattgttggcgaaatgtctccatataaacaaatgcattcaaagagagaagaactatataaaaatcgccacttccaaaatttttcactatttctccaatgataatcgtttcgaattgtttgcgtgagtataaccatcaataatattatcatagaaatggataataaaagacttttaattatatatttccattttttccatacaaattcaataactgcatttgtacatttcgttatcaaataaatactttatgaacaagtgcatattttctctatcgtaatttgcaaattctgtttttgagaccgtttatttaacatccacaataataatgaaagaaaggaatgatccatatacagaaaaatcaatgccaacatttcttaaaattaaatcatcagaatgtaacgaaccatttataattacattagatcaaaaagataattattatgaagttaattctgtttgtcaaacagttcttcaagtttcaccgaatcataatattttacttaaatcaccagaacgaagtatttcaattgaattgtcatttgcacgaaatattccaagtggagaatatcatctttttttaagtgaacattcctttaatattgaagaacaatatcaaaaacttaaaaacaaaggattacctattccagaagatcttacaccaacatcatttttaagttatgtttttaataaaaatatattatccaccacattatttcaacgaactattgaatattttttaacgcaagcaatattagaagttattcaattagagaacagtgtttttcataaatcaatattaagttatttaaatccaaattattcttcaaatttaaattttcctaatatagttagtaatacacttattaatgttattagtaatatatttgaagaatgtatttattcagaaagtaaattattttatttagttcccacgagtttacaatttttagaattacttactacattaattattcaagaaaagatatcatataaatcagttcgtaaatcgatatcaatatttcgtccatcagttttttcagaatatttaattatttatcttattgcaagtattcatagtgttgttaaatcgaatgaaatattttatcttctacacaaattatttcaaactaaatggttatttcatgtttttcgttatccagaagaaattccaggacttttaattagtactgatattagtaatttcgttccatatttaattatttatggatttatttatcaatatttaaaaggtattaaagatattcacaccacgattatttatattgaaaacattggattaaaaagtatatctaaacgaatcttaaaaagtttaattgatcctttcatcgaatatctttatgataaaatattaacacaacaatttgaagatattacgaatcttgaacttgataaaaaacgatttgaagaaattaaatattattatgaaggatatttaccaatatttcaaaaatttattcgagataacaatgataatatccaaattcatacattaaaacgatttcataaatattttcgtcgtcataattacgagccaaaaggtattacaatttttacatattcttttttatttaataaagggattattaaatctaaatcatttaatcaatggattgaacgattaaatcgaaataaaacagtcacagggattattcttgaaattagtacaatattaaatccatttattaaagaaaatattccagttgaagaatatttagataaaactattgaagaacaaattaaatatgatcgaaaagaaatgaaagaattccttgaacaaagcaacaaaaagattcaaaattttaattttgatatagaataaaagaataaattaataaaaatatttgtatgttttttttttttttttttaaaatataatttcaagattttaacgatcaattaaacctcagaaaaattctgttctgtattcaaaagtgactaattaatttaaaatgattttaaacgagaaaatattcacatgcacaaaatccaaaataatcacaatatttcttggcttcatttgctttgtcgggatagtattgacttatgttaattatggcttagacatgaagatggtagtggtgttgaagtagattttggtgcattctctattgcaataataattgtatcatcagttgaagtcgtattaggaattataacacttgttgttcgaaataagtgtcgttcaaagtgtgcaacaaaagtcttattttggtttaccgtcattattgcatttgtaatatttatcttacaagatatgacagtcagtattgttcctgttaaagaatgctacaaaattaaaattatacttcccttattgatgaatgtattaaaccacgctcaaggactgcattattgatcccattctttttttcataacgcatttgttctttatcgttgcgtttgtaatgaacgactatggtgattctcaagaattaaagcaaacaacacaagaacaaaccacaaatttgagtgaaggtaaatatcaaagagatgaaaattcatcaaatgaaatcccacaaaactactataatcaatattactaaatactttgcgaatttgatttaattttatgtttttattttgatttttctttgaatagaactgaacatatccatttgtttttttaaggaatgttaatgaagtgaaaattaatttgaagttctaaattatattttggtaaccaagttacaccttatgctatcaggttattaataataaccaaaaaaaaaaaaaaagaaaaaatttagagagaaatttcaaataaatagcaaaagaagatgattttaattttcaaaatatataaaaaaacgtttataatgaaatattgacaaagagtgtttgccgatagatcattttttttttccttttttttacaagcttgatttgacacaacaaaataaaattcatttagaaaagaaattaaaaacgattgaagataatgattctatcttatttgacccagtttcacttccaaaaccaattaaacttactggactttcaagttcaccacgaactaaagaacgacggtttcatacgaatggattgaaaccattaccatcgctgcggaagatgaagatacgcgatatctacgttcacatgttttagatttagaacatcaaagcattgacttaaccgttcaaattcaacttcttgagaaacaaattcaagagttagaacaacaactttcatttactatgaacaatgatacacaaaacaaacgaggacataatagtaataatgttatttcgagtaataataataataataataatcctgaacttaaaccagttcaaattcgaagtccaaccatcaccgttcgcaaagggaaagcacaaccaccgaatgacaaaaatcttgcaacatattataaacaacaatatgaatctattcgaagtaaatatgaaggattgagaaaagttctttcacaaacggcatatccgaaataaatattttgtttgtattatttatatttttattgtgaatttatgtgtaataacaatatgcttaaattaaaagcaaaactcgtgctctattacttaaagaagattcctatatttgcttcactaatatatccttagaacaaaatcacataaaatatttttttttctaatgattaatatatcactcaaatataaaaatattgaatttttatatttaagcttttataaatacaaccaattttcactcaaatattattttttattattgtaatatttgcacatgtaaaaatttaaatcaaaaaaatgttacaaatctcttcgaataaatattaaaaataatttttcttcttatccaaaagaagcaatggaacttctatacagaataaagcctgtatctagatctgtatcatgttgaattcaacataaatattagaaaaatcttgtatataatttctcaaaagtattttattcataagaatttattcttttaatgctgcaataaacgatttaatatttaaaataaaaacgaaacactcgagaacacattaaaatttcccattaaataaatgtaaatcatgaaataaaaacattttatcatttgttaatttattgagtactttcatttttgtctttttctgtcttttcatcttctaaaacatcttctgaatgattttctttattttgtgctgcatcttctgcttctttctgttcattttcattatttgtttctttgttttctgtcatttcttctttcgatttattttcgatttgaacattttctggaggaggttgagttttttgttgagatatctgtctagtctttaaaattgcttcaattttgttcagcctattcccgatggctattattcgctttttggaattttggattcgatcaacacaaatttggagatgtttcatcccagatggatacattggaagtgctgttaattgctttatcatgttaatgtcttcttgtaatttatccgctgctgctgccaacctttcttgactttgaaatgcatctttccaaattccttgtgctgcattgaaaaaatgaagaagtttctgatctaaagctttagccttttcgttctcttgtgaatttatatgttcatcttgttttactactgtttcactcatttttttatcagataaaattcacaactactgtgaattttttcactgcttaggacccaacaaatggaatttgttgatgaatctcaaaatttcatacaatcaagcgaaaagacagaaatagaaacagattcatcaaatatagagatgaaaaagcaaaatattattaaactaagagaagaattaaaatggttaaaattggaaaacttcgaaagtaaaaagcaagtaaaggaacttgaaaatatgataatgcaatacgataatcaagcaagtcaacttaaacagctttcttcaattttcgaagatatgatatcaaaaagtcaatttgatgataaaaatctcaaacagttaccgaaggatatgaaccgagcaattcaagctaaggtcaattccatttttgatattgttttacatgagtattcgtcatatgacataaataaattagaagcagaatggaaatctcttaatgatcttaaactctccctagaaaaagaaatctctattttatcagaaatttcaagtaacgaaagtttttttgatgatgatcaattatcaatttacattgacgaatttgaaaccaaaatgtcctcaaacgacaactgttctcctatttcttacatactatttagtgagcatatcaaatctccaaagatatatcatcattactttgaacaagataacacatcatcttcaccaacatacaccaacattccaatttctgatgctgtttcagcacatgaaagcgtcgaaaagtcaatttattcatcacaaattcgatttttctctcagctcaaaaatgcacttttacgtaatgacaaaacaattgaagaaattcctcaaattgacatcaatcaatccatgaatgaaatgatgtcatttgaaataccacaacaagagctctttaatgcatgtgatccttgcgaagtacttctttctcagttccaaaatttctacgaaacacttcaaaatcaaaacccgccaaacgaaaggttcaacctcatcaaaggaaatttcgaaaaggagcttgaatttcccgagtttgttccaccaccaaaacctcagtgtacaatagagcaaatcactacaaataacgaatcaaacaaatttttgcattcgcaactcaatcaaatgaaaattaacgcatcccaattgaatgaaaccgcatgtaatgtacagaaaaacgaaattgaaccaaattcgacgaccgtttatgaaaaagaagaaaattctttttcatatccaattccaattggcgataatgaacaaaatgatgatgaagtaatcaagaatttccatgatgtcataaaagaaaaaggtgttgaaattagtgaggactttcaatttgacataatagaaaaaaatgaagaaattgatatatcagaaaatacttcaaatgaacaaactaatacaggcattgaagcacgaatgaataagcttcatgagattctaactcaacaatcaaacatttcaaatccaaaatttgaaacagttccactgattccaacaactttaattaaaacagaaaagtacaaaacagatccgattttacagaccataaatcaaattctcattccaaatcagtatgatactgaaattctttccaatgagattgataacctttctcaaagaattgtggatatccagaacgcccttgcagcagcatcatcagaagaaacattcgacgactctgaacttgtcagatgcgaattcgaagcgaatgagcttatgcaaaaagtggcagccgaaaaggaaaaatttttcctcgaatcagctcagagccaaataacagagctttctgaaaagaagaaacaactacaaaccgaactctcacatctcgaaaaagaactaagtgctattgatgaatatacagaagaatcaattactgatcttgagaaaaaatatcaaaatgctaaaatagaatataacacaaagaaacaagaatgggaggaagagcaaaaactaagggcacaacttcatatgggatttgtataaagtaattagagatacatcggataaaatgttataatattatataaacttgatcttctattttgtttgtaaaattaaacgtttttcctgttattcttttctatcattgcatatttctttttttttgacgaactgtacaactgtaaaatcccccaaaaataaagttttcaaattatcatttgaaatatcaaaaagttatcacattcaataattctgtgcttaaacagagttcacaacaaatgtttttgtttattcttgggtttgcagtcaagtttaaagaataacattggtgtcagactccttgcacagcaagtgtagaaacagttaatgacgttttcattggaacacataaaggatcaggtagttattctttcaacacagaaacatacgaaattaattctggcgctttgttaactcttgatcttgatgctaagttttcaacggagcttggtttgtatgttattcatctgatgagaatgatactcacctcacatcaatatctcctggtacatctttgtttatatcaaaagaatctcattactcgcatacatttttaactccaaaaggaacaaaatatgttcgtttcaattttgatggaacaggtcaagaatcatttgagattcgtaattttgagtgcaacattcgtagttactataatttgccagattctcctaattttagtattgaaacagaaaaaatcaaaacaacaattaatatcgatactgcaataatgcaaatttatgataaagtatcaaacaaaacatggcaaatcctagctaaatccatagcaggaaatcctttttttccttgttaacccagttaaaacaggtaatacgaaattagaatttgatatgggaaatttgaatatgacgattattactcatatcacacttgagctttcagatgatgaaatgaaactaactttctcacgtgatccacaagcaaactttgatgataatttaccatattggcctctttttcaagcagacaaaaatgacaaacattttattccatatggagaaggaattcttatatatgctgacattaatttaaacaaagttaaatgggtaggagcaggtgttaatggtttatcaatgccatttattggaactacaaatggtgaatatgcgatgctcacgtatattgaaacacaagcagatgcaggacgtgtcggacttcttaccaatgatgatacatatacaacgattttatggagttgggaatcagaaaaacataaatggggatatgatcgaataattcgatattcttttttcccaggtaatcatgtaacaatagcgaaacgatatcgaaattatgcaaaagaaaaaggattagttgtaccctttactgaaaaaaggaaaacgcgtccattaattgataaatttatagggtcaggcctaatttattatgaaagttttcaacctatttgggaagaaacaaaattattaaacttaacaaaagaaatgcaaagtttaggaatggaaaaacttgtaccaaatcttatacttgataattcatggcatgatgaagaacgaaatgtactttatgaaatgcaaggagtacttacaagttcatatgaactattttcatcagtaaacgatcctgaatggattgaaaaaggatggactggatcaatttataattgtccagaaacatttccagatgccgtacaaataaatgaaacaggacaatttgttcaagatacatggccattatataatcgttctgaagaatgtcaacatgttcaatgtcctttagtttatgcatatgacgtctgtcaaaaatcattaccgagttatgtacgaaataaaattgaaaacgaaatgaaaacaacaaaaatcggcgctaaatatcttgatactcggaaggacctacagaatgttattcaagtagtcatccaatgacaagaagagaatcatctaaagccaaacaagaacttggaaagataatgaacgattatggatttgttgtatcgactgaaggtggtcgagatgaagctgtaccttattatgattatttacaaggtttaatgacttatggccaacatagaataattaataatgatccagttggttcaattccttcgaatattcgaaacgtattattcatttcaatataatgaaacaattcgtgttcctcttttcgaattagtgtatcatgattgcgcagcagctgcttggtattctgaagcttatatgatggttccttattttaataggaaaagagatttgttccaaatattaactggaacacctccaacttatttgtattatgaagataaatgggaaaatgaaaaatatgaatttgctgaacattttaaaaatggtacaaaagtgtttaatttaactggttatgcacaaatgattgatcataaatatttaactaatgatttaagggttcaacaaacattgttctcgaatggagtaagagtaacagtgaatttcggtgatgaaccatttaatggtattcttgctaatgatttcaaaattgaagaaaatgtagatgtatgtggttacgatattgatgaccaattaaatcaggctgatgattcaaaatggtggatagcattaatcgtaataggaattttagtaattgtcgcaattgtagctttctttgtatatagaaatatgaaaaagaaagaaaagaatgacagtggctcagtggatgtataataaataaaaataatatcatgacaaaagcattattcaatgtaaatgatggatgacaaaattagttttaattattatgtttatataaataaataaaattaaattaagatataacactgtcaaccaactttccctctcatagattacttttaaattttaaaattatttgtaatgtatctaatacatatcagattttaacatataaaaacagtagacatatttttatgaagatataataattctttcaaaatttcctttgaatttagtcactttccattcaaattcgtgtacgatacaatacacaaacggtcattaaagactggatgtaccaatgaaccacatctcaaccagtataaacaagtattgttaaaggaatgtttaaaatatttttatcttctgtttaattttgtgattgttgaccattaataccatgcggacagaaatttccggccgatggacagattttcgtgtccggtactgtatattctgggtttttataaagtttacaacgatgagatttaaaatattaaatcatatgtttttattcaaaaataaatacagacgagcgccacttcgtataaaagttgcatttgcataaatcttggagaagttgtttttttcatatattttcactttttctcaaaaatttcaataaaattgatcaagataatagtttagaaaataaacatatttaacatacaacattactatattggaaaacttccaaaattcccaaaaaagaatggtcgaaatcatatcgaatttggaaagatttcatgaaacgaccgtttacttttgaaataaatgagatctaattatcttttgaattgtaatatttttcaaaaaaatcataccattttaataataacaataataaataataagaacaaaaaaaagatttagttaatatcatttcctttgtattcacgtagtaatttaactatttctgtataaccatttgaagatgcccacataagtgctgtttgaaataatttaaataattttcaaatattatttcaaaatataaaattattaaaataaattttaaataaaacaaataaatatctttagcattaatatcaattcctttttgttcaagaagtaatttaactatttctgtatgacctttttcagatgctaaaataagtgctgtatcaaatattttaaataatttccaaatattattttgaaatatgaaattattaaaataaattttaaataaaacaaataaatatctttagcattaatatcaattccttcttgttcaagaagtaatttaactatttctgtatgacctttttcagatgcccatataagtgctgtatcaaatattttaaataatttccaaatattattttgaaatatgaaattattaaaataaattttaaataaaacaaataaatatctttagcattaatatcaattccttcttgttcaagaagtaatttaactatttctgtatgaccatttgaagatgcacacataagtgctgtttgaaataatttaaataatttccaattattattttgtaatatcaaattattaatataaattttaaataaaacaaataaatatttttagcattaatatcaattccttcttgttcaagaagtaatttaactatttctgtatgaccatattgagatgctaaaataagtgctgttctaaataatttaaataatttccaaattattaaaataaattttaaataaaacaaataaatatttttagcattaatatcaattcctttttgttcaagaagtaatttaactatttctgtataaccattataagatgcaatcataagtgctgtccaaaataatttaaataatttccaattattatttggaaatataaaattattaaaatagacgcaatttaaagcaaataaatatctttagcattaacatcaattccttcttgttcaagaagtaatttaactatttctatatgaccatctctagatgcccaaataagtgctgtattaaatattttaaataatttctaattattattttgaaatattatattattaaaacaaattttaaataaaacaaataaatatctttagcattaatatcaattccttcttgttcaagaagtaatttaactatttctgtataacaatttctagatgcattaataagtgctgtacataataatttaaataatttccaaataatatttggaaatattaaattattaaaataaattttaaacaaaacaatttaatatctttaggatttacatcaattccttgttttaaaaagtatttaattaattgtttatgattagactttgatgcccataaaaatgctttttcaaaaaaattaatgaaattttaaataaatatttatcacatagaattatgtaatttaacatcatcattctcaatcttaattcctttttgtttgatgagccatttcactactataggatttccatatccaagaaattgggaaaaaagttcttttttaatcatttttccttcataaaatatatgtataaatggaagattatgcaaacttaatgcaccagcttggagtgaaagatttaattttgataaaccttctttctctaaaaagataaaaatttcataattaatgtgtttttaagcattgtattcctaattcatttaaatctttgttaatgattaagtttttctttcttcaaatttttttgatttctttcatcataaaaaaaataataaaaacgtcatttcgatgaaattgaattgctgtttctaatacatagctaatagtcgaattattttgtatgcataaatgaataatttctaaatttccgcctgcaatcgcatattttaatgtatttttaacatttgatccattaattaataaaaacttaaaacatttaattgacttataaaatgcacaaaaatcaattaatgaaacatttttatgattaacaaatgaatgtttttcataagatgatggttcaattgtttgattgaagtcaaatttattttgagttgacatttcttgtaattcttctaaattatcatttcgaagaatctccaatatatgattttctttctgattttctttgtctgctttatttataattttttttagataataaaaaagatttgaaggtatcattttatggtcgttcatttcgttaagaagacattctgattcacttgtattttttaggtaaagataaatggttaataccttaagtagttttgaaaaacttaaattttttgtatttgataacaagtttaaaaatgaaatgtataattttgcatctttattttgggtaaaataagccatataaatacactgagtaatataaaattcatagagtaaaggacaacttggctgaacttctaatacttttgaaactttctgagaaattaattcgagattattttcatttaattctaaaaacaacttttcaattgcaagagcttcatcaggaacgagttgcaaaactgatggacttggtggaggaggaatgtccataaaaattatagaaacgatcataagtcactcaatttatcaaaaagtgaattcaaagtgttgctggaatgaggaagaaattcatcccagtaaatatactgatcttaatgaatataaaccaaatatgattcgctatactgttgtgtatgttgcgaagttcacaaagcctatgagcaattggcattttccggacagactggaatatcataatatataaatatattatatttatttgatcttcgaaatcgctgatagtgtaatggttatcatgtaggattgtcgttcctgtgatccgggttcgattcccggtcagcgagtttttttgctctttaaattaatattaacacttgaataattcataaaataaattatttttatcctaaaaaagacatcgataataagtataaaaaacaacaatagttcatgaatctaaaaaaatatgtgaattttagtaatttaattttattgattttcctaaaacatatattaaacggatagtatattcataaaaaaggtatttctgtaaatgttcattgtgattttaatctttttggtgttgaagtaattaatggagaaagaatagcaaatgaaataaatccgcttaatattggaacaaaagtaaaagctccattaaaaatcaccgtagaaatcaataaaacaagaagaagaactttttcatttgttggaaacatattggatttaattgttggaaatgttattgagtacaaaaataccaagcatgttagaacagagataggaccattcacattaaggttaatatttagaagaattaatattgatctgattacgacatcaattaaataagtagcaaatataattattattgtttttattgagccggatactaattctaatggctttattgataataaaattattaaagttataataaatgttggaatatttgtgagaaatattggagataaaagtggattatttataaaaatattatctgacttattgatttcgctttgaatggtaattccaattggtgtactaactaaatataaaacaaataatatggtaagaattggagagccaaaagccatttctggtataaaaccgttaagccaaataaactaaccgtttttgtacgtttaaaaaatcaaaatgaattttatagataaaatatggtcgacattaaaaaattttgcgaatggaggatttaaagatatctacaaagttgtatatgggtcaccacagtttccatattggtttacgtttcaagcaatttggtcatgctatgtcgtttgcagatcaacattacataagaaaaaaacagtacttttatggataattcaactaattattacttcacttatgatatttgcaccgcgtgaaatatttgcatttctttttcataaattatcaccaatcattcataatcctgtgattcttggaatatatattgttgtttttctttttatgactttagcaccaaataatatattctataaaatagtagatatttgttattattttattggaataatccaaggtgctaatcaagcaaggttatttaacttaatccttagaacagttaaagggccaagcaatatacaaaacctttcaattgcaattggattcattataatggatcaggtaattgaaattgttacaagaaagatatcaaagggagaaaaaacaaaaatgtcaaactaccttactgtcataaggacaggtcttctttcgattctattctggttaacgacacatcaaaatccccttacaaagtatattggaatatatcaaatttatattccggctttaatatatgcatttgtattggggttatttaatgcttctgccgtacttgattttggagaacgcgaaagaatcccaactccacctccaacgccaagaccaaaaagatcagcaacaccaactccatactctgaaaggtatccaaatgaaaggtattaaatattatttcttttttcgtaatttttttttcctccttctgaaatgaacgatactatcggtggaactgaatatcgactttttgttagaataacttcttttggaatgtcaacagaagaaacatcgaatgaaccagccaaaccaaaaacattaacagtggaaatggtacgaaaaagagcagaacataatgatggaatgctatcaacacttgaagaagttgctttgcatcaagatgaaattggcgttataaccaatgtattcgaaagatacacaccacacttaaagatcctctatctccagaataactacatcgaaaaaattgaacacatcacccttttacatgaactcgaatatttaaatttagctttaaacaatattcaagtaatagaaggcctagaaggttgtgagaaactcaacaaattagatttgacatgtaattttattgttgatttagtatctgttcaagtccttgaacaaaatatttttctccgcgaactttatttaattggtaatccatgtgataaatttcaaggctaccgtgaatttgtcattgcttctctccctcaactcacgacatttgacggcaccgaaatcactccatcagaacgcatagccgcgaaacgtaaatattcacaacttcttaaccaaatcattgaacaagtttccaaatgcgatactgggcattacactccagaagaacgcatgaaagcatggcaagaaatagaggaaacgaaaaagaagaacaaaccgccggagcctaacggtccatcgttccaaccgccaaaaccgcctgcgcctccaaacggtcccgatgaaaacggtcacatcacccaatgcaacacaggaaaatggaacttcaagtggtatcaagaaggaactaggctttgtcttgatacttctgtaccacggtatctttctacatcattgatagatatagatgttaatccaacatggattagaatagaggcaaaaggaaaagttttacaattagttcttcctgctgaagttaaaagcgagcaagtagaagctctaagatcacaagcatcaggtcatttggttgttaaaatggaattagaacatcctaatcaatcgcctgttgtacaaaaaaagaattaaattatattattataaatgaacttagtaaaaattgtgagtaatattttataaattgtttttttaattcgttctttcatgaaagtaatttaattcaacaaaacctttttaagaaatggactctctagagcaatagaaatgaaaaattttatataagttttttgggtatcttcaaaactggtaaaaataagagaggctttataaggaaaaaatataattcttgttgtgcaaaatgagaacgtttattcttttggtcgttgggctaaaccaggggggccccatatgttggaatgtctgcattcctcgaaaaattgttccattgggcttcttcaaagacatcaaaggatgaatacaccaaatacatgcctgagcccattgggtttggaaaaccgaagcctgtaaataatccaattttagtaacagttgatcgtgtcgatgttgctgttcaagcatacccaaaatatttaggaattgatgaagcaaataacgagcaatttttaagagttgaaaaatgtgttgaaactgatgaccaaacttcagatccttatgttccaattagcagagcatcattctgggatattcccgaaagtaaggaagaaagtgaagacgaagatcaaaacacaagtaatcttagcacttccaataaatccgatttgtccgacaaagaaacaaaaacagacgaaaaatcaaactcctttactggtcttatctctttaggtagcactacaagtacagattcgtcgttagataaaaaatcaacattcagcttcggtataaccaaatcagaaaatacagaaaagaaagatctaaccacaacagaaacttctacgtcagcaacgtcagaggaaaataaaggaaattcaatttttaatttcccaatttcagatacatcatcaacaaaaacggacgaaaagaaagaaacactaggatttagctttctaccaacattaaatacttcatttacaacaacaactgaggaaaagaaagacactccgacaattaatctcacaaccacagatacaacatcggcaacaaaacctgaagaaaagaaagaaacgacaggatttagctttctgccaacattaaatacttcatccacaacaaaaactgaggaaaagaaagaaacgacaggatttagttttctaccaacattaaatacttcatccacaacaacaactgaggaaaagaaagacactccgacaattaatctcacatctacagatacaacatcggcaacaaaacctgaagaaaagaaagaaacgacaggatttaactttatgtcaacatcaaatacttcatcagcgccaagccttagttggggcaagtcatcaaatacagatggcacatcaagttttagttggggcaactcatcaaatacagatggcacatcaagtaatagttggaacttctcacttacatcaggaacatcatcaaatggatggggcaatgcatcaagtacaacaggaacatcaagtacatcaggaacattatcaaatggatggggcagctcgtcaaatgcaggagtcacatcgtttaacattccgcctccgccgaaacaataatacataaaaatgatttatttttaattatttaattccgattgctcacattgaagaaattattggtttaaatatgtttgataatgatatttttatttgacaaaaagtttttctgatgcatcacaagccaaacctttcgcaaaagcttttgactttctccttatccgcaacagtaattacattataatggattctcttaatgtattccattatatctttaattgatggtctgtttaatggatttttatctaaacacttaatcaatagatttgtaaattcgtcacttaattcgatagttttctttaaatctggtattattccatttattctttcgaatggataacttaacttatttatatcaccaaatggatcctttccatccaacaaaaacaaaactgttagagcgaaggaataaacatctgtagcctttgttaaatttgcatttgaaaattgttctggcgaaaaatataacggatcaccgtagtcgtaaaccattgaaacctgtgaaagtacaagttcaaagtgtttgtttactaaaattgacgatgggcaaatattacagtgtaaaatgtcatttttatgtaagcattcaattgctgacgctaaagaaacaattgaaatgcttttcatcgtcgaattgaacatgtttgcgaatttttcatttgacacaacttcgcgaatattaccatatctataaaaaggataaacaacagatttttcattatatgtaataatcggcactaaaaatggatgttttatgttggtatattttgttaaaacagaattattaattggtatttcaaacgttttcatcaaaaatttgtttttaatttcagggaaagaaactagttgtgaaatgcttaagttagaataacccaaattcttttcaactttaacattatctaattctatatgctgaatgttcttttcatgaatatttcgtacatcataatcaatgataaagcgtttgttacgttcgttcatccataaaattgtaggtttaatataaagtgaattaacaataaaattagattcttcactttgtgtaacaaaaccacttggaggcatttcggagatacactcattcaaagtggctttaccttggtcatttaattctatgatataatgttcagtaataccaaatcgtgattgcgatatcgtaatttcgccttgttgagaacaacaaatcactgatttagatgcatttctgaagtcacattgtatcatgttaactacacttttatcctcaacctcaattacatttttcgaaaatagttcaaatttacaattatcgaaaaacacatttgaatctttcattacacggaaacctgaaaggcttctattcgagtaacattcaataaatttcacattagaatttcgaataattattggtaatgtaaaattacaaccttgaatttcggcaactgaattttcgaatgaaattgctgtttcaagtggaccactaaagttaacgttacaattatataagaaagttttagcctttgatttgatgtaaaatccgatgtcacttttgttgattgtaaagttatgaaaaattccacttgatcggtcttctaatataaccgctccttgatgtctatcggctatacaatttgacacgcgaatttgtgatgttcctgagccaacaattccgtgtttattatcacaaaagtatgcgtgatcaatgttaccgaatgattggccaccaagcattattgatgagtcatttggatttcgattaaataatgttccaattaaatatatttttgattgatcatttactatgattgattgatttcgtgcattttcgaatatcgaaaatttgtcatgatattgtgattgttgattgagtgcaatgttatattgttgatatgaaaagttacaagaaaatgtatataattgactgttttgagataacgtaattccgcatgtttcattgttcttaaatgtgctatttcgtacgtataatatgatatttgcttcggcatctccaccaaatgattgattttcagttatcgtacaattatcaatataaatgttatttttggcttcgcttttagtggttaaaacaaagccatttctgccattgtttcgaatggttgtgttagttaaaaatgaataattgcaatcttcgatttgaatgccattcgaacctgactcattgaatgtacaatttagcaacgcgcttttttgtacacgccttaagactattccgaccaatttatttttataaaattcgcaatttcgaaaaattaatttttcacctccaacacaaaaagcgccaatttcattgttattattaaacttacaattctcaaaaatgccttcaattccttcaaagaataaaccgcaattttggcaatctgataaatcacaattaattaaaagcagcatagattttggtttggttataatgcctttttgaattgtgccagaaaatgttgtgtttttgatgagaccacgtgcttcattttggaaaagaattgatccatttgaaatgagacaatcatgaattgtggtaactgtgttatctaataaaacaagaagaggatctctgctttcagttgaggtatgtgtgagctcacatttgttaagatacaaatgtccttttgaagatactttgattaataacgtttgtacaccagtaaatttacaattgttgcagcaaattatagctgatggcgaactttcaatacagcatgtttgtcttgtagtaaaagtacaattatcaaattgaatgaaacctgcaagagctattacacaaaagcctttactatcctcaccatcaacgcgaaaatcaattccttcaaaacttacataatttgtaagaatttcaacgatatcatcttctgtttgtgaaattgttactttaccattagcttgaaagaataaaggtcttgatatgttaagatgttcattatatgttccgctgttaataagaattgtatctccagcatttgaatttgaaattgcatcatttattgtattataatgtgatgatggtccaacttcgagtgttttgtttttaattggtttattagcttgttggatcacaaaagagctttcatttaatgtgtctgataaagaaagtatttcttcaagattgctattcatttcataatgtaaactattcaaatcgtgaatatttaccaaaaaaaaagtcagtttacttaaacatattcgataggcgctgttgaaaacgctctgtttctaaagcgaatataattaatacttctatcgtaaattatcaagtttgcatcaacagctttgttgatataactttggatattttcaataggctttttcatgttagccttaagcaaaggttcaatttctcccatcgaaatcattgatttaccaatagatttcattgattcaattaatgtcttaaattgactatcaacttgaattgcttgttcttttggaacatgtcttggtgattttcgtggggacttagataaaggagatctaaggtcaatctgatatttgaaatctgaatttgaaagtggttgaattaaatcttcaacaccatcattttcagtttcttcttccaatccaatagattggttgtaattgttaatttcttcttcttcaaaaaacatgtcgtcatcaaattcttctttctgtgatttttctgattcagatttctcttcttggatttcataaacagtacttgtttctttgatagttgatgcattgtttttaagtggttcgaggctaggccatttcaaaaaggtaattggaaattgaccaacgacaaattcatattcaaatgaatcttgagggttcttagatgaagccaaaatgacattttttggtttgattttttggaataaagataaccaaattgaaaacatgtttgaaattaagataacagaatattcaccaccgcatgaatttgagaataacacaatatctgcaattgcgtcataaatagatttttcgccttgacgaattgaaacttgaaaaattacacttaaatcattaattgatgaaggaattgttttgggatcatttgctagaacaattacttttgagattgatgacttattcatttttgaaactttcctaatgaattcaatattattagatggacattgagtgcaatcccaaacaagaattgttccttgcttcatgatatgaatacgtttaaataaattcaaaacgtacatcatttggttcctaatgttcgactctttataaaacaatacaaacaagagaaacacgaagtcgaagctctatagttacaaaattatcaaaaataaattattgaaaaaaaattacatcttttgatgaataaagttttattaaaattagatcaacccattgtcctttaggaacccgggcattgctgcttttatgttatcaaacatgatctggaaaccattatcaccaccataatatgggtcatcaattccttctggtggattgaacaaaactaatgatgcttttgcattttttggcttttggtattcaagagtttgataaactgattgatcaagtgcagcaataacatcaaaagtatcccaatctgagtttttgatttgacgagctctttgatggctgatgtcaacgccatttttcttgcaaacattttcagaacgagaatcaggactttgaccaacatggaaactacatgttccagcgctatcaaccttaatagaaccattgacaatacttctgcaaattccttcacatgctggtgaacggcaaatgtttccaaggcaaacgaaaagcactgatttctgcatggacatttgtagaaatgtgatatgaaaacccctttttttcacatcttccaaatccataattcgtaaggattaaagacaaaaagacaatttaatccaactaacgatgaataatcgaaaatgatttcaatcaaattttcattaatctaatttgcatcaaattcaaactttttttattttcatcaaatatatgttaatattctatgaaacaagaaaacataatgattttaaaaaggaatttcataatattttttatgagataatcctgaaaaacattttatgcttttgcacattgaaaaaattttaaacggacacaatcaaagtattcaaatccaacttcccgtgaagttgatgattgaataaatatgagggggtctattccctcaagcttttttgatgagtcaaatcaaggctttcaaagaagaaaaatcgaaaggttccgatcaccagaaagtggtcatagaaccacaaaagaacattatgaaacaaatcaagatatgactgatgtaggaattcccccttttttacaaaattcttatttacaagggacaccaccaccgaaggtaactcaacttcggccttggcaaaaagaacttcttttaagtgatgattggaaaagtaataaaaatgcaattatcttagttccaacatctggtggtaaaacattagcggctgatgttgcttttgctcaacaattagaacaagacccagaatccaaaatgattttttcattaccatttgtttcacttgcatcagaaaaagcacttgaatatcgttcacgttttaacaaattccatgttcgcccattctatcaaaatgttggtggtatggattttcgtcgtggtaacattgcagtttgcacatttgagaaagttcactcacttcttaacagtgcaattcgcgatggatacatcagcaagttcaaagttattgtgatagacgagatacatatgataggcgagtcagagcgtggcgctgtcatcgagtccatcatcgtgaagcttctgttacttcgtccgcacatcaacatccgcatcatcggcctaaccgccacattgaacgttgcggacgttaagcgaatttcaacgtggattaacggtttctcctatgtgtgctcacaaagaccttctccaatcaaaaactatttcaaggcatcgaatggcgatctttacatacttgagaatggtgtacaaaggcaaatacttaagttaaattcaataccagaagataacaaacatattttacacccagttagaacatgtctttcacaacatccttcaagtactgttttggtctttgttaacacacgtaaactaactgttcaggtggcacttttcatagcgcgacatttatttgatgaaaataattcattaccacagattcaacaaccatcaacacggctttctgcgtcacgagacttattaattcaacgactttccaagcttgaaactggtattgatcccaacattggtcgatgcatcaaatcaggcgttgcatttcatcatgcaggaatgttattagaagaacgaaagcttatcgaagatgcagcgcgtgattctgtgatctctataatcgtagctaccacaactttatctgccggaattaatatacgaagtgtatccagagtaatcatttatgacttatatcgacaggggaacatattaataccgaattcggtctttattcaaatggctggacgagcaggacgaaatgagttaattggcggcgatgtctttatcttagcccggacaacaaatgaacgtgaaatacaagacgcgtgtgccttatcacgcaatgaaatcgagaatataacaccacaactttttatgtctgagaaatcatcagatcgatattttttacaatgtttatatttaggcttattaccgaacgttttcgactttgttaacaattcgttgcaattttataatgataatgaatcggatgaaagcgcaaaacaaaaaataattaatgaaattgttttccgtttattaacaaataatttaatagaaaaaaatgtaacaaaagaagatttgataatatataaacctacaaaacttggaacagctatagcgagctcaacattatctattgatgaaggtttggaacttaaagagacaattgataatttgcaagaaaaattatatctgaaagatgacgttcatttgttatatttgtgtatcccaacgaatttgacgacatatgaaaagactccgtcatatgataataagatttggaacatattaattaatgaacattatgaagtgttgaaactgataacgaagttggacaataaaatgttcgaaagacacttcataattacgttaaaaaatggtaatcgaaaaggtattacaaaagaattattgaaattggataatttgttggatcggtttttttacgcttgtatattggggaaattgatatcagagataccaatcattagcttaatgaatgaatttaacatcgaaagaggaacaatccaaatgctgcagatgaaggccgcaaactttgccaaccaaagctttaaattctgtgaaattaacggttatagcacgttaagcaaggcactgaacacgtttaaagaccgtttaaacttcggagtgaaaaatgaattgttacctttgatgaaattgccttcttgtaataaggaaatcgctagaactttgataataaatagaattatgacgcctattgaattggcggaatattcatctgatttcattttggaattggtggtaaatggaaataaaaatttgaaaaataataagaaattcgaagaaatgatatgcaaaattatcgaggaagctaagaacgtggcaaaaagtttgaacataatagatgatatagaaaataatatgaaataaattgtttgtattatataaatgaattttttttaattgtaacaatatgtgaatgactttatctaaaaataagagaagttaattacaataatttctttttggtgcttgttataatgttttgtaaatttacataatggaagaatgtgtttaatataaatgtataaagttgcatgagaaaagtagattacatataacttctctagaaacttcacgcataattccaatgctttttaaaatacatgtaaaagcatcataaaaaagcagaaaggccttttaataaaatgattttacttttaaaagttcagaaatattaagataaaagcaaatatattatatataacaacgaatgcattttcttatggaaaaacacaattattgataatcatttattcgcattaacactttatatttacaattgcctttcctgtttccttatattcgcacattgttattgcaatcttatcaaacagttgcacctctccaatcgccgcgcctccgatccacaccgcattttctctttcaacattcgccaaaactttaacttttcgattaaatatatttttcggcgcaattttctttatttctccttcgattctttcagggaatccctttaacattgtatttccgccagcaataaatatttgtccatacaacaaatttcgttcagttttacttttaatactttttatcgatttatttatcattttatgcaatccatgtgatgagtcaaaaagaatttcggcgcattcgaataattctttagataatgtgatttcatgttcattaggaagtaatattttagtgaatggaatcgatttggacgatgatttagtagcgacatatgcatatttctctttgatgtctcggacaatttggagcccagaagctgaagcaagactgctatcatggctggaaataagtttttgaagctgagtggtcacatcaaagcctgaaagttcaattcgattggcagaattcataatttgaactccatcaataactggaagagaacaagaaacaccgtcaccagaaacaaaaacaagcatgttgagaagacctgatgaatataaagcaagaacagcttcatttgtagtataatatgtaggtatattaaaggtttcgaaaagaagttctgccatcttctctcgtttttgtttggggttaaacattgtttccgaaagaatcgttggacgttgggatggatcagtttttaatttatcgaaatatatgtaatggagaagcttttccatatcatcccaatttgtgacaacgccacgattaattggaccctggaaacattgtgttttttttaaatcgttatcaacatttttaattaatgcgtcaacaggttgaaaaactgttggattttgatttcctgaaaagccaattttacatctcactgaaccacaatctattacaattgcttttgtttcttccacaactttaaatacgatagaaaatttgaatgattaaaacgattttgaattttgacttgtttttgatcgtttttgttgaatataaatgtgtcaaataaaattcaaacaaataattaatgtcagcaaatggatgattctatcaacaaacttattgatgttttctatcacaataaaatccaggatccaaatgctgccatcataaacatggattacaataattttgtgacacaatttaaaaaaggattaaataaaaaaattttagatttatcaaggcaaaacataggaatgaatattttaaatcaactaccaaaaattcttagacagttaaaagacattcgaaatattcagctatatggaaactcaattggtgatggagggataagtaatctgtttcaaattttatattccaatccaaatattactgttttaaatattggatgtaacgcacttacagatcagtcatttacttcaattattgatattataacatctagttcaattgtatcacttcaaattggaggaaaagatggtcgcttcaataaatttagtattttttcaatcaaagaaatattacatgcaattcgtgaaacagaaagaattagctgcttaggaattggtggcatcaaacttagcattagagaatttgggagaagaagaacgatagctcagaaacttgccacttttgttcgtaagtacagaaaattgagaacgctgtcaatttttgattgtggttttaatcaagaagaaatggaattattcattaataatggacttcttacaaatgatcaattacaaaacttagatgttcatatgttaccgatgtcagatcgtgttggtaataattttatgcataatttatatcaaatgcataatctacgatatattgatttaagttattgtcaattaaattctcaatctggaatagaactttccacatctctaaaccaaatgaaatatttaacatcgattaatttaagtcataatgaaattcgtgatttaggatttattgaaatattaaaagttcttttaacaaatgatattatcacagaaattgatatttcatataattcgattggaccgaaaatatcaaattatttatcacaattaatttcagataataaagtattatattcgataaacttaagtggaaattatatttgtgatgaaggagcaaaatcaatttctttatcgatagaaacaaatgaatcaataaaaaagttatatttatcatcatgtaaaatctctgatgatggagcaattaatttatgtaaatcactttcaaggaacaaaacattaaactgtttaaaaattaatgataatttcattaatagagaaactggttatgaaataataaattctcttcgtgaaaataataacattataattctcgatttaacttcaacacaaattgatcattttgttattcaagcagcaacaaatttatgtaaacgtaataaacaaatacaaaaagaaaagaattttttaccactgaaaaaacaaattattcaattgtctattcaacaaacaaaaattcctgaagctgaaatgcaattaaattctttggattcgacacttaaagatttggaaaataatataaatgatgttaaccaaacaatggaaacaattgaaaatcaattaaataaaaaaatatcaaaattagaaaaggctataagtgaaatagaaatagatattaatgaaaaagaaaaatcaattcaatcaaatgaagataaaaaacaaaaaatggaaaatgaatttaatgataaatataacgaaattatcgaaaatactgaaaaagaaaaaaatttaattcatgcgcttgaaaaagaatcaaatgaattggatgaaaataatatcgaatttaataaagaatataatattaaaaaagatgaattagaaaaagaacttcaaaatttggtaaaaattttggaagaaacaaaaaatgttcgaaacgatccaattgctataaaagattatgaaatgcctgatttagacttcttaaaggactttaacgaagatgaagagaaaatcttcatcgtagatgatgtaataaacaaaaaagaacaaaaaaagaagaaaaaaagcaaaaagaaaaagaaaaaataaaattgcggtttattattaaacgtgtttttaatatgaatttggcactttttggtcgtttaaatgtcactttttagctaaggcatcgaaaccgaagatgctgatgtaaagttaattagaatctatcatttttctaaatcaattccatcattatttgaaatttttgaaaattttcctgatataattattaacaatattcattgcacacaatctctgtgtgtattggttcactccttaacgtataaaagagtgaataaaaattggacggaagaattaatatgtgtaaatccaactgataaagttcgaatcagtcatatttcatgcggattctttagcattacaagcgttggctaaaatcaccaaatatttatgtaatcaagatttttattgttatattaaatgtgactttgcatttaaatgaacaaataaaatttttgtttattccttttgtgaatgatttttttaattctttgaacttgagattaataaatgaacaaaataactcttcgattttaacagaaactattgtggcggcattagatattttaggaaattgtataataaaggaacaatttcctttcgataatttgttgaatttaatggtgaatgcttttcctattgtggaaggcgtctgttaatgttattacttttatgcatttttaacttgtaacttcgataaaatggaaaatgaaacaaaaataaaatatttgaaaatgttcattattttgttggtacagccgtatagtaacttgttggaaatgaaaataggtttggaaacttgtaaagttatttttgacttgtcaaaacaattgtttaatattgaagcaattctgaaccttctgaatggtaatgaaaaaaaattttcgtttttcatggactcggtacaggaaattatatatgaattttcggcaacagataaataaaatatgttttgtttggatatttttgtagtgtataaaatcatcattttatttatcaaaattgattctaatattagaattattcaaaattatatatttcacaaatataaatgtgttatcatttgtttttttctaaaattctcatcctcatacaattaaacaagttattcattttaaaataagtgaatgaaaaatattattaaaactagtttaaatttattcatatatcattaatgaatttttcttctttgaaatcatctgcaaaaggatcttcatcaatattggtaacaataacgcctgtttcaaatgagttttcatgtggttcgtttccttcaaaactttccccttctatctcacttaaatcttttttatttcgtaatcgaattaataccacaataagtaatatgataataatgacaactataacaactaaaacacatgctgctatggttaatgttgtgttattattatcattcataattatttcattttcatataaaatagtaaatgaattaatgtaataactataataaaatgtatatgcaataactatgtattcataatatatatgttctgtttgaatataagtaaaaattgaattaaataatgaaagcgaaaatgtcattaaatttgttgatttataaattaaaattttactattaatagtaatgtttgttagaccagtgcaataaccaaaagcagaatcccctatttatattatgttttcagtaattaattttgggaataaagaacatttatagaatgcataatttcctattgtcataactgattcgggaataaaaatatcatttaaattagagcattcataaaatgcataattgccaattattgtaactgtacatcccattgtgactgtatttaatgaattacatctttcaaaaacattatttggaatttcggtgattcctggatttataacaacaaattttgcttcatatttgctagtatcgataaaatcattgggattataaattataattaaagtagttccatcataagattgaagtgaatgagaaaaaaataagatataaaatatcatgacaaaagtatttttgatttttagctttcttttatatttattcatgagaatttttgctttacatttttttctcctgaataaaaacaaaacaattatggttttaataaaatgaaataaaattaatgttgcacacattaaaattatatgaaaaacattaaattgttccttttttagattattataaagaaaattggatctattcagtaacacatctccaatacattcaaacgaagttaaacttttgatgtttatttaatatcaaaaatttaaatgaatattgattaaattgatgagaattcatgatgaaattttcttttataactttaatgttcataaaggttgagcgctgaaagtttcttctgctatctaatttcatcaaaaaaaaaattatattttcgaaatgctcttagtttcccttcattataaatagcataattagaagaaaaaagtgtgttgataagaatgaaatgaatgataaatgaaaattcttctccataacgacaacaggtcacctgactttttttcttcaatttaattcaaatattgtttaatcaatatgatacaaaaaatcacgcacaaataatcaattgaaatcaatgactctttattaagaaataaagaactcaaatataagattaaaattattaaaggatgttttatttttatagaagtgaaaaaactgatttatgaattttcagtatatcggatttatcgcaaaataaacatcaaaataaaaaatccatccctacactcacttttattatgtggataatatttcgttaaataattgttttaatcttcaatttgactttactcagagtattatggatgtccataaaaaaatatccagcttagagtgagaattttcaattaggaaaataattgtaaataattattgactttatttattatctaatgcatcatctactgctccaacaatcaaagcaagtggcacttttacggttattgcgttcttttggaagaacacaatgacaacaattgcgtccttcttcgagtcaggtgccgcaaacaaaaactttgaaccctccaaaggttttgtcagttttactgtaattgttttattgttgttatcaatatttgtgattgataaaaatgcgccgttatgaagcgcaacaatataaccgcacgttacatcccataattgcagtgtacactggcttaaaccaaaggacttgccgccaaccaaatggaactttagattgtgcttctttaattgtgtcgcaattattatttttgtatcatcgactttaagaaatgatttcggtggaaaattaggataaaaatctgtaagctttccatcagaataaagttgcataccatcgctggttgttagtaagtatccatcaagataaggtgtgattgatgtagcactgacattaaattgtttaacaatggaatagtcatctaaatttactttaacaacaagaaacctacttggtgtaataatagctatttcaaatggttcgacgtttgagccacaaaaacttattatatcataaacatcagatattaaaaatttggatagaacaagacgacgtggacaatcaaaaaccgtgaagtgattactttcatcaagacatataagcgaaggctggggctttggaagatgtgattcattgatgagaatattggcttggctacaatcaacaagaatacaacttgcttggcgtatcttgcacatgtgtttgtagaaggtattgtgcataccaccaagtgggcgatttgcttcaaaaggtgaacatatcataatatcggttcccattatgatggctaacacagatctgtcgaatttaacaacgttctctacttcttgctcaaaaacaagtagattagtttcttgaggatccattttttatctcttgcgttttgagtccgcgggctgttcaatataaggagaccgtttttcatatgctgacacttattttcttgaaatagatagcatgttgtttttcgaacaaaattaataagtaaagcccaacgcccttgaagcaaaaatacattttattgcttaaaaaatagtgattaaattttgattaataattttcgaatttcatgaaaaattaaaaaagctatcactcgatttatttatatgataaagtttctttatataagcgttcaagaaaaattatgtataaacatttaaaaataaatacgatgatatccttagattgggaattacaaatgttatcatttattattgttacactatcaatccatttttaaagtattttaatgaaaatcaaaaattattttatttcatttttaaaatattcaaaaattagaattaaataaaaaatatttcttttagttattttctttttcaacccacaataaatgattttcttgcaacaatcgtaatatcataagtgactcattgtaatctgaactcatcgaatccaaattatcaactgtctctgtgaatgtacgcgatgcgagttcgatcgcttgttcatggaagcccataatttcatatagaaaaacggaataatttaatacaacacctaaatatgttgacgaagtgggtgaaagttcattcttagcaatggcaagtgcttcatcataacattgactggctttggtgatgtattcggaaacatcttcgcctttgttctcacaaatataccggtaataatctccttgcattttcgcataaaaaactcgttgttcacctgcatatgtttgtggtaataacgtgtccttgataaggttaataagatctaagcaaatatcttttaattcgcttttgagaatagttaaatattcaaacaacttttgttgacgtgctggtttgttgttattagatggatcttgtaaatgtgtctcaacttctcgaatagcatttcgtcgcaatgtaactgcatttttataaactaaagaaagaagaactttctcatcttcacttaatactggattaagttcaataatcttcttaatcatatcaatatattcattttgttcttccataccttcattaggaactccattattatattgaattcgaagataataaataagttgttctcgttcgtcactcatacgaaatacgtttattttatattttttgtaaatatctgaaaaatattgtaatgataaccgtagttgtaaataaacggcttcctatgatttatgaaatattctgttttaataaaagatatataaaatctttatcaacaagaatccactatcaaaaaaaaaaaatattatcaattcgaagaataaattaattatcattaagattaatgtttatttaatttatgtacttgatgaaaaaaaaaaaaataatattttagaataacaaaatttaaaaaatatataaaataaaaattatttagcaaaatcatcaaaattatgaatcatgaagaaaaacgtcttcctcttgtaaaaagaatccgttaaaatcgattgaaaattaaattcaagaagattttggccaaacacaaccaaaattttaaatatcacgatataaataaggaatatgaaaagtatgaatgaagaagaaaacaaagatggacgttatttcccaagtgatagtgaaatgcaaattttaattcattatcttcaaatttatttttcacatccagaaagatctattcaacgatcacaagttgttcaaacagttgtaggtattctttctacgactaataaacattggagtcatcgaacagttcgtttatggtttaataataataaacgcgtttttttacgaccaaattcacctaattcatctaattcgtcaagttcaagtcaaagtcctaatcagaatattgtttcaagtcaatcacaagaaattaaaacagaaacgagttcaagtttttttcgtcacaagtcaaattttttgattccaacgcgatctttatcagttacacaatttcctattaaacaagaacaagaaccacaaatcatttcaacgccacaatatgtttcatcacaaagtaaacaacctaaacgtggtacattagctatggaattattaatctctaatgaaaacatattacagaaaccacaacaaattttttaagcacaagttgaatcagagaatcatattacagagaaaattatatcattacataatcaaagatcggcagacttaattggagttcaacaatcgcgaacatcattaattgatttttcgacagttccacaacatgaatttcaaaacattcgccgaattaatacatttaataataataataattctattaatattaatcctaatgaaaacaaagaagataatttacctactttagataattatcaaccatatgaactcattgaaagtagttatatattacataatggtgaaagtattattattacatataatacagaagaacaacgacgaaagattcatattcaagaacaagttaatgatattgaatttttatcaccagtcacatctatagtttataattatcaagataatttaatatgggttcatagtgataaatatattaaatcatattatcttgatacatttgaaaatgtacataatcttctaattagtcatcgtcgatcatatcaatcagtaattaatttttggaatgataatttagtattagcgacaggttcaactattctttcatggtcaccagaacttttaagtcaagttaaagaaacggaagatgaagagaaatttgatatttgtttatgtttatctcttccgaatatttcatctgttactacattaggtgaatcacttgtagttggatcaagtgaatatcatagtattcaaatctatgcgaagaatggagccataatttcacgatgtattggccattcatcaggaattacatcattatcaagttatgatgaaaatatgtttttatcaggatcagctgatcaaacgtgtaaaatgtgggatttacgagtttcacaacctatttttaatatcattcgacatgacgggattgttactagtgtttttgggaatgttacagaaagtccgaatttaatctttacagggggtaatgatggaatagttcgatgttgggatattcgagaatttaaacatttatttacattaccaattggtgaaacgtcaccacaaaacattcattataatcatgaaatgcaacgacttacgattgttactagtgaagttacatcagattatttttttatgataattgtaaattcggacaaaaatttgatcgaaatattatatttcaaccaaattctgttttaaattttcatttttaaataaaatattaaattcgaaaagataaattttagaaaatttgattccaataaaaaaattttttttgttttctttttgattaatgttttttaacaacagcatcagataaccaattcattccatcaacaagtcctaaccctgtaagtgcacaacttgcttcaatgtgatatcgcgattgatcaatgacttgtaaatctaatgcttcactaagcttttcaactgaaactgcaccttctatgtcttgtttgttggcaaatattaagataggacatcctttaagttgtggtgattgaacaatttgatgaaattcttgtttggcagtggcaaattgtgttttatctgaagaatcaacgacaaaaattactccttgtgctccattaaaataatgtcgccataatggtcgaattttatcttgtcctcctaaatcccagacacaaaattctaaatctccaaaatgaacagtttccatggtaaaaccaactgtagcaactgtatgaacaacttcattcttcttaagacgatacaatatagtggttttacctgcggctccaataccaagcatcaagattcgatactctggtttcgcgctacaacctcccatattgttgaactgctttatatgaaaccgtttattacgatggaaaaaaattttctggtaatagtaaatgacacgaagtggcgtcacttttgcgttcaacacgaaatttttttcaatcaaaagtgccaacatgaggaaattaaaaaaaaatcagaagattgaagaaagttaatcatgataattcaatgtcatttatcaagaatttcacaataaataataaaatgtcaattattctaagttgcaagatcataaataaaatgaaatttcgattatacttcgacaatttcgtggaattggtggataataactattttcgtttattccttttaatcatatcttatttagaatatatgtttttatgaattattaaacaaatgtgaaattaatataatttttattatagtgaatcaggtattgtttataaatatagtatcagttgagatatatgatttaacatatcattatcttctaatttttgaccataatttattatatatattagttgtataattcctatttcatccgagacatccatagactgattttgtatataccctttgactgttttccattgaatatagttaattcctgaccttcttattaaatttgctggtcttgtcctttttcttccagagaataaatttgaatttatatctttatatcattaaataatttaagaactagttttttcactctacctttttcttgaacaactgaagcgatatcttcaaatgcttttgtaagtggagagtaactcagatcataatgaggtattactccaatttcatgttctatgattttatttcttaataaattgccttcctgtatttggtacaattttttaaaataaatctcaggtatttcattttgtgatattaatgggatttgctcattcgaacgattaatgatttcatgaacacaagggagaccatattcaatttttgtaatacatttgcaatttttctcattaatacattacaataattcgatattagctcttccatccattatttgttttttagttttcttagcaatttcgactacatttttcaatttatttactgctactgaacctataatattatctttataaatattattgtcaattcctgtgagcattctctcacttcgccaagcaaattctgtagataaataatccaatatatttataataatctcaatatctctttacacatctaatctttcccgtatattaccattaaaccttcaatcgcattagtcgttctttgttctctcgaatttccagaaaataagaaactaggatcataacaatcggcatcatcaattaatgcttgaatagctcttgtatttttgacagtactccgaatagtttgatttaaagaattaatatattcattacgatatattcgattttcaatgaatttatgaaatgacttatatattatagattgaggaccaaatgtttgttcaactgatctcatcatatgaactttgcaaaaaacaatcatagtatttaacattacctcttcaattactgctttttttttttttattctatcaattattacaactcttggtatgccaactatattttttatattatcaaatacaagttcaaatattttttttttctttactggacattattgaaaatgctagtatctgtgaattattattctcatcaatgaataagaaatttagaataggcatatcaaaatcattagtcatcattatgttatctatttgtaatatatctatagatattattttatttttttaaacctccttgaaacaaatgttgctgtgagaatttgattatctgctctgttcaaatgtaatctcgtttcataattatttgataactgttgaataatagattggattgatttgattgtatcaacatttcttgattttaaataagaacttctgatatcataaaatttccggacactgacagattatgttattttccttctgatttatgcagcattttctcgttgtttagtgtaagttatacattaatttcgcgtagaatttgatggacccaaccaactattatataaatcttgtgatattggatgtttgtgtcgaaaattgccttcaacaaacataacttttgataaattatgatcaactttcaatcttatgaagctcttgcgatcatattgttttagcgtacggtttttttttgctttgcaacgtcctccaaaacgacaccaaaaatcgcaatattcaaattggccaaagaccttcgttattgtgagtgaataatgaccaacattttgcttgaacatttcttgtatatcagaaggggaagtctcttgtaagttaatcgacatttcccaatttttaaataaaacaggatatataatttctagagtatcgatcgtgttttccattcatctgggcttgtaagattatatcaaatttgatgaccggatgaactttttgagaattttgaaagagattgtgatgatttttgatggttttcaaaatttgataattgaaattatttttaaccccctcatgttggcacttttaattgaaataaaattatcgcgtagaatacaaaagtgacgccgcttcgtgtcaattacgattcctcaaattttttgttttgagtgtactaaaattttagcttatgaaattctgaattcattcaattttacttgggagcgtatttaacggttccatttcaggatggaggaatatccttttcaaatgattgcgaaaaaaaaattaatttatgataaaaataaaataaatttttaacaaatgtgcatgttaattttctatgtcatggagtaatttaactattggtgcaaggaaaaggtgtaacttcttaattaaaattcaattataatcttaaaatattgtgttaacaaaataaatattatataaaacaaatagccattttttacatcaatattaattccttttagttcaagaagtaacatcgcttttcattgtgtttataattagatgaacaaataagttattaattattaaaagaaaaattcaaatgtcgtcttgaaacattatatagtaaaaaaatatcaaacaaaacaaataaaaatcatatccgttttgttcaagaagtaatttaactatttctaaatttccttattttgcagtacatataaatgctgtaagaaatattttaatcacctgtatcatagtcatttacaccattcatatacaataagtaaatttacttattgatttccttcgatataaatgtcattgtaaattaaaatacttgatgaataattaatcgaaaaaatccgaatttgaacacgattaaagtcaaatttctaattttggatcaacaattaaaattaatataattttattgtttatttttcatgatatacatttatattcgcatcaaaagatttgcagcatttcgccttcgtcttcaattagcatttcatttgagtattccttattcattgttggcgatgttgttctcggcgcaaatatacccgcgtttattaggtccttaggttcatcgaattcgatcaatggcttactgttatccccattatcgcctcctttgaagttcatcatcgattgctgcaatttttgtctctgctcaatagggacaaagaattggctctttccatcagcgctttcgaaggatgagaatgcacatatccatccgagctttggatgttcaattgaattcttattgatgaaatcaacaatttgagatgctttcataggcatcacaaacgtgaacaacaatggtgttagaatagcgctgaataagtcaaagcagatttgcttagagattggttgaaacatcgaagcaaatgtagaataagtaatccatgaattagccgaattactttgctctctaaagtcgtaatgtatgtatttctcgacttcagtaagtgcttcgtttggtgtataaggatgagaatcaggtgtgattgaaactttacaaacgccatagatagaaacggcgattgaaagagcccaagttagtgacttgttcccaaagattttaatgttgaggagatgtcccgaatctgtgcagaggccgataacgaaaataaccgctataaaagcgccgctgatgaacgataggagtttgagaagcggttgtacgatagaacttgggaacaggtccatgtaaacgttcgcaaactcataactttttgagatgcgttcgttgaaaagatgcggaagttcattatactcacgaatcttccatttagcttgcgtagtccaacggcgtcttgaaagtgagtcagggctattacgaattgcttgggcataattgaaaaataaataaagaagttcgaatataagaacaaacggtgaaaatattaggagaataatcccaacaaacttaaagcggaaggaaagagtgttcgtaattttgagacggcggactgattgaactccattgacaagtgaacaaccattggaatcaagaacaacgcctgtgagagtaagcttgagaacataaaagaagaagtctgacataggaaactgttcagctgtgtttgattttgttaatttccatgtgagtattgatggatcagaaacaagagcacatatatagttgtcataacgtaatatttcctgtgcaactgaaagcatggtgttgttttcttctggttcgttagcaattattgtttcaaatacatcactccattctaaaactgataattcatgatctgatatacctagagttgcaaaataatttctgattcgataatactttggaataagtaataaaaattgaacaatttttatcaaacaaaataatgaaaaaattatagagcaaataatgcataaaaaaaaggttttgtgaaagcctactgatagaggaacaaaaatttctgaaatatgttctgaggttgttatcttagaataattgatacatccgaataaaaaaataggagcaattgcaaccattgcaccaattaggcacgaagcagtgttctctaatagaaacgttataaaccctttcgtacgaaagtattcatatgcatccacccaattaaatttggatttcattttgattttaaaagtgtcaaaattgaattgatttttcggtttaaaattttgaagaagtactttagcatttcctgattaattattcacagcatattaaccattctgattggataataacattaaaatataattcccatcaaaaacaggaacagaacagtgagaaccctaaaaaagtattgtgtccttttctttcttttttatcccataccttgtcacttttttatattgaatggttcaacttattcaagcaacaaaaaattatgagccattatcattattcacttgacaaataacacttcaaaccaactccagaagtaaaagaattattaatgaacgaaattattataagattttcttgtttcgaaaaaatccttgataatttataatatttttttctttagtactacattccctgacagcaaaaaatgtccacgaaattaacgagcgccgaaattaacgttcgtcggtcagtaattttggctatgtgtcatctgattctgtccattggccagaaaaaatgtccatttcctaaaaaggctaaattgaagtgtaaagatttgtgaaacaactaattgaaatggaatttttcaaatacaatgcatgattttccaaagaaatatatgaataacaatgaatattaatgttataatcatttttgcattgataaaaaacattctttgcaaaaaaatgaattcaatgtgtatcaccctaatgttggcacttttaattgaaaaattttcacgtgttttatttaatatgtattttatattatgtatgattttcaataataataatattataaacgattaaacaaattcatattcaaaaacgaaaaatacagcattgtaatatttgtatttatttaaacaaaaataccacaggagaaaaaaataagtattagctgtaccaacaaaactttaaatgaatttatagagtaaaaaattgattccacaaatgtaaattctgatcctagaataaagacgatcataaatatcacaaatttatgaatttgactgttaaaacaaaagaatcgattccattttgtaagaggaattttcaataaaaaacatactgttttcacaaagaaaaataatatgttactaaataatatgtaaaatgtttcaaattaaacactattttaggaaatgaacattttttctggccaatggacagttttatgtccgatggatatttttttctgtctcgtgacaaaaccgtaaaagtggaaaaatacgttgaccagctttttatgtcagatgcccaaaattactggccgacgaacgttaattttgtcgtacgttaacttcgtaaacattttttctgaccgatggacagaatcagatgacacatagccaaaattactgaccgacgaacgttaatttcggcgctcgttaatttcgtggacattttttgctgtcagggactgtattaatgcttctcaaaatgatcatgtcgaaatagtaaaatatctttttaaacaaaaacaaagcaaagtaaatgctcaatttttttttattttatttaaaaataatatttcgtttattataatactgtagtattttgcccataaaatacatttgtaacccatttgatacactttcatcagcacttatatatgcatcaatgaatcgtaatacagaaatttttagagtgtttctgatgggattttcgatataattcaataaagcctctgacttttccttcagtaaagggaaatagtttaggtgccccttcaataatcacaaagtaattagcataaatcttgagtaatcgttgatattgatttatagaactatcagctaggcttttggtttctatttcggttgacgcttgaacaaatgcattgaagtttattttaaacaataaatgataaattttattattcgttatggtaaataaaaatcctctcacttttagacactccactttttgaatcgtttatgatgttcaatggttcaccaacaaaaaaattcggaatagagtatcactgatttcgatacaattcatgtttaagaaggtacaaccctctacaaattttgttgcagattacacatttattgaagataaaatgaattgaaaagttaatgatataattacttcaaagaatttgcaattgaaagaattattcatgaatcacacaattttttgcaattgagtatttactaattttgaaatgagtttcaatatcgaagagttcatcagcgatatcgagaatctaggtgtcgaaaggacaatgcagaaatatcgaattgaaagaaagaagcttcattcgatctgccaaatgttcaatgaaccaaatcccaaagcagggtccacctaagactcctctaactcagaaagagattgattatattgttaaatataatcaaaaagctcatgtgggttacattacaatggcaggtattgccaagagagatcctttcgctcccaaatcattaacaatatggcgatgccatttggtatatgaaatagaagatctctaccaattcttgcatttgtatcgttcaacagatgatgaggatcacccaaacagatatgttgcttgatacattaatcaagctttgcacacaaatctccactatttggaaaaacttccagaagaaaatttcatacaaaaatgcctgatcgcttttattgataacatgagtagaaagattattcattatcagatacttgatcaaaaaacaagtatcttcgcaatgaatgcttgtgcgaatgcgtttcagaaggaaagccctcctaaaaccatgataatggataatggaactgagttccaaggtccctttgaagaacttctacatatgaacaatgtggaaataaagaagactcttccttatacaccacaacaaaatggaaagatcgaacggtggtgggatatcatcgaaaggaaaaagactcaaccacttagaggcgagtatattgattggttagttgatcagtacaacagcaagtgggagcatagctcgctcatgattcttactggtcagaggaccacaccgcaagaagcattccaaagcataactcaggtcagcaagatgcaaacttcattttcagttaataaaaactgaaatgatttattttttttgagggctttgtaatgaaagcttggtgatcgatgcaatcgatcagattgcatcaacaccttggatgactgtttgtgtgtttactgttaactgttgaataattgtttttgagttttggtcccgccacaactgtgaccgtatgtggtcgttctttttgcgagcgccaaaagcgctaacgattttgatctttatgcattgaaaaatgaagtttttcaatgcataaagatcaaaaccatccctccccattcttgcctgattcttttcgataaatgtgtatgccattcaaaaagtgagcggaattttatttattataaattttattattcgtacacagaaatgacataattttatcatctgaccagtaatcaagtaaagtactgaaaaagttggtcaagaaccgaattctatggtggcacttttaaatgagcttcttccaaattattttaaaccacagaaatgattatatttaaaataagactattagcactaatgtggaaagtttaaaatgcagtaaaatgaaaaaattataaattttttcttcagaattaaatttcgcggttaatttcccacacacaaaaatttccatcgtaataaacggtttcatataaagcagttcaacaatatgggaggttgttgcgcgaaaccagagtatcgaatcttgatgcttggtattggagccgcaggtaaaaccactatattgtatcgtcttaagaagaatgaagttgttcatacagttgctacagttggttttaccatggaaactgttcattttggagatttagaattttgtgtctgggatttaggaggacaagataaaattcgaccattatggcgacattattttaatggagcacaaggagtaatttttgtcgttgattcttcagataaaacacaatttgccactgccaaacaagaatttcatcaaattgttcaatcaccacaacttaaaggatgtcctatcttaatatttgccaacaaacaagacatagaaggtgcagtttcagttgaaaagcttagtgaagcattagatttacaagtcattgatcaatcgcgatatcacattgaagcaagttgtgcacttacagggttaggacttgttgatggaatgaattggttatctgatgctgttgttaaaaaacattaatcaaaaagaaaaaaatttttttattggaatcaaattttctaaaatttatcttttcgaatttaatattttatttaaaaatgaaaatttaaaacagaatttggttgaaatataatatttcgatcaaatttttgtccgaatttacaattatcataaaaataatctgatgtaacttcactagtaacaatcgtaagtcgttgcatttcatgattataatgaatgttttgtggtgacgtttcaccaattggtaatgtaaataaatgtttaaattctcgaatatcccaacatcgaactattccatcattaccccctgtaaagattaaattcggactttctgtaacattcccaaaaacactagtaacaatcccgtcatgtcgaatgatattaaaaataggttgtgaaactcgtaaatcccacattttacacgtttgatcagctgatcctgataaaaacatattttcatcataacttgataatgatgtaattcctgatgaatggccaatacatcgtgaaattatggctccattcttcgcatagatttgaatactatgatattcacttgatccaactacaagtgattcacctaatgtagtaacagatgaaatattcggaagagataaacataaacaaatatcaaatttctcttcatcttccgtttctttaacttgacttaaaagttctggtgaccatgaaagaatagttgaacctgtcgctaatactaaattatcattccaaaaattaattactgattgatatgatcgacgatgactaattagaagattatgtacattttcaaatgtatcaagataatatgatttaatatatttatcactatgaacccatattaaattatcttgataattataaactatagatgtgactggtgataaaaaaattcaatatcattaacttgttctttgaatatgaatctttcgtcgttgttcttctgtattatatgtaataataatactttcaccattatgtaatatataactactttcaatgagttcatatggttgataattatctaaagtaggtaaattatcttctttgttttcattaggattaatattaatagaattattattattattaaatgtattaattcggcgaatgttttgaaattcatgttgtggaactgtcgaaaaatcaattaatgatgttcgcgattgttgaactccaattaattcttccaatctttgattatgtaatgatataattttctctgtaatatgattctctgattcaacttgtgcttgaaaaatttgttgtggtttctgtaatatgttttcattagagattaataattccatagctaatgtaccacgtttaggttgtttactttgtgatgaaacatattgtggcgttgaaatgatttgtggttcttgttcttgtttaataggaaattgtgtaactgataaagatcgcgttggaatcaaaaatttgacttgtgacgaaaaacttgaactcgtttctgttttaatttcttgtgattgacttgaaacaatattctgattaggactttgacttgaacttgacgaattagatgaattaggtgaatttggtcgtaaaaaaacgcgtttattattattaaaccataaacgaactgttcgatgactccaatgtttattagtcgtagaaagaatacctacaactgtttgaacaacttgtgatcgttgaatagatctttctggatgtgaaaaataaatttgaagataatgtaattaaaatttgcatttcactatcacttgggaaataacgtccatctttgttttcttcttcattcatacttttcatattccttatttatatcgtgatatttaaaaattttggttgtgtttggccaaaatcttcttgaatttaattttcaatcgattttaacggattctttttacaagaggaagacgtttttcttcatgattcataattttgatgattttgctaaataatttttattttatatattttttaaattttgttattctaaaatattatttttttttttttcatcaagtacataaattaaataaacattaatcttaatgataattaatttattcttcgaattgataatattttctctttttgatagtggattcttgttgataaagattttatatatctttttattaaaaacagaatatttcataaatcataggaagccgtttatttacaactacggttatcattacaatatttttttcagatatttacaaaaatataaaataaacgtatttcgtatgagtgacgaacgagaacaacttatttattatcttcgaattcaatataataatggagttcctaatgaaggtatggaagaacaaaatgaatatattgatatgattaagaagattattgaacttaatccagtattaagtgaagatgagaaagttcttctttctttagtttataaaaaaatgcagttacattgcgacgaaatgctattcgagaagttgagacacatttacaagatccatctaataacaacaaaccagcacgtcaacaaaagttgtttgaatatttaactattctcaaaagcgaattaaaagatatttgcttagatcttattaaccttatcaaggacacgttattaccacaaacatatgcaggtgaacaacgagttttttatgcgaaaatgcaaggagattattaccggtatatttgtgagaacaaaggcgaagatgtttccgaatacatcaccaaagccagtcaatgttatgatgaagcacttgccattgctaagaatgaactttcacccacttcgtcaacatattttaggtgttgtattaaattattccgtttttttctatatgaaattatgggcttccatgaacaagcgatcgaactcgcatcgcgtacattcacagagacagttgataatttggattcgatgagttcagattacaatgagtcacttatgatattacgattgttgcaagaaaatcatttattgtgggttgaaaaagaaaataactaaaagaaatattttttatttaattctaatttttgaatattttaaaaatgaaataaaataatttttgactttcattaaaatactttaaaaatggattgatagtgtaaaaataaattatgattaataataaccagaaatatcgatgtgaaagaaatgaaaaatcacttttatgcttatgaaaagtgaatttttagggtgctccattgagcggtttggtcgtcctttcggatgggacaccttaaagcccacgagctcatacaaaaatcacgtgcagatcttcttgaagaacttgcaacattagagaagaagcttttcgaactccgcggtcagattgccacatcatcatcacgccaaaaactttcagaaatccaaactgttcgtcgtgatgttgcacgtgttaaaactgttcttatggaacaacaacgtaaggcccttaaagaaaagtacaatggaaagaagttagttccaaaggatatccgtaagaaacaagttaaatcacagcgtaaggtccttccagccaagtatgccaacaagcttacaaagagagctgcacgccgcgccaagtatctcaagccagttaaatttgcacttaaggcctaagtaaatacttatttgaaaaattaaagctagaaggaattacaaactgctttctcgtttctccaaatattatagctaatttttttttattagctgtcgaaatttttctatggtatttcacattggtaaaattcctagtgggaatcattagttatatcatttattctgttgttttttcttttaatgaaaataattttcaattctttttggtatctagataattggtaaaatttttatttattaaataaattatttttttgcttttattaaagcgtgttttgatgaaatttaaattactgcccattataaattcatttttatttcgtttctatatctttttagccatttgaccaaaatgtgtcaattttctaacgattatttgtaattcaatttatcaactttttaaaaaaagttctatcgcaaccgtttcccatttttatgaaagctctcacacttaaaacaggtaagtcaccgaatactgaatgtgccaaaaccaataaaatatatgttagccacaagaatctcgttcaaattccaaatgaaggccattatgtcaaagtcggactgtatctttttcttgttgatgaaaatccaggcgtagacgacaatactgttgccttcaacacagaacaacgacggcttctcaattgttcgcttcaacaatcaataaatctcaaatttgaggttccaagttaccaatgtacaaaagtcacgtttgatgtttcatttctcacacgtagcaaagaacgcaagcttacacttgatgcagataaacttcgtgaagtatatactcgcaccatgtcacaaataccattaaatcttaatcaagctcttatctttcaatacgatggagatcaatttttacttaagatcgctgccattgaaggtggaacacttggaaaagatctcgaaattgttccaaaggaacatatttctactgcattctttaatcccaacatcacgtctatgatctttaagaaaggttctgattcacaagtcatcattgaagacaattcatctccaagtgttaccactgtcattcgaccagattttaatttcgaagatttaggcattggaggtcttgatgccgaatttgcaactcttttccgccgtgcgttcaattcccgactttatccacccaagatgattcgagatcgaggcatcaaacatgtcaaaggaattttactttatggccctccaggtaccggaaagactcttatggcgcgacagatcggtaaaatgcttaatgcatgtgagcctaaagtcattaatggaccggaagttttcgacaaatatgttggtgaaggtgaacgaaaaatccgcgaactatttgcagacgcggagaaagaccaacaagaaaatggggacaatgcgcaattacacttaatcatcttcgatgaaattgattccatctgtaaaaagagaggcaccggtgcaatgtccggagttggcgacactatagttaaccaattgttgtccaagatcgatggcgttgaagcgttagatgacgttttattgattggtatgactaatcgtaaagatctgatcgatgaggcattgttaagaccgggccgtctcgaggtgcaattaatgatatcgttgccagaccaacatgggcgtgagcaaatctttgcaatccacacgaagaaacttgttcaatgtggcgcattagcaagtgatgttagtattaaggagttggctgagcttacaccgaattatactggtgcagaaatcgaaggtgttgttaaatctgcgcaatcattctcattgaataatggatttgatccaaagacaatgcaactaaagagtgaagctgatctaaaggtcacacgcgaacatttcatgcttgcattacaagaagttcgtccagcatttggtgttgaagatgacattaagaaattatgtacacgcggattatgtgaattttcaagtacattcactaatacgaagaaacatgtcgagaaattcatcgattcattgctacaatcgaatggtacttctttaatgagcttttgcatctatggcctccccgcgaccggtttgacgtcatttgccgtgacgatagcgaaacaggggttcacttatgtcaaagttatccttgccaaaaagttcattggacgatcagaagacgccgtatcgttagaaattttggacacttttgagaacgcttataaatcgaagcaaagtgcaattatcatcgatgacatcgagtctatcatcgaattctcgccaattgggccaagatttgcgaacaagaccttgcaagctttgttagttttgttgaaacaaactccacctgaaggtcataaacttgcaatctttacgacaacaagtaaaagagaagcaatgtctatgatcggaattgacacaagatatttctacgaagaaatagaattgttgccattgaacaagccagaacatttgattaagttggcaaaggaatcttgcaacgccaatttgattatagaagaagatgacttgagaagcgcaagcgagtacttaagcgctaacccggtgcctgtgaaaagagcaatcgaggcaatcgatttcgctgtgttcgaggcgaaggacaagccgttggtttggaagaacttggagaagtgcttgagacagcacaaccgaacatcagttaattgaaataaataaaaaatattttctttatggcgaaagatgttcaatgtgcatcaaattcgaatttgctgtttgactataagttcttcataacttaattttgtttgttatgtatttgtaggtgaatgtatcttctgcaaaagagtattgttcaattgttaaatagtaattcctgtcgttgaaagaatttgtggtttcattttcttatgatattcattttcattaatttctgtggctttatttcaaattcgaaatattaatactacttgttgtgttatgccaataacaattacaacagcacgaacaataataccaattattattgcatgactattattgtcattttgaaattctactgaatttatatatgcaatgaaatttgatgaaaaattgtcatatgtcgcgtaaataatgattacataatcataatcattatatgaaattgttgaattataaagaaataactcagacgattttgtttgagtttcataaatagtgaatgaatgtgtaattgataaccaaactgttaatacgtaagaaaaagatcaagttaaatcattttgaagtgatattgtgaatgcatttgattgtgcaaatgaatatatcgataattatattcaatctttcctggaaatggtccaaatgccgaagttcttccatatgttaaatatgtaacaactgtcgctttgactgacgaaaatgcattttcaccaaacgcatcgaagtttgcaacagttcaattacagtgctgaactccgatacttttgttacatcgaaacattatgtgataaaacttttattcaactgcatgcaaattgtattatgaactcaccaaagttatcatcagttgtcatccaaacctgcgcagttccacagtcgccccatgggtttgtcgtttcatatgattcttccatttccatcagcagcacagtgtcgtccggctgatcatctccttgaacgaacagtggataaccgcctaaataagttacgcattttctgttcgggttatactcttcttcgattatcctatttgcaattaataagtcatcgctttgcatgtttgggagtaacttcttcagcatttcaagtgatgtcggatatgatgtcgattggcgccattgtttaatcactcgattctcattaaatatgaattgaggatcgatttcttcatatatcaaatcattaatttcatcgtttttatagcaaatgacttttaaattgctataacaatgttcacatgctaatccgattaatacacattcgcgttcactaattggaaaatagctttggatttcagtgggaagggatgggacatataatgaaaatattaatgaggtcgtttgaccgcatgattcacatttatgatatccgttacatggaagatatggagcacgtccgccaaacttggacacgcgtggattagtggtatcataatcttcgacaattggtgcataacatggtttagctaaagattcaatgattgatttaagttcttttaccttttcattcacttgtgaaacaacatcaggaatatcaatgccattgcgaagtttgattaaataaacaagatatatctgggattcagtaagtgatttgccagaaaatgttttgacaaagtctttgtccaaattaagctttgcaagaacacggacaatgctgttcaaaaagtaataatcaatgtattgcttccaattagagcagaaagaatagaagctatcaagcatttctttcgaatttgtacaaagtgaatcgatagtgagttcaagaagatttccatttccaagcgcgaaataaccacagatgattttcttaataattatatgaagatttgttggtgttgcatgttttttaatgactgaaagaaaatcatcaataactttcttgtcaccagcattttgccagggcacattctttgctttgttgaatgcttcttggatctcagggcaaagctcttcggcaccaagcatgtttttgtgaagtcacttgtgatgtgtattaataaacgtgcacacatttgaatcgaatacaatttttgtgtggtcgattttgacaaagtctgttcgaataatgcttttcaaaaaaaaaatttcagcgttcatatttttacttattcatcttttaagtcttgtaccgatgttgcgccttccttttcaactgccaccgacatatcatacaacaagtcctcatcatagtccttaaaattatcaattttttcttgcacctgatctattgacaagaaacaatacttatctcttttaaatatttgtatgttttggaccaatttattaacacccaaacattttctaatattaattagtccattaacgaatgtttgtgtgttttcataaaacataaacaaatctcttaataacattcctaagtaaggcaacactggttttgaagcacttagtttttcttcattgagttttctaatttttgaaaagttatcattaatatcaagtttctcctgtaaagcttttaacttctccaaataatttgaatcgactctttccattgtgatctttagtcgaaacattgcgttgctttcgaaacttgacaaaactgccatcgcgtcataaaaattgttataatcgaataactgttgtgctaaatcgatcatttgttgaatcctttgtatccttacctttaagctttttgtgtctaagattgaatatgtgacccattgtgataatcgattataatgttcagtcaaagcagtaacgtttggagcgcgatactttaaacgtggcttttcccatgcgcaatccaatagctcgctgcgcccaatgtcatataacttgttggagcaccaaacggtcaactggcgggcaaattcgataattggcaaatccaaaagcgaaaagtctccggtccatagcccaaccactccatccactttcactccgtctttaggtgcattagcttctatttgtttaatacgtaaaatggtttccttggaacgattttcaaacattccagtaactaatttaccaaatcgtgggactaagacttcatcattataatgagtggccgcatcaaggatacgtggctcaatatcattgatagaattacgaatccatactttgaataatttgacacataataattgctctgctttttgtgatggatcatttaaaaccatcgagaagcgatcaatgagcttctgaagaaagttcttggatgaagtataggaagaaattgtgagacatattgcattcgttaaatcggatacaaaagagttcttagtattggcatcgtctttggattcttcatcgggcgttgtgatgtagaatatgatttggttaagagtggcttcgacaggaagattagtattaggatcatatttgatgtcatcgggattattaaatacatcctctttgagtggtttatccgtctgtgtaccacttggagctgcaccaattgtttgtgatatttcattatcaagtgctgcttgagttattttgaatgttggaaatgaatgtgatgatggcatagataactcccaaaacttttcaattcgatgtacgccgcgttgaagaagtatgtttagttgcgaataaagcatatgtggtggaattataaaatctgatccccattctgaatgaagtaatgtttgtgatgttgtaagaccaagagtcctaaaatgttgtgagataagagctaagatgagttcttgtgaaagaagtcttgatggaggtaaatacattcttgcaaatgcagctgagcgagtaataggattaacagcaagacgaagcctttgaatgcttgggtgtgaggttagaacatcttgaagccaaccatttcgattgatatgtttatcagcagtacattcagatctaagacgatcaaactcatcagatattttcagtaactctttcgctctcctcctgtgtctttttcgtttttcagtttgtggcgtttttgaatttatttgttgttctttttctggaataacaattgtttcttgagaagataaaactgattccgcagacacacttggcactggatcaaaaaaatcacatccatgttgttcttcttcatttttattgtttgaaatttttttgttttcttccatttgattgtaaaaacaattgaatcgccagtacaatcggaaggagggggccgttataatggctgattaaaacaaattcaatgaatttacgtttttgaatataaatacgattatatttcattcatttgattctatcgttgtgatatcacatgcaaccactttcaagactttatgacaattttttttaagaaagatgtttttcatttggtttatttaatgcacaaagaatttgcttcaaatttaatgtacatctaatcaaatgtgataaattcgtttgttacttcaactagatatgaaattttgaaataaatctttttcgcttatcatcattggtaattgatatattcttcaatttaaagtagcaaaccaagatttcaaaataatatttgaaattttaaatcaccttaattacaactaatcatatgttttcacttgtatctatattgtgtgaaatcctctatccaaaaaaataataattttcacatttttgaatcaaaaatcatttaaaaatatacaaaccattttttgttcatattaataaagataaatcagataaatatgaatctttctttgaccaagaaaatattgcttatgaagaactttcgaagtatgattttgcacttataattaatatgatcgaaaagaaagaagaatatttaaaatgtaacagataccgttaaaaagcaaacaaaatttgaacgagcacttttttctttaggacttcagtagattgaatgaaaaacgattaaattcatgatttgttgtgaacggtcaccaccgagaaaatattgttttgtcaataaatcaatacatatttatagtttaatattcaatatttttgatgtgttctttcaatagtttttgtttcttattccattttctgattatagttttaaaataattcatctcgtgttttataaatacaatataattatatattttttacattataatcgaacatggaaatcttcatacatgaaatagaatagctcaatatggtaattattcacattatgtaagccgacaagatttttctttctctgtgtattttccattctgaagaattcattgattttcattgaagtcagtacttccatgaaggaagtactgaatgtatttattattattattattattattattattattattattattattattattattattattattattattattattattattattattattattattattattattattattattattattattattattattattattattattattattattattattattattattattattattattattattattattattattattattattattattattattattattattattattcttattattattattattcttattattattattattattattattattattctgattattattattattattattattattattattattattattattattattattattattattattattattattattattattattattattattattattattattattattattattattattttattttatttaattttttttatagtctaatgcatacaatagttcatcattcacattgttattttcaaaaatattcattaacaaatgatatcatttatttatgtgttcatacgcaatgtgtgatatattgatcaaactcgaaattaaataaatagcatcaaaatattgtaataaatatttagaataaagtaatagagggatattgtagaaattttgaaaaacgattcaattgcaaattgcaagataacttcataatattatcatgctattttttagatttataatatatatactaacgttatttatttaatgcatcaaataattaaattatatttaaatttgtaaacgaatttttcatgttccaactttttaatttttttctatggtttttgaacgtatttttttattataaacatttttatttccaaatcaaataataatttatcaaaataatattgtagcatcaattgaaattattatgttatttattatatttcagaatcaattttcattattttttggtttttaaaatgaattattctgataactaaatattaagtgaatataaatcgacattaataaaaatacaaatatcgaatcgaatactaaaaaatgtaataaagagatttcaaacctcctaatctaaagtgaattgattatcaatcataaaaaaatcaaaatcaaaataattaagtatttaacaaagagcattaataatatcaaatattttttgagttcacaaattaaaattatgaatatgtattgatttattaacaaaagaatatttatcggtggtgaccgtttggagtacgattttaattcagaatatttttgagtggggcaacggttttttatcaaaaatgttttgttcggactttattccaaattaattgataagtcaaagtgtttaaaagaatcatttaatttaagaaaagaaaaatcataatcaagaaattgatatttgaaaataatctctgatcgaaatacaattttgattatgttgaaaatcaagaaaaaaaaatgtactaagattccttattttttatttttgctgtgttttgtggttgattcttatttttgatttgtccaagtagttccttccttaaaaagagcagtctgtttattttcactacgatttcttgttgtttcttttgcaaaacgaataagatttcagtttctttttccttcgttttaaaaaaattatttaagagttctgcttcttgttgctcatattttttaagaacttctaattcatagtctatttcttgctttttttgttcaattatgttttgatatgtatttaatttttgagttgtttttaattcataattttgtaatgctgctttttgtttcctaattagcctagaatatttggatcttaccttaagtgcacgctttaatttttcttgttcgattatatccatatttgaatatttttcttcaaattgagaaattaataattgttcgttcttttgagccattgaaatttgatcttcaagtgcttgtttttgacgattaagtccatttacatatgtaacgactttttcttcatgagatgtgaaatcttttagatgtttgctatctgaagcaaatttatcttgtagttttcgataatctcctctaatagaatctaattgagatcttaatctttgtttttctgagctgctttgctttgatttcatcttttggaaatgttatatgaaaacaagaccgtttattaacgaaatgtgacaaaaaaattaaatcttttaatatttttttataatgtcaacttatacagaagtattaaatgatttcccaggatttgatgacagtttgaatacagatgttggttacattccacttgctagtcgtgatcatattcctattattcatattgttggaatatgttgttcaatgctcgcatatcaaattgcttattccgttgaatttgcattgggcactccaattatgaaacgtcttggtgtatcacaagtagctgcatctatcatttggttttcaggtccattatcaggtttaattgttcaaccattaataggttattacagtgatatttctcgtttcaaactaggtcgtcgacgtccatatatcattattggaggtgttggcatcatcattggttttcttcttttatattttgttgaacagattggctcgctttttgggagtgccgagcatgccatgtcaatctttgtctttatcattgcacttcttgagaccaatatatccataaacatattacaaggtccatcacgagccatattaggtgacattatcccacaatcccaacaagttctttccaacaccattggttcccttatgttaggccttgcagcgatcatcactaatctcattggcggtttgaaacttggtgacaaaaccaacggcgtattcaccaacgatgagctcaccataatcgtaggtgtaatcttaatcattattggcattttgatcacacttttctgcggtaaagaagaaccgttactcgaagtaccaatacgcgaaaacccatttaaggaaatctttaaagccataaaaaacataccgcgaccagttcttcgtatttcgctggtctactttttttcgtggatggcgtatttcccattccaaacgacgacgaccgatttcttcggctctgacatctatggcggcgttgccgactctgaagatccgactgttttccaactgtacgaagatgggaaagcgtttggaatgttagtcattgccatctctaactttttagttttgttatattcatttgtccaatcagcaattatcaaattgttgggactaaaactttcgtattcgatatcgcaaataatcgaagcgttagtgttgatacctgttttcttcgtcaagaataaatgggtattgttgggccttttggcaccgctcgggatatcatgtacgatatttaactcagttcctttcgctgtagtcggaatgattataccgttggaacaaatgggtacgtacatgggcgtattgaactgcttcgccgtcttaggacagcagtgttcaagcttcttgctcggatctggtgttggcgcactgtcgaataaaaaaggtccaatcattggatcgggttcggcgtttgcaattgtggccgcagttttgtgctattggataattgtgccacaagaaaataatgaaattaatgaagagcttttacgctcagatcctattaaatgatttgatttatttagaattaataaaaaattttgttgttaaaatttagaggaaaaatatcataataaatgttatgtaatgtttgttgtttttggataacgaaaattttaccaaagtttgaaactgaaacataaaaatgaaaaataactcgtaatgagaatatgcattaaagaattctttctcaagataaaattgatttcaaaccaaaaaacaacaattatgataacatctaatgtactcacaataaaacatttcatttaaaaataaatccacaagacaattttttgaaagtcgtataaatttgaagctttaatttatgtataaaaaaattaaaaaaatctatcttctgaaattttagtaaatttaatggaagtcattacctagtgatcagatttatattttaattattacggcttttcaaatctatttttaatttccaggtatgatttctatactttacatgtgagaagaaatttacttgatcaataaaagaattttattaaattccgaatcataattctattattagaagtcggacgcttcttttaatactaataatttgtcgtttttttatctgatgtaattgttatattcagtaattcttcattatgtaataatatatgtattaatatttatttgtttaattcaaaaatattataaacagcactttgggcttctttagatggtcatgtataaaatatggtatcatcaaaaaatataaatacagatataatttaaatgacgtaataagtttttattttgaaaccttcaatcaaagaatagttacacattcataaagtattcaataaattattgtgacaagcatcacttttttaatgttttttaatcgggctgtattttgccaaaccgttgcttgttttacattttcatttaaaatatttgtcatttatatttttattgaaaatcaaattgaaataaatttgttttttaaagaatcgatcgattgagaggatttggaggtttggtctgcggttatgtaattgatccctcacttcactaaaatttaaattcaaaaagttaggggaaacggttatgtatccatggaaatgccattcaattttaagattttcattgaaatagtcaatttttaaccatgtgcgagaaggacaagtttgttccaaatatccacacacaaaaatttgaaggttatttaagcgaagttaaaaacaacagcgctcttctcaggttttggtttgaaaatgatcttcttgaatttccgatgaacgttgaaatgtttcatatggatgaagatcctcttgaacaaggcaaaaaaatttcatttcaactcatgttttttcaatgtggacccattaaaattttcaaagataaaaaagagttcaataccgacgaagtactgtgtggctttgcaactgaatcaattataccatctggtactttctctgcttcttctgatgaagaagaaaagaattttcaacaaaatccaagtgtaattatgaacggaatagtaaactctgtagaaaaatgtacagagggtgaagaagacacccttttcttggaggtaatatgccaaggtttcaggttcactgtaagtattaatgaaccagaaaacctatctgttgaagaaggaaatattatttctggtgtgtttgaggcaattggttcaccagtgcatagagattatagttcataaaaaaagattattttatttcacgaatttttttgattctaagttgagataaatttgatcaaaaataataataatatgaataacaaaataatgtgttaagtgcagttttttggttcatatgcattgaaacaacttattaaagaaaaggaaaaataatttttttaaagaatgtgatgttggtttggagtgccccaaaatttggggtgttcttttaaacggctttgtcggttttggtccttccttttttaagtctcatggtttgcaaaaataatcgcgttcctaatgatcaccttcgtaaagattggttccgccgcataaaattctactttgatgacccagctcgtaagaagaggcgccaaattgctagagcaatccgtgcaaagaagatcgctccaagaccagttgaaggtccacttcgcccacttgtacattgcccaacagttcgttacaatcgtaaagtaagactcggccgtggtttcacagttgaagaagtcaaagctgccggatttgaaccatctcgtgctaggttcatgggcattgcaatggacaaattccgtgttcatacaaaggacgaaattaagcaagccaacatcgaacgtctcaaggcttataaggctaagatggttcgtgttcatacaaagactgaaaaactcccagctggtgaatccattccatcactctttgcccttccaaaggctgatcaaaaagtcacatggcgtgtaatcaaagatgaagaaaagaagacagaacttttcaaggctaaacaacaagcccacaaagaatggagagcatcaatcaaagctaaggaagctgctaaacataagaagtaaatcattaatcaattggtgattgaaatcaacttaattttttattggaaaatgaaatactaagaacattaggaaatagtgaaataaaattcgaaaaacattttttatcaagattttatggaaaaattaaaaaaaggatttcattgagtttgttcgatttgagtagaccgtttacgatccttttggtaagtttattttcagaaaagtagatcaaaattcatagaataatttgaattggaggataaaatgtccactttttgagcgcttgcagctggtcatttggtaaagttgctgatatgaagagcattgcagttctttcaagtggtaatgacaactgtgggataaacggcgcaattagatcagctgttagaagtgcaattggtcaaggtttaaaaatatatggtgtcgaatggggtttccgaggactactagaagatcgtattcatcctattacaagcagatcagttagtggtattattggtaagtcaggttgccttcttggtaccactccacccaaagatgaaatggacaaaagcattcgtcaaattttagcaaaccttaacaaaagatccattgaaggtcttgttattgttggaaaccttgattcattccaaaaggcacaaaagctaattgacaacggaatccgtgttattggaattccatctgatcttcaagacagcattccatgcacagaaatatcattaggagtcgactctgcagtcaacaatatcatggggtgcattgatcacatccgtagttgcgattcttcaaaaaatcgtagttttcttatcgaagttgaaggaagccataacggttctcttgcactcaggtctgcaattgtttcaggctgtgaagtctgcttaacaccagagaactcagcaaacgatgaagctggacttaagaaaattgcagatattattgacaaaacaacaaagctcgggaagacgcaatgcctttgtataatagcttctggatggaaaccaggaattaaagcccttaaccaatatcttagcgatcattatggagaaaatgatgttgcaattcgagaaacaatactcggttatgtccagcgtggtgggtctccatcagcatttgatagaatattaggtacagaaatgggcaacaaagctgtacaagcactcattgatggtgaaaccgaatcaatggtttcttggaataatggaaaactaagtttggtgccattctctacagtagctaactctaagaaggacctctcagagctattacgaactttcaagctgactaattcctattgagtaaaacttttgttattgatttatataaaagtggcaatgtatgatcgaccgtttaaaagtgtcgtttataataaataacttttcacctgaaatcaacatcatatgttaaaatgtatatatcgcttcttcttaagcccaaaacagagatttccttgtagatccacaatttaatacatcgcaaaaaaaaattatttctttgtgtctaaaccattcctcgtaaaagttgtttcgtcgacagattttaggggggtcgttatataataaaccgatttttgagcactttttgaccatcagaatatcttggtaaataatcaaaattaaaaaatataatatatatattaatatttactctattttaatattatagctagaaaaaaaagaccaccacttaatagaactttttagatacgatttaaaataaagtggtaataaaattaagaaaattgaatgaaaaaaatcattctgaagatttcaagaactaccatttataaaatataatatacatcgaaaataattaagattggacttaaaaaatatatatttcggcaaaaattgatttcgaaatttgcattttgatctgtatatttttttctcaatttgaagacagatttttacttaagtgatgataaggataataaaagtcaaaaaaatcatcagaatatgtttattttcccagtttgagtactcatacatgttaattaaactgaaaatcaaaattcagaaaaacaataaactcattcaaatccgaaaaatgtcaaaattgcagaatgaacagtacccagtttcaaaagcagaaagatgaatctattcctaaaatgcttgcttctcattatactaatgaagaaatacaagatttcttaagtgttggctcggaaagaatatctaaagttaaaaaaggattccaaatgaaccagaagattggtcgtccatcagctttaacttggcaaatgattgattacatcgaaactctttcatatgcgaataccagactaactgatggagatataacatcatctctaacagaaaagttttcaacaaagattttgaaatcaactgttgctcgcacaaagaagacgcttgggtattttttataggccaccactcgttaaacaagagatcactgaaatccaaaaacaaatgagattcgaattttgtcaatgggttcttgacaacaaatcccagttcgagaatatcaacttttctgatgaatctcgttttggaaagtgtccagataacagctggtgaaggataaaacgtggtcactggaacgattcgtgttatcatgaaaaatccaaatttaccccgggattatggtatggggagctattgggcatggattcaccattaatgcaatgtttgagttcggtcgattcatacgagtacatcgaaatcttgaaaaaaagtcaactgattccaacatgtgatatgaaatacggacgttttaattggttttttatgcaagatggggctccatgtcataatgcaactcacacaattaattggttatgcaataatgtttataatgtgccaggatggcctccaaactcgcccgaccttaatccaatagaaatcttgtgggcgattattaaacgaaaatcaaaaaagttataattggagaaagaagatgatgttttcacagctatcaatcaaatttggattacaattgatgataaaattctcgatgcgcttttaggagattttatcagaagatgcgaaatgattagagatcttgcaggagaaagcgcatcgcaatttatatcgagtcacagaacggtgagcaaaaaaattgatgcagataattttcgtgcatggacaagatttgaggatgatataatattggtgatgcaaaagaatgtggggaatcgtctgacattgattggtcaaaaaatcgggagaaataagattcagatcaaaaatcactatcatacatctctaatgaggcaaaataatgaaagactgaggtcaattaccccacttcctagcatttaaagctttccattctgtgctaacaaccccacctgcatttggaattgacaacttgattttcacagatcaaaactcagaagtaaatcgaatgatttacagttttttttgaattacgatagaaacgatgatttttatacaaagcccgaaaacagtcgttttaaattcaattcacttctgagttttgattaccagtttacataatttaatgaatcaaaaaagttatggaaactcaatagaaaattgcctgtggtagcttttaatttattttttttcactaaaataactttaaatttcgtgaaaaaaaaaaagcaaacagctgtaataattatatttttcactcactaaaaaagaaaaaacgttaacatccaaatttttcgatattagcggttgtttaagaggtagatggtttgcacatgggtgatcacggttgttatttagataaatccctcttccacatgattccatacgttctttgtaaaaatatttttttgattaagcctttgtttttggtcttcaaaatttgtgatttttttattaacggtcactggatctcaaactcagcatcggcattcgggggcggttttgatttttatattttacataatccgctaaaatatttcactactattataaacaattaaacatggatttcaattcagttgtaaatgtatttttaaatacatctcaagaattttataataaaataggaaacattgttcaatctgcaaaatcaatcattaacaaatttgataatacttatccattatttttttttatcgaaatgatgaaatagaaaaacattaagaaatatcatcacaaaatgattttaattttaaccaaacaataaaaccattgctttatggaatatgtttttatattaattaataagaaatgttacattaattacaacgatattataactttcattttatatatatttgtgattaaatattattatacaattaattatataaatatggtttattctttagtgatcactctttttattaaaaaaatatatcataaaaattttcccttaacatatataacaatctgcaaattactatatgaatactatacaaaactttttaaacttaattcatttaattaattattataacaatatatttaccgacctactaataaattataaaatgacataaatttataaaaattatttttcttaattaaataaataaaagtgtcaaaaatattcttttttattattttactaaaaatcatttttttatataaattcggacactttattttcataagcattttcaggtaataataacattgtttcgtcaatgatttgtcttggcgtttttgatcttttcattaattttctcatttcttttctttcatttgatatttctcttggtgtttccttaatacaaaacgaatcaagtaacgcacctttatccaatttatctttttggaaataatttcttaattctcctttatgtgttgcgtaagcattgatagttttttgccatgcattttttgccatttcacttaaatcattctcttcaactgttgacattgtttcttgtttcattccattaattgctttttgttcattatttcctttcattgctgaaactccttttttaataagttctttacatttatattctttaatattaactttactgttttgaagtgattgaataaaacttaattcattttcacttaaaaaaatatatgatataccttcattacctatacgtgctgttcgccctattcgatgaacatattcttctttatcaagtggtgaatcatattggataatagtagttacatttggtatatctaaacctcgtgatgcgacatcagtacaaaataatactccaaattcttctgatgtaaatttacttatcgttttagatcgttcaatttgttcaacattcccatgaattcgaaatattggacattttaaatatggagaatatgaaccaatttcatcattatctgtgctggaatggatatcaataatcgtggcttcttgtttgtttcgtttctgcatttcattatattgtaatcgtggaacatgtccacgttctgcatctgttttaaaatcaaagaaactaaaaaagtgataatggaaatcaactgaatcacatgtattaataaatactatacttttcatcccagtatgtcgtcttcgtgcattcgttatttctaatcgtaataataatgctaacattactaatcgttggcgaatatcaacaagaagatatctttgttgtagttgtggtggaattgaaaaatctttttggttttctgtatgaactccaattgtaatgggatcgtttaatgataaatttgttaacgctttaaggtcttctgttaatgtggctgagataagaatagtttgtcgtggtggtaacgattcaataatttctgtaatgggtttgaaaaatcctaaatctaataaacgatcggcttcatctaaaactaaaaattgtaaatttggaaaagatttgaaattttgcgtgttatgaagatgatataaaaagcgtgatggtgtagtaattaaaatattaataccttttcgaatacgtttcttttctgtattaactttttcaccaccaattaaaataccggcaacaataaaattaatacttgaattcatcttatgaatgactgaatatgtttgaagacaaagttcgcgtgttggacaaataattatagcaagtggacccatagatcgtttgataggattaacctcagttggaaatctaacagttaatatttgcattaaaggtattaaatatgataatgttttaccactccctgtatcagcacgcattaaaatatctcggccatcaataataggttgatatgattctgcttgaattttggtaagtgtttgaatattcattgctttaactaaagcatcataaacataaggatttaaattaagtgaatctggtgtaatttttgaaaataatttttcatctatttcttgagttggttgctcaatatcttttttcttcattttttttttaaattttttcctttggtcgtcatttttcagttatcattcaaaattttgaaaacaaaatttttatggggtaccctaacagcccctgtcaaaaaattctatcgtttcagctggaaaaaagattaaaaatatttcatttaagtatttgaacttatacaaacaaataatgctcaataaacatggcctttaaatgaaaatttatcatatatgaaattagaattttactgatttaaagacgacgaccacgacgaccacccttacgacgtgtggaatcatgtggaagaggggtaacatcttcaatacgaccaatcttaaggccggcacgtgctaatgcacgaagagcactttgagcaccttgagctggaagacgacgtgaagaaccacccttacctgagaatttgatgtgaaggccatcaatacccattgttttgagacgtgcagcaaccatttgtgcagcaagcatagcagcatatggtgtagattgatcacgttgagctttaacaaccataccaccagttaccttaacaagagtttcggcaccagagagatctgtaacgtggataaaggtatcattctttgtagcatagatatgtgcaacaccaagtgcaatttcgttttgtgccttagttggaccaacataagcttcttcctttgtcttttttgttgtttgttgttttgcttcaacagcaggtttggacatttttgcaaaggccgaccaaaccgaaaaacctctgttaggggtacccctaattataaatccaaaattgaaaaacttttaatcgttaatatttcatacggataatctggctttcaccaccatgagttaatgttttattcattaactttccggaattggtaacaatgaaagagttccatttatctcaaaaaagaaaattaatcaatcaaaaataaaaatttattgataaaaaaaataatgtggttataattccttccctaaaaatgcatctaacttgggattttcacaagcacctttagatttacatatttcatatggagtcatcgttgtttttgatgcttctgaaaaaagcaaatcaatgttatcgcgtacatagctgcggcacccaaacctaagagtaaattgctttaatgaagcacattttctaaataattttttttgaacttgttcttttggaattcccttttttgctaatcgaattccaagtgataaggttgtttcgcaaagtttacaaatatttggtgtttgttcttcacttgaagaaagagacaaaagaatcaaaaacatcatctgaccaagcattgttaaaaaattgagatgtttacttctaataacgaaaaaaaaattacgataaaattcaattagaaaataaacggctcaatcacacagtttgttggaaaacattcaaaaaagtttaggaactttttcataaagtaattaaaaagttttcgagtgaccgaattacgaaaagtgaaccatattcttgaccgtttagaattttaggaaaccattacagatggaacaaaaaaaagtagaaaagatcattggtattgattcccaaattattacagaaaaatcggaattttatgttaagttttatggactttcatacagacattgtgattggattaccaaaaaacaattaaaaagtactccaaactttacaaacttatatagaagattctcaaagtatcatcagccttttcgcccaattaattttcttaaaaattttaccatatacaaaccatacgaagttccatttgatgaagggtatataacaccacaaagggttattgggattcaagaaaacaagaaacaaaaagaatatttggtaaaatgggtttctttggattatgaatattgtacttgggaaactgatgttccaaaacagctaattactgaatataaaaatttcatatcaaatccaaatcctgttaaaataactacaccttttcccaaaaatccggataattttgttcaaatagtaaattcaccacattttaaaaacgatcatactcttactaactatcaaattgagggcctaaattggcttcacaataattggttaagagatgttaattgtattttagcagatgaaatgggtcttggtaaaaccattcaagccttagctttcttaaaactacttgaacaaaaatattctatccgaggtccatttatgattatttctccactttctgtgattcctaattgggttcaagaaattaatgaatggacagattttcgaactcttgcgtattttggaaatgaagggtcacgtgaagttcttaggcaacattgtttttattcaccagtcaagaatggagggaagaaaacgttgatctttgatatcgttgttatttcatatgatttacttatcaaagatttcaatgtattcagaggcattgaatttgcctatttaattttggatgaagcacacaaaattaagaacttcaattcaaaatcatacaaattttgcagtgaagtcaaagcacgaaatgttttgttgcttacaggtacacccattcaaaacaatgtattagaaatatattccttatttcattttattgatccacaagaatttagaaacattgatgaatttgaaactcaatataatgaaagtgatcctgcctcaatgaatcaattacgagaaaaaataacaccatatatcttaaggcggaagaaagttgatgttgattatcccataacagccaaagaagaaacgattattgaagttgaattaactaattcacaacgaacaatatataaatccattttaaatgataacagagaagttttattacaaacattaaccaagaagaagaccaatttaaataacatattaatgcaattacgtaaagtttgttgtcatccatatttaattgatggtatccaaactacagttgaagaacaatataaacaaacgaaacaatatccacctgaatatcaattaactaatgatgaagttatgcaattattaattatgtcgtcaggcaaaacaatacttattgataaactattaccaaaacttcatagttcagggcataaagtattaatattttcacagatgacacaagtattagatatcttagaagattatttaacatataaaaactatttatatgaaagacttgatggtgctactaatacatcagatagacaatatgcaattgatcaatttaaaactaatccaaatgtatttatctttttattaagtacaagagcaggaggcttaggattaaacttaactgaagcagatactgtaattatatatgatagtgattggaatccacaaaatgatattcaagctcaagctagatgtcatcgaattggacaagagaaagatgtaaaagtatatcgtttaatcactagagctacttatgaatcagaaatgtttctaagagcatcgaagaaacttgcgttaaattatgcgcttttagattctaattctagtgaacaagacaaagaaagttataaagagattgaattaatattaaggaaaggagcatattatacatttactgaagaatgtgatgaagccgataaattttgtgcggatgatattgatcaaatattaatacatagagctcatgtagtgaatagagatctgattagtggtgggaactcattattttcgaaagttaactttaatggtaatgaatcgaatgagaataaagttaatttcgaagcgccgaatttttgggagacaatattagaaccaaataataaaaaagatgaagaattaccacgaagaattacaagacatattagttatgctgaaatggatcgatatgattctagtgaagaatcagaaaacgaagatttatctgataatgattttaagccatcacaagatgagcctataaatattccttcttctgctgaacaaattaagacattttcatcatcaaagttaaatttattttataagtatttgtttaattatagttatcatgttattcaaaagaatatgaatgaaaatgaatttagtttcattcagtttttgatttcatatttttatcggaaattaagttataaattacaagaaagattttatctttatataaaaagaactatagttttccctgagatacatattaataatttctctgtttctatatttagaaatcctttttttataaataatattatcggtgaaaaagaatttttacttatggaaaaactcgaaaatttatattatactgcaatttatatatcaaataatgcattaccaaagaatttcgtgttcgcgccttcgatgaaaatggatttatttaattggtgtccaagtgatgatattatgttaataataagttccgcacattctccttatgaagtttttatgtttactataaataaagttttccctcaatatgaaaacattgaaaaatattcaaaattactattaaaaagaagggatttaattgtcaatgaaatttcattgttaattccggagagtttttcagccgaaaacaaaatcattaaatcatttcctgatataaaatatttaagtccaaacatttttaatcaaaacttccttacaaaaaatgaccaattaaaaattattcacgttttaagtttatacggtgtgcctcaattggacccaatccaaaaaatccaaaaaatagcttgtttagaacatgttaatataaatgaaatttattcgttcgtccattcaattatcgaatcaaatcaacttttgaaagaaagaatcaaaattaataacccaaagggcaccctgtacgatttgaattggattcctaagaaaaagttggcatggacaaaaaatttgattagtttactttgggagataaggtcgagattcgaatggtttttactaaagaaagaaaaatttaaattcgataaatggaataaagccccgaattggtgggtaaaaagttgcgattgtttcttgttcgaaaatacttgtaattacggttttttatcttttgctatatttgcatatataaccccaacttccgatagcaacaaacaagaaactcaacagtttattgcaaaatggaaaaaaaaagagatggaaacattaagacctttttgttgtaagagatatgaacatttgaaatttttgtttccttttaacacaagatatgaaaggcttaagagtgttttttcacaggcattaaaacaagatgcacatgaataacagatattttgatttaccaaattgtttgattttttttatataaattaaaattgttaataaatcaaattttagagtacagtgttttgcttttaatgaatataagtttcacaaataattttcttctttttggatgactttttaaatataaacgatcatttttcattcaatcttccatttaaaagttgataagcaaaaaaataaaagcaattcactgtcaatttacacataatttctaagcagatctttttcttgagctcttccatttgcaattttcaattgtgtcttcatcacatcctttaatgaaaataccactctggtgaaccaaaagccttactttatcgaagtcaacaccattgagttctgatttgtccacatattcactcgcttcttgcgatccaagctcaacaaatccatgtgaagggaagttgccttgttgatgaaacagtgatccatctattgttttgatgcctaaaagtcttgcaaatacgaatttatctactttaagaactttttcgttgacccattcaattccaataaaatcaatataaaaaggatcatcttcgactattttcaaagcattgtataacttgtggtaaaatctgctgttagcattgttctttctttggaaaaattctcgtactaattctccaaatgtcatttctttgtcttgccaataggaatgaggaataaagccaagcctatgaggattaaacttaactccttgatctgaacaaattgaattaaattcatggtctgcagaattgacattattaatttggggaataggtagagttttttgtcttgatcctttctggttcttgaatacattgcctaattgtacttggcgtagtaattcaaggagattaacatttggtggaaaattaattggtgttgatggagctctttgatggcgacgtgacccagcctttgactgctgaggacgtgaattagactttttaggtgaattgtttactttatcaaattcaagagtatttggaaataaaattgatgaattgtcattttcaaatgaaagagtgtcttgatgtccaagggttgggcttggtaattcgcttgggacgttgaatgcactccatccaaacccaaaatcgtcattatcgaagttgaacgccatttacttgttgtgttcaaatgaaaaagtattcaatttaaataaaattctgaatttttttcattaacatatttcaatgcatttagtaaattgaagaacgttcttccatacaaatttacctgtccgtttatttttatcggaaatggggctccttgtttcgaattttcctgcaaagtgacaactcttcccgccaaatccaaacaacattatcggtataaaaaaccaccccaaaaaacaataaacgtatattaaagtgctttccagcttttcaaaatttgagttaaaccaaaaaaattgtgaaagctatattcaattcttttctgacagcggttatttaggggttgtttgatcgaacaaatcaaatgaatatattgagcataaaaatattgtacttctaaaatatttcttttgtcattctgttggttgaatttatagcttgtcactaagcccacagaataatttttgagcttaaggagagtgacgattggatgctagaaatggaaaccgtttgtttttaatgtgtttattatatattttgatcttattcgaaattaaactttaaaaatatccaattctttattcgttttatttcaataaaaataaattcaatttttaatttaattgcaagataacataaaaaaacaacatttttaaaacagatctgttctcttagaagaattcagtcatcttgtgcaaatatgggcaatcaacagggttgattgaattccctggctcacacaccgatagaaaggggcaccccttacatggcgtctttgagatggggcacgccagtggctgcatcgggcctggcttgagagtattccctattttaaagatctggccgctgcttattgtagctgttaccaattgttcggcttcatcatcattataacgaagatttccaatgccagatgatttgatctttcgctttaattctcctactgtgatacctggctggtttataacaaattgcactacgtggggaagaagttggtcgattagctctgagttaaaagttgatccagaaaaccatattccacctgtgacttctgatgaaggatcaatctcaaataagaatagatttttctttttgtctgtgacagaagtaacttcttttataagttctctttgtttcatttggttgagaatttgaacaaattgcttttcatcaagatttgtttttttcttgatgtcacctctccaaattcccttatcgccagcttgttcaattaatgaatatattctgtggtgttcttcatttagtccagaaaatttatctgcaagttcatctggaacatatctataagtatttcgaccatcttctgtttgtatattacgaacattaccattactaataagatgtctaaggaacttaaataaaactgttgtttcgatcggaccaccttcaacttcaagagcctgtttaatttcttcaggagaaaaatttctctctggttgctcttgaaaaacattcataaagcgtgctatcatcgctctttgtttaatttcttcacgttttgatgcaatttgtttagaagcagcagacatgaaactaaagccaaagctttggcttcttcttaaaaagtcgaatttttgaattcatattgatcgtaaacctctttttgtgcaaatggaaagtttcagaatcatgattgttagatcaaaataaaattttgaagtattcccaagaataactttatgaaatgtctcgaattgccatttcgaaagtaaatttaacttttaaccttagaacacattccacatcattcgaaacgatgataagaatacgtttagattcagtttgctttggcttggccacccaccaataaatccacaattaacaaatatattttatgaatatataattattttttaatgaggaaatgattttggaatgattatacttaataattaaagaaatgtttagaaatcataagtgaaatttgaaccgtaactcaatttcttttaattagaaagacttaaacttaagcgatttatgctttctctttagttacttcattgctcactatatgtgggaatatagaaggaaaaagggcaggttttttggcaaaccaaatagactttttaaatacaatatattcaaaccgttgtttttaaaagaaaattcaaagaactaaatttaatacaaaagtgtcattactcagactcgaatgcaagcaagcgatcctgacttccttttgaaaattgtccttattggtgattcaggcgttggtaagaccaacctactttctcgctttacaagagatcaattcaatccagaatctaaatcaacaattggtgttgaatttgcaacaaagacaatggagattgaaggcaaaactgtaaaagcacagatttgggataccgccggtcaagaacgttatcgtgctatcacttccgcttattatcgaggtgcaattggcgctcttcttctttatgatatttccgcagctctcacatttagctctctttctaggtggctccaagaacttcgtgagaatgctgacagcaatattgttgttatgctcgttggtaacaaatgcgaccttagtgaactcagagctgttaccaccgaagaaggaattggttttgctaagagcgaaaaccttcttttcattgaaacatctgctcgtcaaagcatgaatgttcaagaagctttcacaactttgatcacagaagttgttcaccgcctttccaagaacgatctctctaaagacagtggttcaccatctcaacctgaaagaggcgtttcaatcacaagccaagacaagccaaagaagaatggtggatgctgcaaataaagttcgtcgtaaaaaatcctttactcgattctataatagcaatgttgtttctatttttttagcttcttgaaatgaaaagtgtcgcctttatgtgaaaagtgacggatattttaccatctttttcaaatagataatttcgctaccaacttttttttatatttaaatgttttggcaattgggaaataagaaataccttagagttggcacatgaacgaaatgcaatttcataatcgttgtgtacggaaactctcaaaaatcatttaattttcgagtaaaccactcgaaaagtgaagaataagagataattgatcgttgttaaagcgataggaaagtgacggatgcatttttgggatttttgagaatttttatacaatttgtgtaccaaaaatgatttgaatgattatctatccaaacaaactactcaattatttcacagtgtggatgaaaatctgttcaatttccactttttgagtaatttatacatcatgtgttatttgtgaataaaatattcaaaattcataataaaatttgaataggatccgttcttgaaatattataaatgtgaacattatatcaaataattataatttattagcagtgttttttatttcaaccatttcgccgtgtgttgatgaaatttcattgatggacctgtatgttggcccttcaccaaaacaatcttaaaatgaacaatttttatttaacatgaatattttaatttttttttctatcttcattcgaggattttaatatatattttgtgaaatcaatttatcaaaaaatttatttgttttaacaaagagcgatttcaacatcattttcacacaaacaattgaaacatttgaatcaacaactgaaactattactatcacttaaatagtattttgagttatcaagaatatgaaaatgcaatcaaaaacaaaatcaacacagaaaatgttattaatttatctctctctcatattgaagtagatccatttgccaaatattttaaagagaacaattttatatgaatgtaatgtttttattgtatttgctataataaacatataatatataatagaaggaaacacaagacccgtaaacaacaaaaatgtttgtatctaataaataattattttgttcttaaaatatgtttatttatatctgactgacaaatttttcttcttttaaatcgtctgcaaatggatcttcttcaatatttgaattattaatcccaaatgaaaatgtattatctatttcattaattttattattattttcatctgaaatattcatttcttcttcattttgtttccgcttcttattttgatatttaatcataaatattatgattatcattataaatacaataattattacaattacaataacaattataatgataattaatgtattattatcattagtgtttattattacatcttcgatataagaaatataaaagaaattcgaataataagtaaaatattccggaaaatatataattgtataattgtaatatatgaaatcgacataaatatatttagtttcagattcaatgaaagtaactgaataagattttaagaacgtataataataaattgataaagtttttattaacgataaagaataagttaaagtataagtgttaacgaaagtaaaattcatcgaaaatgtattgacataagtgtttgaatcaaaattactttttgatttcgtaaatgtatttaatttcgtaaatgtatttgagttagtgaatgtgcgtgttggctggagacattcgtcaagtgttgctcccttagtaatttccatatttccaaatgtttcattttgatatgtttctattgtcataactcttgtcgcattgatattaacaaatgcatcattttgtatttctggtgaaatttctccattaaaatgaatacattgaagtgatgtacaattagtaaatgcacatgaattaatataatgaacattttcatcaataaaaattctttctaaattattacaataagcaaatgtataattcataatagaaatgactgatttaggaattgtaaatgttttacttttcatattcggataactaataatttgtgtaattactttattatataaaacgccatcgttttcataattcgaatatttgaaatttttttctgaaacattaataaattgaagtttcgtacattctaaaaatggattcccaattgaagtaactgcacttggtatataaatattcacaaggtttgtacatcctctgaatgcatctgagccaatacttcggacgccttcatataatgttatcgtttcaagtcctatacatttgtaaaatgcattatcactaatgctattacaacggattgtaatgttatttaatgaaatacattctgcaaatgcaccacctccaattccactcattaatttatctggaaattggacatgttctaattttggacatgatgcaaatgctctactatttatatttccaactgtttctccaattattactgttgttaataaaggccattctctgaatatataactttcaatcacgccaacattaataattataatacgctctgttacattcatataatatttttaataatcaatgaagtcagatattgtgagattttttgtctcttcgtcatatgattgctttgtattaacaaaaaatataagcaataaaatcagaataacttcgtttttttgatgaatgcttttctgattaaaataaattttggaaagaaaagtaaaaacaaaaaatataaatacgaacaaagttatatttgaatatatagatgtaattaatgcattaaatatctttggtagatttttaagaatattattgctgaaattcattgataaattacattgaaaactttcattaaaatgatatatattatgtaggatatgaaagattgcagttattttggaatataaatacgaagttatgaaatttgaagaaacgaaatgttaaaaacctattctgttgttatctagagaattgttgaatgaaacgcattgcagtaaatgatctatgttgtttgctgttcgaattttttgtaaaaatattttactttttatgtgttcactcttgttacttggcatgtaactaatgcttttgttatgcacatgtatgttcattgttttattatgaataaaaggattagaataatatttatatgacataaaaacatgtttgttggaatttacgagtaggatgaaagtgccaatgtgaattaatgttatcatcaattgagaatatccatcatatttcattgatttggtatatgcgtttccaatataaatctactttggttgtaacaaaaaacctataatttttcattagaaatgtgtgtaacagctgttttttgatgtgacacgcgagtttttttcgaaattattttaaatgtaaaggcacacacatgaagcattaaatgacatgaaaagatttcatttacttgctcataagtgaggactcgacatttgaatgggatttaagggaaaacgacaaaaaacaaccaactttttatgaaaaaaaagtttcaattgaatgttcaatcaacttttgtgtgtcaatggtaccgatcatttttaatacaaaaaaatgaaaatataaatctaaatatctatatttggaattggttatagaataaaaaaaagatatatataataaaacacatcatatgttatttatgaattaaatattcaaaatttaataagaaaatttgaataggacttgttctcttttgttgaacaagctggtgataaaaatcggcgatatcgttttaactttttgaacgtgttctattaaagccgataggaaagtgctggttatccacaagatatagcagaaaaagcacttttctaataatttacttcgttaactttttgatggcatatatggtcatataatattcaacaaaaacagccatgctgaaaaattttgaaaaatttaaagaaaaggctcggacatatatagagcctaatgattatggtatctttgtatcacaagacaatatatttcggattgaaagaccatctgtttttattggaagagcatcaccaaaatgccatccagatattgatttatcagaatatcaaaatcaagatgtatcacgcgagcattgccttctaacactttgttctgatcgtaatttttatcttgaagtaatatcaagagatgtaattgtgaacaccaaaattttttataaaggcacacaaatacgtctaaatgatggagacatcattgatttagggggcatttcgcttctttttttagaaaacaaatcttttattgaacagatccaaattaaatgtgaaaattagaatccttttaataaaaaataaattatttcaaatgtaatataaaagaatactcaacgatcattttaataagccattacatgatatgacaaatgtaaaattttattacttctcatcgatcagttgaatatatttgaggagagttccgcaaactccaaatcgtgaaatattttctcaggaataattttatatacagtttggcgattatgaaaaacattttaatctttcattacattaaaagtcattaattaaaaaaaataaattataaaataatatgaaattttatttcaaactcaaaaatatataaaatattttcatttaaaattaatatttcataccaagtgcgataccataaccaactgaactaataattaatactgcgataatcattgttacccaaccaattttgaaatattctggaccttctaaaaatgtttcttgtgttaattgatctggataaccataaacatgtttacaaacaccactaactaatgcgttagggaatgatgaaatatgaaatagttgtgcgccactaatcataattgcacttaaacaaacaaataaactaacatgacctgtatgtcttcctaagattgcgataactggataaaggattgaagcagctgatgtagaattaattaatgaaccaagaataccttcgataagtaaaaagatagttaaaagtggccacattggaatagattctaatgcacctgatactgatgaaagtaaatcaagaagtccgcttaatttcatagcttcaccaagtgcaagtcctccacccattaatgaaagtgttgaccaacgaatactatgaaaatcttcagtatttaacatacctgatccaaaaaatgagataactgggattaatgctgtaatacctacattaccaagaacacttggaaatgtttcttcaagtgtccataaaactatagttaatatagtaataatacatgcatatgtatgtttaattgaccatggatcatatttttcattagaatttaatgtaatattaatatgatctgttaatggtttaaaacgtaatattaaatataaccattctgctacacaaattaagattgataatggaaatccaaaaacacatccaatctgtaaatgaaatcttaatcttttctgatgtttgcatatattgtaatgctaatacattttgtggtgatgctatagttgtaggcattcctgcacgattgcctctccatgcaataccaaataaaaatgctttaataaatggatcattaggatctaatgaacgaataattggcatcgttaatgataatactaatgtcgtcgatgctacattagataaaaatgctgctataaataaattaattaacattatcgttaataaaatccacttaggatttttagataaacgtttaaaaaacgaaccctaaaatacgatctgtaatacgtaatttagataaacatgcactcatggtcatagatcctaaaaatacaaaaataattggatccataaacttccaagcaaatgtagatgctaatgtagatgcactaatacgaagacgtgtttctgaatcaataccaactccaaaccaaacacatataatagggattaaataagctgaagcatatgctggaagtccttctgttgaccataaaaatgcaacagtaattaataatgcaagacatgtatgttctgttggatatgattttaatattgggataatataaacaactccaaagattaatcctgctataagtggaagaaatgatactttttgttttggtggagtatcaactgttaagttctcagtagtaaacgctgataattcgttgtcactctggaagattaatggtgacggatcagtttgaagaacagctgtgttgctcatcttgaacggtagcacttttccatatcgttttcatatcgttttattatggtcaaaattgaatgtgctttatcgttttaattcaataaaagtgacaaaatatgccacatgcttctttacaacacatgatatgccaaattcttaattgcagataaagagaaacttacgtttggactgtagcctattttttcctcatggactaataagaaatatctgggaaatgtattaatttgaatcatgtttctgatcaaatcgaagaaactcttcgctgaggctttaggaatttttggaaacaatcgtttccaaaaaataatacttcatgttggttgttggaaaaaatcattttaatgtttcaaaatcttccctatgttcctttctaggtgatttttattgtttcggagcatgaaacatatcttggttttagtttttttgatggaagataggttttggatgatctcttttaaaatttattgtcaaacgccacgtcgatcaaattcaatttaaatacaagtgggatgattggaattgaatgggattttgtgaggagttaaaatgattttttcgtgtttgaattacaccccattcattttttcaattgcgattgaaaaacttatttaattttgaggttacagcgattcaaaaagtgaaaagtgatggaagactccactctccaggcccctctccttttacaaagcgattcggaattatcagcgtttactactgagaacttaacagttgatactccaccaaaacaaaaagtatcatttcttccacttatagcaggattaatctttggagttgtttatattatcccaatattaaaatcatatccaacagaacatacatgtcttgcattattaattactgttgcatttttatggtcaacagaaggacttccagcatatgcttcagcttatttaatccctattatatgtgtttggtttggagttggtattgattcagaaacacgtcttcgtattagtgcatctacattagcatctacatttgcttggaagtttatggatccaattatttttgtatttttaggatctatgaccatgagtgcatgtttatctaaattacgtattacagatcgtatttcagggtttgtttttaaacgtttatctaaaaatcctaagtggattttattaacgataatgttaattaatttatttatagcagcatttttatctaatgtagcatcgacgacattagtattatcattaacgatgccaattattcgttcattagatcctaatgatccatttattaaagcatttttatttggtattgcatggagtggtaattgtggaggaatgcctacaactatagcatcaccacaaaatgtattagcattacaatatatgcaaacatcagaaaagattaatatttcatttacagattggatgtgttttggatttccattatcaatcttaatttgtgtagcagaatggttatatttaatattacgttttaaaccattaacagatcatattaatattacattaaattctaatgaaaaatatgatccatggtcaattaaacatacatatgcatgtattattactatattaactatagttttatggacacttgaagaaacatttccaagtgttcttggtaatgtaggtattacagcattaatcccagttatctcattttttggatcaggtatgttaaatactgaagatttttcatagtattcgttggtcaacactttcattaatgggtggaggacttgcacttggtgaagctatgaaattaagcggacttcttgatttactttcatcagtatcaggtgcattagaatctattccaatgtggccactttttaactatctttttttacttatcgaaggtattcttggttcattaattaattctacatcagctgcttcaatcacttttatccagttatcgcaatcttaggaagacatacaggtcatgttagtttatttgtttgtttaagtgcaattatgattagtggcgcacaactatttcatatttcatcattccctaacgcattagttagtggtgtttgtaaacatgtttatggttatccagatcaattaacacaagaaacatttttagaaggtccagaatatttcaaaattggttgggtaacaatgattatcgcagtattaattattagttcagttggttatggtatcgcacttggtatgaaatattaattttaaatgaaaatattttatatatttttgagtttgaaataaaatttcatattattttataatttatttttttaagatgttcccataagatattaatgaaataacttgagaagtaacaaaatttttggttatgtgaatctttaaaaaactatcgaataaggaattatcttttgaaaaaatgattataaattatttggcaaaatgtgttcctcgttaaataaattcaacaagacatcaaaatgaaaatatgaacatataagttggatgatttattttaaatgattgcaaacaagaagttgaatataatgaaagattattaaattattttcctgattaaccaaaggttaatcttttactttatcatttggaatcacttcaaaaatatggatttaattttaaagaacttaatcaacttattcatcgcttttaattcattaccgggacaaattttgaaacattcaatttttctaatcgattcagatcaaaattgagattgattaacggtgaatcggtgaaaatttctatacgaaacaaagattggagaattacttcatttttattttgatgtcaatggaagaaccacttcttgcaaatgctgaaattgatgttacaacagataatgtaacagaaataccttcacaagaaaaaatagaaacacaacaagaagaaataaatctcatttcatttgatgaaaatgatgaacaacaagaacaaaaagagaatcaaaaagaagaagaaaaaataaacatcaataataaagacgaaacatcttcatgtcaaataatcaagaatggatttataagagctattgaatttgcagatagtgttacatgtcaatgtgttgataaagtaaaacaattacatgtcacgcaagtcctttctaatgtatttgggaagatgtgtcatgcagttgataattccacgattacaatttttcatttattccaaagtaaaagtaaaaagaatcatttaaaaacagaataaataatatttaataataattttatttttaaatttatgttttatgacgaccgtttactaaggataaacgttctattaataaaagaaaaaaatgaggagcaaaccagttcttattgaagaaaagaaaaattcgaaagagaaagagaaagaaaataatcctcctcaaggaattaaaaaagaagttatttcaagtatttcaaacccacttttaactccttttcattggaatggttatgatgtatttttaattatgattcttgttatattaggtacatttagtcgattttggattattcaatatccacgacatctagtttcatttgaaagtaaccaaattcatgttcttaattcgtttcttaatggatctttatatgttgataaacaaccaccatttggaagttatattttatcacagttagcgaaattttcgagtatgatctttcatttgaaattctacgaacagaatataattatacatatcataatatgaaatatgtttcacttcgttctattcctgcatttttttcaacattaacgattccaatttcatattttatagttcgaagttttgggggtaatcgttttacatcattttcgacaggactttttgtaatgtttgatttcttattgatttcgcttggccgacattgttttacagatggactttttacaattttttatttcagtttcagtacttttttcatcactttctacacattttaaagtttgaagtatttatcacagtatattatatttaatttcagttatttttcaggatttttcattgtcaacagaatctgaatgcttttggagtttgcatcttttcattattatttagtcaatttcgtcttcgacttcttttaacaggaattattattccaatttttatcttttttatctcattttctattcaagttatatcagagccatataaatcagagcattcttggtcattaccacaagaatatcaagacacattactttcaccaggacaaatttataatattcaacataaattaattcttcgacacagcattgaacttattagaaatgtttcgattacgtcaattaacatttgttgataaatatgaatggtatttatggaaaattatgggatgtaaatggaatattttatggacacaaatgaatcgatttgtttcatcatttggtaattttattgtttggggcataatagttcttattgtaatttatttgattcttaaaatgctcatttcgccatcgaattgaaagaccgcttgataaactttgtgttggttatgttatttgtttaatttattatattcaagggttaaatgaacgtgcaatttgcgattatgaaatatcagatctttttggtctttggcttttagcgctttttattgaaacagaatttaatgaaagtgtttatggatttgttcttccattgttaaatattattacagttgtcatttttatggagtccattagtttatggatatgaacattttgatcaacgctttcttccatattttgcaaaataaattttaacttttataaatatatttttttttttttcattttttcattttttgtgaccaaataatgattcaataatgaaaagtgacgaaaaattaataatttttttcttctttatttaatggattcacaatcattagggatatgtatttctattacgaatgaatttatgtcacgtccattaaatgcataaatccagttagtaacgacgagttagcccggatcttctgagttaattcaaaccctatggatttttcactgattgaaagtaaattaagccaacatttatatcgaaatacatcagaatggtataaagatgtttgtttgatttatgagaacgcagttcaatatcatacagaaactagtatttggggtattatagccacacaattattacatgattttgaaaagatggccaaaggattaaattttcaaagtcgtgaagaatatttcgaaagtctttctaaagacacgattaaatatgggaagcttatttcatcatcaccacataaaactgagaatgattcatttcgtcaaggctgtatcaaacgctcagaaggtgttactcgttttccacaagaaaggttggttattcttgataaactaacagagcattcagacgaagaaattgttcgaatttctattctttatattattaaaagcatgcacaaagatccacctttaacatatgaagacgacacagttaccattgattttgataaattgaaagatcaaacattaaatgcgttatatttatattttcaaagtctctaataatttatacatgaatgaataaatgaataaataaataaatataataataataataaaaatatttttctgttgacaaaaatcaatcaaatcaataaacgtacaccgagcaataattgaattggtcaatcaaaagaaaagatggaaacagttacatgggaaatattaataagttcagaacctcgtttactgagtgcagccaagaaattatggccatcaccaacaaaaattcaacaaaaagttatccctttagcattagaaggtaaagatattttagcacgagcacaaacgggtagtggtaaaacagcgtcttatattatacctattttaattggaattttacgttcaccacttccatggagttataaagctttaattttagttcctacacgagaattatgtaaacaagttaagatgcaatttgaagaattatcacgttattgtcatatttctataacacatttaggtgatgatgtttcacttgcgtcacaacgagttgctttaacagcaaatccaccctgcatgtattattagtacacctgcgtatgtacattattatcacttaatatttataagaatatttcatttttagttatagacgagtcagatcaacagttgttttaaattcacaattaccagtagcatcacgtattcatattttacaagaatttaatcgtggtggtattgatgtattagttgctattgatgaagataatgaaatttttagtcatgaatttagtgcatcacgaggtattgattttcaaaacattgattgtgttattaattttgaagttcctaaaactattgaacaatatattcatcgtgttggtcgtacagcacgaggtatgaaagaaggtattgctattacatttattaataatgagaaagatattgaatttataacagaatatcttcgaacacaagaaaacaatgaaattcgacgatttgattttaatgttactgatgcggaaatctttcgatatcgagttagttcagtcttagaaagtattacgaagacacaaattaaatcatctaaacgcattgatattaaacgtgaattattaaatagtgaacgcttgaagagtcattttgaagaaaaatccagccgatttgcaaatgcttaaacacgattcgtcacttcttccatctcgtgttgacaagaatcttcgagttttacccgattatttaggtaaccaaattcgacggcagcaaatccactcacacagagaaggcgcgcgaagcgagtaattccacgcacacacgtaatcaattgcgaaactgacggtatcaacgccgcgattaagaaacataaacataagaacaaaaatcgacgtcattaacatataaatagataaatacatacacaaatataatgttatgaagaatgataaataataaatttaataaataattattatatagaaataatttgtattttatttttattttttaataatttgatgaaatgtaatataaaatgttatacatcgatatcaaaaaatattaaatatttggacctgaatcatcaacttcagtcactgctcaaaaaacatgaaactgttgaacgtaactctatatgaaaatggtttttattagagaaaatgtatatgcaattgagaataatgcattttgttcgtgtaaaaatcatatattcattaatgttacaaatgaaaatttatatttttctaattaaaaactatggaattttatatggaaaacacatcaagatggtaatgattaaccttatgaatactatcacaaaaaaagaatacatttactaaatcatctgattccatttgttatttcaaatttatttacttttttttattcaaatggtataaaattgactaatacaataacattaacacaaacattctctgttacacaaataattaattataatttgacgtacgatttcattttctgtttctatttacattttttgttgaattatgtttggaaataaattttttctgaatatattattgttgtatatttaatattttatattatggcaatttttttacaattatatatatatcaaagtgaaaaaaacgataataaaaacacaataataattataagtgtttgtgttgctgttgttgtaattataataattgcaatacttgtcatcatttgtattcgaattcataacaaaaaacaattaagtaatgaactagaagtaaaaagtttccgagataatcaatgaataatattaatgaaggcccatttgcagatgattttatagaagataaatttatttatcatatttattgtataaacgcaggatgagcaattaagaaaaattaacaataatttcttttgatataaaaaaaaatatatgttttacctttaaaatctgtattgattagcctgttgtcatgttttcaatacttctcaagcaatattataatgtttgtcttttcaagggattttttatgtaactacataatatcggtgatttgaattaaaatatattaataataattgatgatagttgcgattattttatatgtgcatttatgacatttctaataccaaaagaaaatcattagtttgaaccgaaataataattaatgatattgtatgtgtttcgatatactgtatttaaaaaataatcgtgttgatttatttaggaaaataatcttataaaatttcccaacttgcaaatgttatttgtgaagatgatatataatccaattataagaacaaatgtatattatcaaataattttaactcattttaatggagtgaaagtaggtaatagtatattgagggtaaatacatcaaaatataaaaattacatttaaagtaacaagttattttatatcattataaggctatcaagcataagtttataaaatttacaagggagaaaatgcaataacgaaagaaaacgcattcttgtatattaaatattatgaattaaacttgggatgataaatgattgatagaatttgattaatggtcccaattttttatagtatccatatttttttgaagctatcaataacgcacattgagttccttaacttgtttcaatataaaattatttaaaaatataacattttatattacatttcatcaaattattaaaaaataaaaataaaaataaaatacaaattatttctatataataattatttattaaatttattatttatcattcttcataacattatatttgtgtatgtatttatctatttatatgttaatgacgtcgatttttgttcttatgtttatgtttcttaatcgcggcgttgatactgtcaagtttcgctaattgattacgtgtgtgcgtggaattcattttcgcttcgcgcgccttttgtgtgagtggattttgttgccgtcgaatttggttacctaaataatcgggtaaaactcgaagattcttgtcaacacgagatggaagaagtgacgaatcgtgtttaagcatttgcaaatcggctggattttcttcaaaatgactcttcaagcgttcactatttaataattcacgtttaatatcaatgcgtttagatgatttaatttgtgtcttcgtaatactttctaagactgaactaactcgatatcgaaagatttccgcatcagtaacattaaaatcaaatcgtcgaatttcattgtttttcttgtgttcgaagatattctgttataaattcaatatcttttctcattattaataaatgtaatagcaataccttctttcataccctcgtgctgtacgaccaacacgatgaatatattgttcaatagttttaggaacttcaaaattaataacacaatcaatgttttgaaaatcaatacctcgtgatgcactaaattcatgactaaaaatttcattatcttcatcaatagcaactaatacatcaataccaccacgattaaattcttgtaaaatatgaatacgtgatgctactggtaattgtgaatttaaaactgatgatttaatactaaatcgttctaaaaataatcgaactcgatatccattattactattattaacaaataaaagaattcgtcgtccaatacttctgttttgaagtaaagcataaaatacttcatatttacgttgttcttcaactttaatataataatgcattaaatgattactacgactttcttcttgaatatcaatacgaactggacaatttaaaactaacgtttgaagtcgttcaatttcatcgcctaatgtagctgacattaaaaatgattgtcgtgtagatggaagtttgctaataatttgttcaatgtctgggccatgatctaatcctaactgttgatctgactcgtctataactaaaaatgaaatattcttataaatattaagtgataataatgtaatacgtgcaggtgtactaataataattgcgggtggattggctgttaaagcaactcgttgtgacgcaagtgaaacatcatcacctaaatgtgttatagaaatatgacaataacgtgataattcttcaaattgcatcttaacttgtttacataattctcgtgtaggaactaaaattaaagctttataactccatggaagtggtgaacgtaaaattccaattaaaataggtataatataagacgctgttttaccactacccgtttgtgctcgtgctaaaatatctttaccttctaatgctaaagggataactttttgttgaattaatgttggtgatggccataatttcttggctgcatcaagtaaacgaggttctgaacttaataatgtttcccatgtaactgtttccatcttttcttttgaatgaccaaatcaattattacacggtggacgtttattgatttgactgatttttgtcaacaaaaaaatatttttattattattattatatttatttatttattcatttattcattcatgtataaattattagagactttgaaaatataaatataacgcatttaatgtttgatctttcaatttatcaaaatcaatggtaactgtgtcgtcttcatatgttaaaggtggatctttgtgcatgcttttaataatataaagaatagaaattcgaacaatttcttcgtctgaatgctctgttagtttatcaagaatgtaaccaaccttttcttgtggaaaacgagtaacactttctgaacgtttgatacatccttgaagaaatgaatcattctcatatttatgtggtgatgatgaaataagtttcccaaatttaatcgtttctttagaaagactttcaaaatattcttcacgactttgaaaatttaatcctttggccatcttttcaaaatcatgtaataattgtgtggctataataccccaaatactagtttctgtatgatattgaactgcgttctcataaatcaaacaaacatctttataccattctgatgtatttcgatataaatgttggcttaatttactttcaatctgtgaaaaatccatagggtttgaaataacttcagaatatccgggtaactcgtcgttactaactggatttaaaaaaaatgcatttaatggacgtgacataaattcattcgtaatagaaatacatatccctaatgattgtgaatccattaaataaagaagaaaaaaattattaatttttcgtcacttttcattattgaatcattatttggtcacaaaaaatgaaaaaatgaaaaaaaaaaaaatatatttataaaagttaaaatttattttgcaaaatatggaagaaagcgttgatcaaaatgttcatatccataaactaatggactccataaataaaaaatgacaactgtaataatatttaacaatggaagaacaaatccataaacactttcattaaattctgtttcaataaaaagcgctaaaagccaaagaccaaaaagatctgatatttcataatcgcaaattgcacgttcatttaacccttgaatataataaattaaacaaataacataaccaacacaaagtttatcaagcggtctttcaattcgatggcgaatgagcattttaagaatcaaataaattacaataagaaatattatcccccaaacaataaaattaccaaatgatgaaacaaatcgattcatttgtgtccataaaatattccatttacatcccataattggccataaataccattcagatttatcaacaaatgttaattgacgtaatcgaaacatttctttaataagttcaatgctgtgtcgaagaattaatttatgttgaatattataaatttgtcctggtgaaagtaatgtgtcttgatattcttgtggtaatgaccaagaatgctctgatttatatggctctgatataacttgaatagaaaatgagataaaaaagataaaaattggaataataattcctgttaaaagaagtcgaagacgaaattgactaaataataatgaaaagatgcaaactccaaaagcattcagattcgttgacaatgaaaatcctgaaaaaataactgaaattaaatataatatactgtgataaatacttccaactttaaaatgtgtagaaagtgatgaaaaaagtactgaaactgaaataaaaaattgtaaaagtccatctgtaaaacaatgtcggccaagcgaaatcaataagaaatcaaacattacaaaaagtcctgtcgaaaatgatgtaaaacgattacccccaaaacttcgaactataaaatatgaaattggaatcgttaatgttgaaaaaaatgcaggaatagaacgaagtgaaacatatttcatattatgatatgtataattatattctgttcgtggcatttcatacgaaagatcatactccgaaaatttcgctaactgtgataaaatataacttccaaatggtggttgtttatcaacatataaagatccattaagaaacgaattaagaacatgaatttggttactttcaaatgaaactagatgtcgtggatattgaataatccaaaatcgactaaatgtacctaatataacaagaatcataattaaaaatacatcataaccattccaatgaaaaggagttaaaagtgggtttgaaatacttgaaataacttcttttttaattccttgaggaggattattttctttctctttctctttcgaatttttcttttcttcaataagaactggttttttgctcctcatttttcttttattaatagaacgtttatccttagtaaacggtcgtcataaacataaatttaaaaataaaattattattaaatattatttattctgtttttaaatgattctttttacttttactttggaataaatgaaaaattgtaatcgtggaattatcaactgcatgacacatcttcccaaatacattagaaaggacttgcgtgacatgtaattgtttttcttttatcaacacattgacatgtaacactatctgcaaattcaatagctcttataaatccattcttgattatttgacatgaagatgtttcgtctttattattgatgtttattttttcttcttctttttgattctctttttgttcttgttgttcatcattttcatcaaatgaaatgagatttatttcttcttgttgtgtttctattttttcttgtgaaggtatttctgttacattatctgttgtaacatcaatttcagcatttgcaagaagtggttcttccattgacatcaaaataaaaatgaagtaattctccaatctttgtttcgtatagaaattttcaccgattcaccgttaatcaatctcaattttgatctgaatcgattagaaaaattgaatgtttcaaaatttgtcccggtaatgaattaaaagcgatgaataagttgattaagttctttaaaattaaacataaataaaaagcaaattcttaaaggttgtgaaaagaattttttgtcagtcacataattaaatatttttagttaatttacatattttttattaaatttttcattctttcgaaaacaataactgaaattttataccatcgccaccgctataattttcttcaagtttatctcttatttcttgatgatttttcaagaatatttttaagaatgcgattattccttttatggtaacctcatctaatttcaaatgaatttgttttctttttgttaaaaatatcacatcaattaatttgtcacaaattaattcgatgtgattctgtaacaattcgatattctttagcacgtccatactcaaagaaatcaaatcttttaagatttttggtattgtataaaatgaaaactgtaaacaattttcaaacaaattatcaatgttttcattttgataattaataatttgcttctttaataacaataaaattatttttgtaacaaatggtaatatattttcttcttcatctttatcatcgtcatcgtcatcttcctcttcataacctgaattatattggaaagatggaagtgtgaaaattaaatcattaaaatcatttataaaatctgaataattttcgactatcaaagctaaagactctgcaattaaagcaagttcagaactaaatgtatagtctaaaaagtgcacaggcttaaccaaaaatttataaattatatttatattttcttgggaatcaattttataatttttcaaaatttcaacaacaggattcaaaacgttcaaaagcattgaattttgaacggagtaaagccaagaaattatcttatcgacgaggaatccactttttgaagggaagactctaataaaagcagcgtaaagtaaaaacaaaaattcatttaaagatgaattcatataaggaggataatttcttaatatataaaatgatccatttatagaatcttgaataaacgggacaaataaatccccgtcaacttttttacttaagataattttcgttaaaagattacaaaatgaaacaaaagtgttcttcgtcgaaacataattcgccattttccgaacaacagtaattattagacttaatttatctgcttcgattagatcaataaggttaagaatggagttagaaagtactaattgagctttagctatacgtgaagaacataaaggtaatatacaattaaacgattttaatgcaaatgattgaaatggtttattctttgtaattaaacttaaacagaataatatatagtaacgattagtttgatcaaacgaaggattattaacattattaattatatcatttatatgattttgtatgatattaatagagaatttactatttaaacatgacgcacctgcaaataatgaaatggttccaattgtaattccgttttcttttatgaaatcatttgaatattcgatatcatcctcgaaaatatcataacaatcaatggtatcaataataaaacttaataataacaaacaattatcctttaaataaattggtgaatttttatcgtgaataactttatgaatataattaattaaaacttttatttcttgttttgtttttggtttgttttcattgttattgaaatctaaaggttcattttcatcttcttcaagttcttcaacttcactgatagctaaaatataatgtttaataagatgattatatttatgaagtcgatcctttgatatgtttggcattattgttaataatgattcaatcgaaatcggcgaaatgattgttaatgaatcaattaatgttttcatcgattgtgtaacaagataaaataacgaaggatcttgcgtagttaataaattaactaatatatcaaatattgaatcggaaatagcattcgaatcatcataaaaataatcagaataaatctttaataatatgcagccaatgccttgatttaatggatcacccttaagtaatcgttttatggttttaaagagagtgggcaaataattgtcgttttctaataacgtttttgatattaatgcatacgataacatcgctccgggcgattctttatctttgatgtattgcaaaaattcttcaattaatccagatgaataagaacgatcagaaagaatagtttcagtaaggtcgttgatttcatgatatggaatgtctgagggagtttttaaaattgaatcaaatattgtgacaaaagattttaatatgatgaaacaatcaaaggtattcaaaaatgttgatatataaagtagaggaaatattaacttgagttggtcatttggagataaagattcattttgaagtgaaatgatgtctttttgaatttgggggtctatgttcgttacttcatcaggattttcatcgcagtacctagtaatatatggcaaaatgggaattatttgttcaacatcagatgtttgtgaataaaattccctaattaaggactgagtatcaaatgtttcaatttgatctgtgtcatcagagaagtcagatgagacaaaggcattaattaatttctggaatatttctgggattttctttccagacataataggggtaccccatttcaattaaccgtcaatgaataaaaaaccgtttattatcaattgactttaaatcatcattttcgggaattactgatttaagccacagcttagggctgataaatggtaagtttatatatatatatatatatgtatatatatattatgattatttacaattcaacaaatgaaaacagttgtatctatattaaaaatatgatctttttatttgtttgctaaaaactatttataggtgcctactttagtttcaaattttcaaatcggaaaaaaatcattttactatttttactaatgtctcatttattcaaattatatttgaacaataaatttctcatcattaaaatcatctgcaaatgggtcttcttcgatgtttttatttgacattcctcctataaatgtatttgcactttcattattttcttcgtcattatcattttcataaattatgttattacttatttgtttattatttcgaatacgaattattatttcaatgagaacgataattacaattactattataatggaaacgcatacagagataataattatatttttattcatatcatcagattgtaattgttcatttgtatatataatagtgaagaaattggagtaataactataaatcactgtgtatataactattgtgtaatcataaaagataaattccgttttaatataaacattcgatgaattaacaatacaaagcgaatatgtatttctttgcgtaacataaaatgataatgtttgcgtaattgatagtgaatatgctaaccaaactgttaaagacaaagttatattaagtagaaatgaatttgttattgtatttaagtgagaaaatttaagtgattcagtaaatgtacttgatttagtaaatgtacttgatttagtaaatgtacttgatttggtatatgtgtttgatttagtatatgtatttgttgatatttccatgaagaaatgcgatgtattactaagttttccatagttatcaattaatatgacatgtatataaacattttcatttaaaatatctgcaataattctttttgttatacttgtattatttaaatttactaaggttaaaattgttgaatcattgttatcaatgatataataatattctgttgcaaatgatgttaaattaaaaagaatttcgtctgattcatatattgtaccatttgatgaatttccaataactttataaaaaattgtttcggtttcattatttgtgcttaattcaacagttctatatcctaatgttgtaatgtttggagattttaatttaggcgtttcaatagaattatcatatgcatattgaagcgttgtcttctgatataagtagtatatagtatttgcaagaagttgtctttcatatagagtagcacttgcaaatgtatgacctgtttgaatcatagctgtgtttttatatgttgtcaagtaataatgtggatttccatatcttggttctgtatatccacttaaattccatgcatagttttcaacttcggtataattagaataattatattataagtcagcttgtgtatttctacctagttcctcccaaacttctccaaatgctgcatttgaacatgtgtgcgtttcaaagcatgttagattaccatctggaattgaatatggataatttgttaataatccatgttttgtcacacgaaattcatcactaaaatgcatccaccttgttgaaaatgtaccatttgaacagttatcagccttaaaataaattgaatcatattcttctgttccaagcaatattccgaattttgatgtaattggcccatatcctttttcatttccaaaaacaaatctaacaacatcatgaccaaacagaactccataatcgagatcaatataatccgaaacgcgttgaacagtttcatttttgggaaaccacgtaccccagagcccatttgcatccatgaaaccaattacaatgacatcataatgcttcatttcttctaaactcatgttatcaaaatcatatttagaaaccggagtcacatgaatgatttgctcttctggtgagaaatgatttgtgcctaatgaagtgaaattataaaatatatcttcataagtataacctatattttaaacaatctaaaaagttataataatttttatttatgtttgcaaactctcatgttttcttgaaagatattataaaacattgctaatctcatatgaaattaagttatcttaatgatcttataactctgaaaatgaataaccatttaaattgaatgtacattttatgcttttgcaattgtttgtttttgtttctattgttttactatcttccctatgcttttgtacctaccaacattatgttctgtttagttcaacaagtacaataaaagatgacaacacttatatttatattattataggtgttgccattgcagcaattattataataataactttgtgaatgattttgttaataaaaattaaaaacaaaaaagtaatgaaaaaatcacataaacatcaagtgatgataatacaacacaagatgtttcacataatattaaaatggaaaatattagcgctgatccacttgcagaagattttaatgaaaatgatatctttataaagttttcatattattaactcaaagcaaaaaaataataaattttaatcatgaataaaaaggtattaaaaaaatttatttttgcattaacaattttcaaactctttcaagaaattcatatacagtgaagaagtgtttgctattgaagaattttggcattgagtgaaagattcgattgatgaaacaacactttcatcatttattattacttttaaagaatataaaatagtgatacaatttaaaatgacattatcatcatcactaaagacaaaaaatgatacaaatgataaaagttcattatttaaattctttataataccgaaatcaacgcaaactttaattattgataaaataaatttttttgattcataattataagaatcgattttattgatatttatacaagaaaaagttttctcagcaaataaatttgaacttttagatagtattaaagctaactcaagaatatataaataaacatttggatacatatttaaatttatattaaacatttgtaagatatcaatttgattaattaattgttcttttctaaattcatttgatgaataataaattaaaagatctaaagctgaaacaactaaagaatttgttttaaaatttgttacattaataataatattaatttgttgttcatctaacattatatcatcatttgatataattatttttgttattatttcaagtaaaacattttgtgttgataaatctgaacgaattaaaatttcaaataattttggaattaattccataatatttggaatatcaatatactcaatttgtcttttgaggatttttaatgttaagcaaaaaagttcattagttttgtttaatgacaaattaaatatgaattttaattgttcgataccaataaaaaactttttatctttagttaataagattaatataaatatcacttgtgtatatgacttatctgatggaatattatttaaaatattagtgcaaattgaaaatagattatcaccaaactcagaaattaatatttgattttcttcaattatatttgttattatccaaagaagaatttccataagttttatatcaattatattcaaaaaaattgttgaaattgaactatcaagaattcttttttgactatcaaaatctaaagacttaccaaacgaatttaaatagttttgtattttaattcccatttcataatcaataggagcagaaatttgtttaatctcttcattagaaaaatcatcatctaaatcaggtctgtaatatgaaacatgtttttccacatattttggtcgaaaatcataatcatttaaaggtggtgaaaaaggttttttccaatcatttaaaggataaggtttcataaaaaaaaatggttcaaatttccaaatctacaaacaattttacttattttccatcatcataaccaaacaaaacttcagttatatcctcaaaaaacaaacaaaacaaaatccaacaaacccatcatcgaccgtttataccatttcaacgatatacaaaaatcaaaactttattccacatcaaactttcaatgatcgaattcttgctcttttctttgcgttcatttgtttttcgaacaagtcgaatgcagcgtttgccactatttcctgtgttaattgtgctgttttcattcttctcttgaattccttcaaagccctagctattgattgtatcaattccttactcatcaacttatcaggaatatttcgaatgaattcatcgaattttatattcagcgacggcaaattatccaacatcacttgtaacaaagcagggtcatcatatgccttcaaagttaattcatcccaaacacttttatcagcgacttggattgcatattccacagtttcctttgggtttttaatgttatttaagtgtattctcataccgtcaagtatcgcaccagttttctttgataagaacgcggcttctctataaagcttttcatctattgcagtttgtctagcaacagtataatcgaattcggaactatttaataaataattcatagtttccggatgatggaacttaatatataacacagccaaatcagttccataaggctttggtattggtatatgcattttatataattgatgtaaataatttaacatatgttgacacatttggaccgtatttgtcttaaagttcggcaataccaaaatcggcttcatttgttcagtatgtgataacataaattgggtgaaaatatctccataagttcgatataatgtatcgaatcgttttaatggataatcatataattgatatttctcgatatcatcgaaaagatttaaataattcgcagtgagtcctgagtcaaaagcttttgaatgttcaccaattcgatgatataatatcattaatgggatatgaaatactttttccgaatctgctttgatttggacgtcatttatcaatagtttcggatcgaaactatcaggcggtaagttcgaaaacacttgacaaaatcgttgtgtatcattatgaattaattctcgtaaaatcggcacaagttttggtgtgttctttaattcttcaagtggaacataacttgcaagtgatgatatcgcatcattgttttggaatagttctatagctcgatcccattcttcattacgtggcttaagatatttattacatagttctgctgctttgttataatcacttttggacttaataaaatgtgataaaatgcgcataactaaatcaacacgttcattgtccgttaatgatggtaacatactttcaaacttcttaagacataattgatcttcattacgatctaaatgcatttgtaaacgctcggcccaacttgaaaatgtaatacaataaacaaattgatctaaaactaatataaatttgcctttcgttgtgggtaataacgtgacgtatttactcggcttaatggcattctctggaggagaaacataactaatggttaagttttggtcaatataaaacatacattcttttttcgcgtcatcataaaataattgcatcgtgatcgaatcttgaactgctaaggataaaacattacgatggacattgacaacaatctcacgtgtggtagtaagccatagttcataatataaggaaccaaatgataaacctaagatggaatctgataattgtaaaaaggtacacctggggttttggatgggagaattgggaaatactggtgttattttataaagtttttcttcgttcttttcacgaattacattaatcgaagtaaaagaggcccaagcaataattccgtttttccaccaaactgtttgtataaaaccttcattctcggaaattgttgtctttttcattcggagccagccttgacttatacgaataatactaccattggtatctgaaaaaatggcattgaattctttggtggaagcatagtttggatcaagagcacatgctgaaatagaaacgccgtgcgaaactgtaataactgacttattttccgatattggataaagatttaaatttccatttccagtggaaaataaaacaaacttccctgtggaatcaacagagatataagttatctgagcatcacttttggtatactcaattaatgtttcacctgataattttgccacaacacatcttccatgttcagttccaaatacaattttgtcatcagaagttattgcaaatgcggatatttgatctgttttatcatttttatctgtaatctgtaatgaaatttgagggtatttgagtataggttcttccattttgcaggcggttttgtaaacttgaacttaacggtttttaagcaattcactttttggaattgcagaaattttacaatgcgcacgttaaactctgcttcagttgtttatcttgactgtatttttggaaagtaatgaattcacaaaaaaaagagctaaaggttagcctactaggagatggggctgttggaaaaacatctttaatcctcacttatttttcaggcaaatttccccttgaaataatgggcataattgagtctgattataaaaaaaatgttatttttaacaaaattccatataagcttaacatttgtgattgctgttgtggagctgaagattttgtttctcttagaaggaaacttctatatcaaggtactgatgttgttattctatgtttctctcttgtttgtaaaaattccctagatgcaattatgaattattggatagatgaaaccaaacaatatttttcagaaacaccttcattttgttaggaaccaaaacagatttacgtgacgaattcataccggatccgtcaaattattcttatgaacctatttcatctcaagaaggaaagtcagttgcaaaagaaatagatgcgtttggttacattgaatgttctgctaaaatcggatataatttagatgaagttttccaacttgcaataaaagctgcttcaagccaaaaatttaatacaaagatagataaaaaagaaatttgcagaatattttaagtaaagaattttgctctgttattattctcctatgttttctcttaatttatttgtcatgacaatttgtgtttaataactttaataataaatatatttttaaatatatatatatatatatatatatatatatatgaatagaaaaaatatattatttttattaactaaaagttaaacatcatgatgtgtgatatcatgtatgatatcattgtttaattcataccatttttttatttttgttagacacctaaaatgcatataaaattaataaagatgttaatgttttttacccagatatatgaaatagatgttgatttataaatatcgtaagcttaatgatactgagtgttatagtactctaattataattatatacaatgtacaactgtctcatttatgtcatggaagaaagatatattatctaatttgtatcgaaattccaatttattaactacgaatttcacaaatatgcaacataaaagactgagtatccatgtgcatcatatgtatattatgagcaaacactgtatcaattacgatcatttttttacaaatgggtttttgttgatgattcaaaaagttaaaccccttaagtgcaaaagcggctattttgaggaaaattcaatataacattgtttgacaacacacaattcaaaaaagcttttttcgatatcccttcaaatttttcagaaattccggtgttttagctctgtggttaaacctaaatttttttctgttcttgatataaacatattatataaattgatcataattaataacgaggtagtctaccttataaatacaaaaatagataaaatttttaataatatatttaaagaaattcatatttttattttcacaaataaaaaatttttgtcaattgaattgaaatcatacttcacatcattcatcaaattcattgatcaatgaacataaaaattattcttcttattgcaactggtgttattgcactagctggtttgatagggcaccttgttgtttgcgccacatggacttcaataatcaatccaacattttcaaacgcgggtggaatctgtgcaacgctgaacatttctgctatttgcatttgtttgtttgctgcaataacaattgtaggaatcattgttttaatcattcttaaatttgcaaccaaaaatgttaacaagtggctcctaattggtattggttgtgtttgggccatcacttttgtatgtgcttgcattaacttttctaaaatgtttaatccaaatgatgatgcagagaaattagcaaataataataattttgtagaattttcaaggcaagttgctaaatattctttgtcttctactgaagctttaaaggattggagggaattcttgaaaagattaactgataagtacggagataaagaagatgattggaaaaagatagtttttccctatacttcacttcttgctttcttgatcgttgaaatagtcggaatcgttgtatacatcattactcttatatttttcttaaagggttaaacaaatggaaaaaagaatctgagtaaattattttcttttctttttttaaagaaactatacaacagcgttataaataatattgtttttatgagccattttaatctttttgattgtgtggcttttgttaaaaattacaatagtcaaaatataacgaaaccacattaatgtggtaaacttctcaaaataaaaaacgttatgtgcaaatcaaaccaattttttgcatagtttattatgcacttttttcatttccaaaaaagaggaacatgcaactccacatttcaaaatttttgaaatagagataatttcaatatgcagacctatattacaattcttatcatcttcgaaaagaatgtaaaccgcgtttaatcttcacatttgaatcaaccattcttgatcaataccaatatttaagaatgtcttaccattttttaaatatttgatgacgactttttgctttctacatgtgttttatttcactggtaatttactattcaagctaatttctaatttatgacttagttcataaatgtgtttatcaagcaaaacaaaaattagctttcattttgtcaaatcaagccattaaatctaaatgaaaatattaccaaattttctttatttctgtcttaacattaatcaaaataagatccaatgaatcaatacttctaagaaaaaagattttattatgtttactgttcaaaactgttatttaattccttcctttctttttcattgagtttttacaaaagtatttttttcttgttgttgacaaacaagcggttagttgtcaatttctgttgacaaagaatgagcgccaacgtggacgaaggaatccaagttggccgtacgacagatgttttactggcaaaagcgcggcattataccaatgtatattcgacccgcaaagattgtcagaccataaaagagcaaattcttgaaatcgttgaagataaagacaaatactggaacacacttgcatcatttcttcatggtcaatgttccaagcaagaatatgatgatgtcatgaaccaatgtcttactgattacagagccaaacttttacataatgatttaattcgttccattttatttaatgcgcatttttctatgattcctcctcctggagtgaacatagtcaaaacgcccacccctccacaacccaggcctattcaagcgccatcacagaattctcgtaattcctcattttcaacatattccgcttcagacatgcgccatcttccttccattaaccagctctctagtcgtattggcatattgcttagttctcgcaacataaaagtcgaaagtaaagcgactggaattttatttcaagaattaaagcgatttataatgtcaattcttgaaaacagtgcgctgcttgtgtcaagtaaaggcattaacccacaggagaacatcgttataacacatgcgcagattatgcacgtgttaaattcggattatcggatcttaaacgttgtctctccttcgctgctgtcgaaatattcgtcatttttgcaatagcaaatttataaacaacgtctttattattcttttggccttaaatttaattaaataaaaataaattttttttgataataatggaaaatttgaaatctttaaacaatgaattactttcttttcaagtgaagacttgccaacaaaaacatgtttgtgatttaagaacttcttgtaaaatcattatgacattattactgtaaaaagataatttgcttataaaaaattattttaataaaataatatttggaaattatttaaaatatttaatgcatcacttatgaaagcaacaaaagaaaaacatttcgatatcattcaaatcattaaggaaaaactattaatatattaagcaaaaataaagatcaaacaagtaacttatatataatgtaaaccaacaatgatatcgaagaaaaacatcatcaaattagatttaaaaatgtgaatttcaaaattaacacattttttttaaattggtgtaaaaaattattttaaatctacttaaaccagtaaaagttaccttatgaaaaaatttaattttatttatttttagtataaactttatttacatttttatacatattttttcatcaactattgataacgaatataaatttaaatacaaattcaaacaaaaagtgtatgaaatcgaatttcatcactttttatgttaacaaaattacaaataaaaacataaaaacagttttatgaatctataacattcattggcacaaatacgattttcccatcatttaacaccactaaagccaatgaaattttctcgaaatatttcacgtcaacgacatttccattacatctaaagaacggcttctttatgtccaaacaaaatgcttcgaattcgtacaattttcctttttcgtcagcaaccaacacgaaatcgaaccctttatcatcactccatgtatcccatgcaatgatttggaatggtatttggattgttttgatctctcttccattaattgtatacaatgaaatcaaatgtttaattgtttgattttgaaacaattcttgataaacaagtataaaacaccatgattttgtcagtaaaatcaatttcggagtcccatataacttaataaaatgtattatagtcccatgacttaatgaacatatgatcaaattttcatctttggtaccacaaacaaatgaatcaaatacatgggaacaattactacatgtaatggaatcacaaaaatatggtattgattgcgtcaaatttttaaatttgttcttataaatataaattaccgcatttttcgatgaaacaattctataaggtccactttttgatatgtttacaatatcgccaacagttgtcagcttcctaaccgtctgaccggtttcactttttactttataaagttcgtttttattttttgagcccacaaatagaaagccctctgaaaattgaatgaatatatttgaattttgaatgttgtcaaaatcttgaatttgaatttcattaatttttaagtcatcgaaatccttaaaattaacaattttaattaaatcttttttcttcttattattattacctaaaaattttttaaatttatttaatttaattaataaatttttcgaaattccttcgttacatatcaatgtaattttgattttatttaaattgattaaagaaacatttgaagtaataacattaaaattgccgaaatccaaaacgatttcttcattaataatttgttcttttaataacaacttcttatttaatctttttggatgaggattcttaaataacaatggaggaatttgaccaatttgtgataatttatcttcaatttcatttttaatttgtgaattcttcaaattatttttatctttccatacatcagaataaatttcttttggatatgaattaatatcacaatattgtttatatccccaaaacaaatcgatccaattatttaagttttcagacacataatcactttcaagagcttttcgatgtaaatatataaattccattggtgtctttgcccattttggtaagacaacttctgaagcagataatttctcgtttaacattcccaaattaaaattattttcattaattaaaaactccggcatataaaagaactcgggaattaattctcggaaattattaatcgatgttgaaagtttataagagtttttaatcgatgtaaacattcgagctgaatgatcaaatcttccgccttgaatttggatatgtaatgaagtaaatggttcgattcgaattagccatgaataaagtgataatggacatatcggaccactactatataaataaggtttaatacctgcttcaattaatacgtcgaatttgttctttaatgattctaatgttttgggatcttgtgcgcctataggtaatgataagtcacgaaatgtttctttattagttaaatctaatgtttcagatgtataatctttaactatccatgggaaaaatggatattgtgatgatgaatgaaatgaacgtccactataaatatttaataacattaaatattcgaaatttgagattttataattaagccaatcattagtgaaattcttttcgatgaaataattataaaaattagaaatttgtaatacttttgttgataaattcttctttaatcgatttaatatattattaaaaattatattatctttaaaatctatgaaatatgattgatttgaatcagtgaaaaattctaatgatgttacatgatgatttcgagttcgaattaaaacgtgtattaaatcctttaaataaaatgatttaattttatcatcggaatgaacaatttgtattttatcattataaaatcgaaattttgaattgtaaatgtttttaatagttaaatgttcacatttacattcataaaaaggtttttcgatatcatcgaagttattaatattttcttttatatttataatgttttcttcgacatttaataaattagaaatcgttgtattcttatgtataatactcatttcgatttcttctttagtacaattagttatagaagcattagaatgtaaatcaaatgaaaaattaatccgtaatttcatcggacaaaaatatttacaaaaactatgatctaacttaaaatgtggtttcgttcgatactcaattggtaatgatgaattccatggagctttagatgtagtcatagaacgccataaatgtgaccataatcgagaattatattgatctttctcgttcttttgatttatatatattaaatatgatgatttttgtggaactgaaatttcttcgaatttttgatttaaaaattcgaactcattaacatttgggaattctgattcatttattaaatcttctaaatttgatatataatcgaaaaatattttggtgctttctaaattagttttattattatatgataaaaagaattgattttcttggaaaatagaatatatttcattcggtaaaaggattcctgaacgtaatatatattcggctaatattaaagatgtttcatcatgtgaatatgataataatccaatcatagctttcatcgctatacctaaatgattccatttaccttttttattaatttttaatccgaaatgatacgattttttctcagatttaaaatttaataaatttttgtataaaacttttggattaaaattcaattttttcttcttatttttaaaatatttcgttgtattaaatgaacttttactatataatttaattagatattgatttgatttagtgttttcttggaaaaagatataatgacgaattaaaacatcaatagaattcacagtattttcattaatgttattacaaatttcatcgaaaaatatatcaaaaattatataatttttgactttaagtattttactaattaaataaattcgataatacaaatttattaagttatttaattgatattttattaaatatttaataattcttaatctaattttatttgaattaactttaaataataaaacaatagtccaaaattcattatgaattgttggagtatttttataataatttatcattttctttatacaatttttcgataaatttaatgccatatatgaacataaatgatgtaattcaggtactttcttagataacttacaaaactttataaacaaatatttattatcttgaaaaaaagtcgaataaaatgaaataatttgatgtatttcttttttaatatcgaaacaagaaaatatttttataactgtatatataataattgggtttttaaatgtaaaaagaaatcgtaaatattgtatatcgattgggttttttattattttcaattttattaattttaataaaaagtttaatgaatcaatgatttgtaattgatctggattagtcacaagattactaatgaaatcagttagatccgaatctttataatttttcattaaaatcgatgtacaaatcgaaaataataagtttcgacatttcgaaatatttaactcttttgaatgtgacacttttgatcgaattttatcattagtttcataccaatataacattcgcatttgatataaaatcgatttaaaatcaatgaaatattcgatatgctttttagaataagtttctaaatgtttcaaatatttaagatgatctataggtttacaagaaatccaaatttcgaaattcattaaaatcgattgaaacaattgaagttttaattctttatgttttaatttctcaaacaaattaaagaatttcaaatatattttatacgtaaaatgtattggttgactttctttaaataaatgtgataatattaaaaaaccattacttaaataaaatgattcttggattgaataatcatataataagaacttagataaaacaaagaatatggaattaaagaagttatccgatgttttaccatcttgataagttaaatctaattgagcaaataatggtaaaaaaacatcgattttaaaaaagtttaataaaacttcaacaaatgataaataataaggacgttttgatatattactttcatattttatattatttaatgattttaaattaataaaaccattaaatgatttagggacaaaagcaaaaattggcgaaatttgtaaatcttcataattcacatttaatgataaattttggatttcaagagaacttaaattattaaacaaagcaaaaggtccaagtaatgaacacttttgattattattattgttactattgataatacaattcgaaaatttatgtttaaactcaacgtcaaatgtaactatttcaagagtatcgaaatagcattttaattcattattcttaaacataaacacataaaaagaccattgttctaattggattctataaggaatttcttttattattatatattcaggtgtttgtaatttaattataaaattattttcaataatttcgattgataatgaaatgttttgatcataaatttgaaacaattcgaatttattctttatagaattatgaaaataccaaaatgtaaatgcaaaatcttgaatattattatttaaagttatttttatctctgttttatcatctaaaggaattccatattgtggaatacttttagcttgatcaattaaagaacataaaactatgataaaatttatattataatatggaaaatatttaccatcaattggacataacaaagcaataaatttttggacaattgtaaatgaacaaattttcgatgaaataatttgtataaattttaatgatgttaaagtttcattttgtaattttttagttttccattcgaataaataatttaaaattaattgatcgatttctccttcatgtatagatatacaattttgtaaattattttcacataaatcaattaaatatgttaaacattcgattaatttcggtgagttaaaatatgattgaagatataaatataaattctttggttgaattattttattttcatcattaatacataattttaataatttatttgtaaattctgttgttggttcattcccataaacattttttatagatttctctaatgatttaatttcattttcttgtaatgattgaatttttgttgtataatataataaatcaatagtttcatttaataaatttaatgaatcaatgttttgtattaaacttaattgtataattaatggattaacaatcgttaaaaaatgttttaatatatttttcgttttagaaaatacataatttaaagtatgtaatatatttgtagttaattcgatgaatgattctgatgttaaattataaatatttgttgataaaataaaataaattgtatcaattgtatctaatggtaaattatcatattgatcaaaagataataaaaatcgttcaatataatttaatattaaagttcgcaaaggtttatcataaactaatgataaaaaaaacttagaaaaatgtacattcgaaaagaaattaattaaaaacaattgatcaactaaaatccattgtacatatgataatattgctacacttgcaatatatattatatctttatcagtagttatagtcttataataaattaatggatctaataatgaaaatgaaatcgctgatacaaaatcactgatcgaataatcaatagaacaacaaaacaatcgtgaaactaattccgaatataaaagtggtgtttgtgctgcttgataaaatatggtacgtaattgattcgcattattacataagaaaaaatcaaacacatatgaacgtaatgatgatatttctatgaatttttcgggtttttcatccataaaaattgttatcgatggatcaaatattacggaattaaataatacttcaattggaaatgaaatattacgaaaatcattataaacagaaactaaaatactaaaatatgtaatgtaaatatcaatacaatgttccgattttaatgaactaattaataaatgaaaacaatcagttaaaaagttttgtaataaaaattcatgcttatgaattatacgtgtaataatttttgtaactgaatatattttgggatttataatacttccaaatggcatcgtttttggtataggaaattctttggatatcggttttgaatcaaatatactttcatctaaaaaacgatattgaacagttgtggaaccatcaaatggtactcgtagataatccttgtttgtttctggtatcggaatattaatttccgatttttcgatgttgtcataaagcgcgcacgttaaaaccgtcaaaattgaatatattttttgatcgttttggaattttgctgatgcgttactaaaaaatgttaaaacatatggatctaattctttaataaacttcgtacttcgttctaatatcttaaatgctatatctgcaggaaatgtagaatcaggcgcttgtattaaatgatctacaacaacaaaaaaatcttgaaaatttgttgacgatttaatgatatcatttgaaatgcaatcaataagactataagctgttactggaagaattttgttaaataagaaaaaatcatttaaagatgaaagatatggaatcatattttcattaatatgctcattaataacatatgataatgcataataaaaagcagatgtagcaattgttggattgtgttctttcgggtcaacgagttgcgaaacataatttaatgaattaagtaaaacactaagcttagaactttgttttgacgaatgaaaaacagaacaccatcccaagtaagagtaaagagtaaacacataaaggaaataaggtgaagattttctaaacttataattttctactaacttagatagaaaaaaaggaacatatggaaaactgatcttatttttagccaaaacatcgacaacatttgatgatgaatcagaaagttgatttttaattgatatcatttgaaactttgaaatctttggaaattcgatactttcaatagaaatctttatttcttctggtaatgaatcaagatcaatattttggaacttaatttttaatgacaatatttcatagcatagttgtttttctggtatgaaatcattcatctgggtttgaaaaagtgccaaatattctgtggaacccctacccgatattgcattcaatttatttacccatattttcatgcacaaaccgcctgataacgatcataaataattcaatttatggctatgtacgtttataattttatccaaacgacacattttattcactcattctttttatttacataactctataatgtgactctaaaaatttgttcttatattacatttttttctatctgattgaatatcttaaacaaaacacaaataacaccaaaacgttttcataatttgtccaaatgttaaattaaagaaaatatttttgaattatttacaactgcaatttcaatgcattcacagttgcgccacatcacatttccaaatattattttgttaaaagatttactaagatccgagacctttcgaaaaatccatatttaatttggcaaaggttcgaactgtataaagttttcagttctcttcttcttttgtctacagtataagaacaccaacagcactgccaccagcgccaatgcgactgagagacaagcgatccagatgattcttgttgtcttgcttggggtggtgaactcttcatagttcacatctcttggcagcgtgcaagcgccagtcaatgggactgtgaataacatttgttccgggtcagaagccttcttaatgaagactggttgaaccaaagtttcgcatccgattttatctgttatctcgtttggaattaggtacaaaattccttgtgaaattatattcttaatattatcaaatttgacattcatttgattcgataatgttatttgtttttggccaacgattttattatttcctaaatcatataagccaacaaatgcattatgaagataactatcagatcctaagttcatatgcataacaactttcatatcaaacgatacactttcgttttcaatgttaatacttgtgtatggttgtggagatgatatataatcatcgctattaacattctcatacgtaatgtttgctgacccagaaacagattcttttctgttctctgcgtagatttgatattggtcattcttaaagaaacatgggatttgaagtgtgtgctcaacgcctttaataaggtcagagcctaattgataacgcttcccatctttcttgaggaataagtcatagctgtctttgtttccattgattttgactgtaaagttagtgtcgcatttaatggcgtttgtagataatacaatttcgggctctttcgttaagtctttggttgagtcagatccaaacttacgttcgatttgtggtaatgttggatttgaacttaacccataaacattaatcttgatgttatcaatggtcgttgtactaccataacctgcacgatgcgcgataactgtccatttacctttggacgtttcaccataaaatccacgaattgtatatttgactttgttgttgtttgtttctttgacttctgatggtagtataactttaagaacggtgcctgatggtgatttaacacttaaataaagtgaatgaagttcattataatttaactcgatttcaacatattcaatgaacttaacggtctcggcggttatgtcagcagaggactcaatttcaccgtggcgaccgttactgaggtcaatttttggtatttcaattgaaacttgtttttgttctgataaaagtgtcaatgagcgtgctgctttaaccgcgagttcggaattaatacgtccaaaaccataaacgtcactatagtaatagcgcgcactattgttgatccatgactcatgttttggatcattaattgttgatgaaagtgcaaaaatactttgaatatctctatatgtaagttgtgaattaacactaagtaaaagagaaacaagtccggcaacataagaagcaccaacaccattaagattatcatgcgtggaacaaccagttgtatctacactaagagatggcggagatggaagattaattgtgttaccaaaaagatatgatgatccaccagatggagcattgacaacaatggatgtgccacgattgctccaatatgaacgagatccacttggcgtagtatcagagactgtaatggtttcaggtgcacgagttaaaacatagaaattggtatcaccaccaattttgctatctccgcctgctggtgctacaatgatacttttacaattatgaatgtcagtttcaagagatgatgaggttggaggatcacatttaccattggcgcattcatttggaactgaaaaatacttgacatgagtggaggtattttcgcgtttaagagccgctctaattacatcttctgatgtctttttggttttaagacaataataagaggattgatatgctacaccaagtgagcaataatcatttgactcacctacaacatgaccaagaagtgaagtggtgcggcttttttgattgtcatcattatctggtgaaacatttgtagttccatcatcaagattataatgtaatgttgataattgtctgccattgagatcagtatttgaatttgcacatccattaccaataacaccaatagtaatactgtttccgtttaatccttcatcccaaactggttttatgttaatgtcttcgccggaagaagatccataagtacccttatttgaaaggacaaaatcatttgagaactgggggtcctggggatcaaaggaaatcccgaaaacaatgaagaggagcatatggtttaattgtgatcaattttcaaagagagtcatcgtttgatcgttttgagttgcttgaatggtttacaaatatgtgcacatgcgatcatttggaaagtggctctgaaaacaaaaaaacaacatgtttaacccctgaaaacaacacttcacatgtaacccaaaaaaaatgaagaacgttaagcaaaatttaataaaaaaagtcaaaaaaaatggattttacttaaaacatccatcattgatcatataccaagacttatatattacatttttaactattttcagtgtgtatacattttcttgttttattaagaaattatctaatttgatatttgaacatcattacctttgattctcagaaataattgttgccctcaaatatgaataaataatcaatgttagattaatattaaaggaatcgatcctgtatagaattcagtgcattgaaatttaagtttggtttagtatacgtttaaaatttagaaaaatcaagcagtttatggatgatctttttggtactcaagaaatagattgggaatttaatgctcctcactggtttgattttgaaaaagaagaagtcgaaaatttagatgattggttcgacattcaagaaaataatcttgcaaaatttaaaaaagaatttgatctttcttcaactcttaagacacagcagccacctgtaagcaacaaaagtgataaaaatgataataataaaaatgttaatataaaatctagaaagccaacaagaattcctgtttataattcaagaagagcaaatgcaaaatctgttcaaattcatcacagcaatcagcatccaccagtacatgaaacaaaaacaacctcaagaagaagtaaaatggctgctccttcatcaactaaacaaaccacaacacggaacattgagaaaaccaaagcacctacgctagcaaaaacacctattcgagtccccttgaaagagagacagaatgttactaagaaattataaacgattaataaattttttgtactttatttgatcgaatttgtttcctaattttgtttgtagctataaaactaaacattttcatattaacttatgcatatacataagaatattgaaaattaaaattaatcaattttttaaaattacacataaactataatatttaactgaaaaaatactatgaaacctaattttatcaaaaaatccactagttgtttagcaacactttttttcttcttcggtcttttcaacaggttcagctggcttaatttcaaatgtaatgtgttcttcggttttaacctcattcttgagcaaatatttgataagttggtcaaatgcatgatcaatattttgtcctgaaagagctgagacagcctgatacatttcaacgtgatgatcagaaagccatgaatcaatgctttcttgaggtacttctatttgatcttgaggtagatccattttatttccgacaagaataactggcatttcgttattggtaggagaataactgttaagaaacagatttaagtagtcttcaacaccagtaaatgattgagatgatgataaatcaaatacaagcatcatgcaatttgctccatgaagaagagaaggtgtaatagccttaaagcgttcatcacctgcagtgtcccaaatcatgagagttacttctgacgaatctattgttaatgtttttgtgaaaaatcctgcaccaacagtttgttttgtctttgctataaaaacgttgttacaatatctttcaattatggatgtttttcctacgtgataaggtccaaggagcacaaccttaaagtctttagttttgcctgacattgcaaatgaatttttgaacacaaaatttcaatgtaaaacaacggttatattaaacgcttttcaacagcagcacctcccaaattaactacacgaaaattgggtgcgccgatttttcattgcattataaaaaagtgactaaaagacaattttacgaagacttacatatgaaggaagaaaaaataataactattccaaattttaaaacataacttcaagaacaattttacaaaatacttacattttattcaacaataaacatatattttatttttgtacttccgctttttttgtttcattgataaatcttttaattttattatataaaacattacattctttatcattaccaaataatttttgtatttcatcattaaacttttcatctatctgtgaatacacagactttaatggcattggaggtggagttgaacataaaattcttctaaacaattccgtcaaaattaattctttcattaaatcatctccaaattcgaacaagtgaatcaacaaatttttagtcattgtagtgaacaagttttgatttcttaattgatctataatcgcaatcattaaaattttcgatatatcgaaatctaatttattaaaaagatataagaaaaatgtttttccattatttttttcatcgtttgaaaaaacatataaaactaaacaccaaaaaattcgtggaattcttttattattcgaaacaaaacatttctttaaaacctcagctatatttatgaaatcattttcatttttctcatttttttctaataatatatcatcaacgattatatcaattccgaacatttttaatggcttttcaatatcgaaaccaaacgaaggaatattattttcattattttgatattcgcttgataaaattatatttctaaattgtatgaaatttaaaggaagttgttcaagcaacaaaacataaaacgaaataaagaatagtggtgcgttaattgaaatccgatataaaattcgagtgacactcttatagaagacatacggcatttctttacataatgagaaacatataaccaaaaaattaatacaaaactgatttgttttatattgatttaacttaataaacttaggaataatcgatttatgcatcattaattggatccaacaacatgaaaatgatggaaaatgtttcggctcgaaaaaagatataaatttaatgagtttatcttcgttttgaaaaaataatgaacttaataaaccataaattaatctaaataatgctaatggacataaagtaattgcttctttagctatggattgaattgctttagtagtgactgattctaataatactttacctgaacatttagaaaatgatgaacataaataatcaacaactgaataatcaattttattgccttgaattggtgaactagtttttcgtgtcgaatgtaatgcaaataatatcaaggagcgaatagaagagactgttggctctttcattttatctgtaaagtctgagcgatcattatctgtaacacaataacttaaaaatgatcttagtaaaggaatatgactttgttctggatatggtaattccttaatttttggtgtttcttttatgtttaacaagattttagtacttgtaaaacttgtcgagttatattcaagtaacataggcattaacggtaaaatttttgttttcgaaaattctgatgtgaaaggattcgttaataattctgagaataaagcattcaaatcctcgagattcaaaaagttcttgagtttcaaacaaaccgctaggaaacgtttatttggaaaagtgttcctaaaaaattgtattatatcgatgttatattggttatttttcataattcttaggaataagtttgaaaaatttaaagaaataacatctgagtttgataaagaaagagaaattatagccctaattattgattcatcaaaatcatcttcttgttgtactgttctaatgtttgttggatgattttcgaaataaattttatcagcaatttcgacattatttaaagctattgagatatcaaatggcaaaactgatatatccggttcataataaaaataatttattaaagacgagtttttagagtttaattccaaaatatctttttgctcaataaatttcgggttacgaaacatttgtattccattttccacttcaacgaattgggaaaaacgtgaagttgaatttaaagggatataaaatgttcttttataaaataatgacaaatcaatttttaatttattttcgaatatttttatgctttcttttatatctgttcttaaagaatcatcatattttaaagaagcaattatttcatataatgaaacaatataaggatttggcacattaaaagatctcggaatataacctaaaaagttcgaaaggaataataacgattcaacaatagtaccattaataatcgaatcctttaaaattttatgtatcgatattaatgataatggaggtaagatttcgttctttaaagtaagtgctgaaagccaaagtcccattttttcgaattgtgaatgcatattatatgattcccattgtttttctttcgcttgtttaaacaaggaattaatatataaacataaaatttctaaaaaaaattgattaacttttaatgctaatggcggattaaatgataaaaatatttgtactatgtaattaaattgtttaacaccttccattttattggcttcttcaagagatgaataaatgttttgactaagacttacttcttggatatcaatgtgtcgaatgggatatatattaatgattgagtgtggtggaaatgattttcgttgcgttggaataatataaaaatatttatatgaagatgtataaaaagggatttgtggattgatcttaagtgaaaaatatacatctgaatctaggtattgaagattgggtatttttaatatggaacgacaaaacgattgataattatgtagttctggaagaatggaatgtgctaatattaaacaaaatttaacaccttcttgtgatggtaaaagttttgtaactgtcgataaaaataaaaattgtgttggtaaaggaattaatgaatttaatatataccacccaattattgaaacagataattcatttaatggtcgttcaaggaggattctgagaatgcaaaaaatcattgatttttcttgtatgtttgatgataatttaataagctcttgaaaaatttgatttggttgtaaagaaagaatttcattggccatgttaactgtgtaatcactaaagtcatttacgtaatgtgatggatacttaattttcattgatggtgaacgtgttgttgaaattaacgttctacataatccgtttattggtgtaaatgcaaacatattaaaaagtggaaagtgtatttagttaaacagcatttaaattgtatataatcaatcacatactctttttcgcatgatttaatgaatctttcgatgctcgttaaattaattatcacatatgttgcaaaatataagaaatgtatggacatcgccagcaaatgcattttgtgaattatctgatgtttatctctttggatgtaagggtaattaattttttatttgcataaatattaaattacttcgcttttgttattctttccacaacttaactccatttgaagtcaaaatcagttaaggcggacgaatactccgctcagccatcgcaatgcctttgcctctgtcattagtcaaaacggattcttatacatagcctcatgatgcagaaatgccaatgcaagtccagtagcaatcactcgctggttatctctactacatcaacttcattaacctttggcacatctgtaagctccgtcagcttaatgatctctttcatgtcctcccaaaagcacatcatgttatgataaatcgaaaccattatatgcagatggagcagttgtggcgcgtagtggtggtgacagcacaaaagattgaggtggaaaagccgtgaaggtggcgcctcggcatatatttttcagcaagggatcttataatgctaaaccaaagaattccaaataaagagatcaagattccacattttgttcttttaggagatgatagcacacaatccgaagataataaagccttttcataggcacattgatttatgatgtatttataaatccttaattattattaatcataaatgatttattattagtcaattttcaaaaattaaatttaatttattggaaagcaattcaaaaatttatatgagatgtaatattttaatatattgattaaaacataccttaaatatatttaaaataaatttgataaaaaattcgaaattttaaaaaaaattgaatagctatatggttggatattataaaaattgaaaggtgtcacttttaaccgccgtcgactttttgtatggtttatttcgaaagtgccaaagaagaacgaaatttttaattttgcaaaaacgttttaattaaattcaaattaaataataaattaagaaatgtttaaggatgaatattcaaatattttattgaagcggccatacccgattggatacatccagctccatttcgaacctggaaattaagcaatcgcgggccatatcagtactaggctgggagacttcctgggaacgtatggtgctgcttcctttttactttatttttacattaatatgaaattatattttttatagaaattattaaatataaatgttttattttatttattattaataaaattatttaaaaatttatataagtaattaataaaattactttaatttttataatattatatttttaaatattttaacatgattattaatgattattaatgattgttaatgattattaatgattattaatgattattaatgattattaagttgtttaataaaataaatataaaatttatttaatttacatgtttatttaataattttattgttgttcttttgtttctttaggttcttccttagtttcttctttaggttcttcctttttctctgtattttctgatttaattgcaggtttttcttcatttttactaccaatagtttcaataccacgtcttaaagaccattcattttcaaatgcatcaatttcatcttcacctacattatgccatgtttctttagttgttttcttgccttctttatctacaacttcatcgacttgaacccaacgattaccaattcttttaaagtttagaaatataagtcgtttctccatcattagtttgttcacgaatttcttaagttcttcttctttaggtttttcttctttttgttctttaggtttatcttgttcaatcatattattaaattcttcatcaaatgcatcagcaaataaagaatttaaacgacgttcaagattattaaagtatctgttcatcgcattaaatggatgataaactcttattggtctgtattccacgaatggatcataaaatggatcagtaaaataaccaaacataattaaaaaatgaattaaactcttaattgttcatttagaataaattaaaacatttatcaattgaaatttttttaaatttaaatgaccgatcaattagttattaaaaatatctttatcgtccgactttttctatggtttattctgaaagtgccaaagaagaacgaaatttttgattttgcaaaaacgttttaatcaaattcaaattaaataataaattaagaaatgtttaaggatggatattaaaatattttattgaagcggccatacccgattggatacatccagctccatttcgaacctggaaattaagcaatcgcgggccatatcagtactaggctgggagacttcctgggaacgtatggtgctgcttcctttttttattttatttttacattaatatgaaattatattttttaaagaaattattaaatataaatgttttatttatttatttattattaataaaattatttaaaaaatttatataaataattaataacaattactttaatttttttataatattatatttttttaaattatatttaacatgattattaatgattattaatgattattaatgattattaatgattattaacgattattaatgattattaagtggtcttcaataccacgtcttaaagaccattcattttcaaatgcatcaatttcatcttcacctacattatgccatgtttctttagttgttttcttaccttctttatctacaacttcatcgacttgaacccaacgattaccaattcttttaattttttaaatataagtcttttttccatcattagtttgttcacgaatttcttcgaatttttcattaccattaaagtatctttgtgatgaataagttctataataattttgtggtctataatttttcaggctttttttaacaatctttttgttgtgtttctttttatttctttcttaagttcttcttctttaggtttttttcttctttttttgttctttaggtttatcttgttcaatcatattattaaattcttcatcaaatgtatcagcaaataaagaatttaaacgacgttcaagattattaaaaagtatctgttcatcgcattaaatggatgataaactcttattggtctgtattccacgaatggatcataaaatggatcagtaaaataaccaaacataattaaaaaatgaattaaactcttaattgttcatttagaataaattaaaacatttatcaattgaaatttttcttaaattaaatgaccgatcaattaattattaaaatatctttatcgtccgactttttctatggtttattccaaaagtgcctcagaagaagaaatttttaattttgcaaaaacgatttaatgcaattcaaattaaataataaattaagacatatttaacgatggatattaaaatattttattgaaggggccatacccgattggatacatccagctccatttcgaacctggaaattaagcaatcgcgggccatatcagtactaggctgggagacttcctgggaacgtatggtgctgcttcctttttaatttatttttacattaatatgaaattatattttttatagaaattattaaatataaatgttttattttatttattattaataaaattatttaaaaatttatataagtaattaataaaattactttaatttttataatattatatttttaaatattttaacatgattattaatgattattaatgattgttaatgattattaatgattattaatgattattaatgattattaagttgtttaataaaaataaatataaaatttatttaatttacatgtttatttaataattttattgttgttcttttgtttctttaggttcttccttagtttcttctttaggttcttcctttttctctgtattttctgatttaattgcaggtttttcttcatttttactaccaatagtttcaataccacgtcttaaagaccattcattttcaaatgcatcaatttcatcttcacctacattatgccatgtttctttagttgttttcttgccttctttatctacaacttcatcgacttgaacccaacgattaccaattctttttaattttagaaatataagtctttttctccatcattagtttgttcacgaatttcttcgaatttttcattaccattatagtatctttgtgatgaataagttctataataattttgtggtctataattttcaggctttttaacaatcttttgttgtgtttcttttatttctttcttaagttcttcttctttaggtttttcttcttctttaggtttttcttctttttgttctttaggtttatcttgttcaatcatattattaaattcttcatcaaatgtatctgcaaataaagaatttaaacgacgttcaagattattaaagtatctgttcatcgcattaaatggatgataaactcttattggtctatattccacgaatggatcataaaatggatcagtaaaataaccaaacataataaaaaatgaattaaactcttaattgttcatttaaaataaattaaaacatttatcaattgaaattttcttaaattaaatgaccgatcaattagttattaaaatatctttatcgtacgactttttgtatggtttatttcgaaagtgccaaagaagaacgaaatttttaattttgcaaaaacgttttaattaaattcaaattaaataataaattaagaaatgtttaaggatggatattcaaatattttattgaagcggccatacccgattggatacatccagctccatttcgaacctggaaattaagcaatcgcgggccatatcagtactaggctgggagacttcctgggaacgtatggtgctgcttcctttttaatttatttttacattaatatgaaattatatttcattaaatctataaaaaaaaatttaaattattaaatttttatttttgtacaaacattatatctttgatttgtttaaattttattaactattcgtgaatttatttttcttaatttatttaaacttttttttttcgtttttcaataaaaaatttgattttattcatagaatttgtttcattcactttatttactatgttataaagatatccaaaagattgaatttgtgaaaatttttgataataaccccataatttaatttattcttaaaaaatattataagatttcaattgaaataatctaaaataaaataataatttaaaatatttgggtttttacttagcttcgaatatatagcatgtaagggcatcacaattcaagttgaatccgccatttccactgtattgttgacctgagataagatctttgaaggaggaaccaccacaattaacataaatagttgttggcattgtacctgtattaacaacaaagacaatttttgtttgtgtttgagaatcccatttaacattaataagtgctccatctttagttgaaacgctattagagcctctccacattgctggataattttgacgaatgttcattatctttgcagtataatcatgtaagtcttgttcattattattaaatcctgagatgtgtccatcagtacgtgcaacattatcacctgctgtattaccaccacaaccataagattgccagcagtcagcgatgtcaccaacttcatcgccataataaatcgtaattggaccagtgtaagcagctaaacaacctaatgcgatcttataacgcttccaatatgaaggattgcttctatcataaccatatttgttacggattaagttaccaaatctccaaacatcatggtttgtaatgaaaagatttggataaacatctgatgaatatcctttttcacttggtgttttgaatacatttgtaagtgtaccaacaccatagccaccagcaccactttcttcttgtgctataacttgaacaaggttataacgtgatgggaaatcaaatgcagatttaagaccatcttgtgaatatgtttgtgattggatttcgctagcaccactccaatgttcaccaaccatataaccaagtgtaccccattgtttgccttggttcttacgttcattgcagacactttgaactgcttcacgaatttcatgccaatagttatgaccgttttgataaacttgataacattgatcaagacgccaaccatcaatttcatattcacggatccaatatgttgcgacttctttataaaagtctaagcttcctggatatgaaactggattactgcctccttgaggatatttaccacttggtgatcctttgacattacctccatgatgaccgaaaacaccatctaaaaagatatacattccacggtcatgacagcctctgataagattacgaagatcatcattagaaccaaattttgggtcgacattgaaataatcagttgcaaagtaacctgttgattgaagtaatgaaccaccagtaccacctgttgaatcaaatactggtgtaagccaaattgcgttgacattaagacctttgatgtaatcaagagcattaatgatacctttgagattacctctatgactacttggaccatagcctgtgcaataacatgatgatccatcaccttggaatgatgagaccataatttgataaattgtaagtgagttgaaatcagtgtttaatccatttgatgctgttccaactgtagttgtacctattgttgtttgtgctgtagaagttgttttgtggaatgagataaagcctattgttgtgccaacaactaaaccaattccaacgcataaagcagcaatccaataataccttctctttggtttgacttctttttgggattcaatatcctttgaactaagaagaggctcgttttgtatttcctccattaaaaaatgaaatcagatagggtgtgaagtgtttacattcaaaatgagaagaaggaggtagcttctcaaaatgagcggttattttaagcaaaagcaggtgcatcacaattcaaaattcaaattaactcacaatttcaaagctttcaaataaacgttccattttcgcttgttgtggatgattttttgtttcaaaaattttattaacagattaaacacattcgtagttattgaaactgaatacaaagattttttatttctcgttaaaacttaatactgaagaaatttaataattagaattagatcactaattaataaaatattatataaataaagaaaaatttattaataaattatcaccatgaaaacattatatctcttggataaactcaacaggatacatatgctctaaaggttccaaaatgatttgagcatattttgcaatttctttatcctcacttgtttgcaaataatcaaatgtttccaaaacctgtaatctcagctcttccatttcctggatattatcattttcttggaagaagtttagatttggtccagacttatccaaagtataaaaagtaattttcatgataggcctcaaatactcattataagcttctttagcttcatcagcaaaaaagcataacaacatattaataagattatatctcaaaagatggaagaatccttgaataggacaatattcacaaaaagaagcaattgcccaataagcttcttctttaattctaaaagttccggtctctgtcattttgaaaattgcttgaacaatattttcgttttccatatgatatataattgattcttcatcatcatatttttctaattccgcaagttttgcagaaagtctaattccagaaattataactttttcacattcgctcgaaaaagaacagtggatgattggaaagatatcatttaaattaattaatgatgtttttttaattacaactgatattgttttcgctattgctattgataaatcattcatactaagaattaaacttattcgatctattatgggacgactatactgtgtacacattggagtggactttttatacactttccgtaagcctgttaaaaatttgattatgatttcttgatcatctgacgcaaatacattttcaataaaatcattaaattcaacatcttttgaatcctctgcagattcaataggtgggataacagatgtggtagtgtaatcgtaaaaatcatcattaaaactatttgtaatttcaaaaaatatattaacaactatattgagatattgaggtacatcagagaaaaaaatcaaaaagtaaagtgctccttcatcaagaaaagttttcgatcctaaacagcctgagaaatgtattaattttaaaaattgttcaaatgagtttggaatatatttaataagggttttgaagattccgaatgagataagtgatttggcattatgtggaattagatggtctaaaaattgtaatggttcatcaaatgaattggaattaacttgttcattgaaatattgaagaaattttgtaataaaatcattatcaaagattggaagttcatttccaaacttcgtatggagagaattcaaaatggaaggcggatcttgaaaattattgataatattgggaggtacttttgcaaaaggaactatgggttgagatagctctttctcaatgtgtttctttcggtgtatatccatgagacttgcctttcgttggtttgaactttgtttgcaatttttcttgtagttcatcaaaatgtccaaataaaatttttttaaaacgtactaaacaaattttcacgcaagaatacaaatattttaaataaaaacaaaaaatgttcgaatgatcattcagaaaaaaaattattgaaaaatgttcatttttataaagaaaaagacattgtaaggtacctttgggtgattcatatgttaacttaaaaaattaattttgaaaattgggaaattaattcaatgattgaagaaaaacactattttgatgtttaaatacaaaaaggaatcatctcttccataaggccgataatattgtttactatttatttacttgaagattgatccaactaacaaatttttaattcacttaaagaaaaaaatatttttattttaacaactttttattcttctttataatataattaatgtcatctgatttctcaattatccttttttctcttatcaaaaatattccttttctatcacattctggaagaaaattgaagttaattccattttggaacaaaatttcatttttatcagaaaatgataaatcggaaattgatgaaatcgtattttttgtgttacgtttaagaacaatttcagtgtacatatcaatacaattatctcgaacgtcaatttgttttgtcttcaaaaactgaaatacagacttccttcgagagatgagcgtaatttccccattaaaatacatgggatattgcatttgaatatctgggaaaaaaattgaccaataaaaaattgtagaagatgtaaaaagagatatgagatttgtcaaaattttgtctcttcttctgttgaatatgtctgaatttctattgaatatgaatgtaaattcatctttaaatagaaatgctaattcaacatcagcaaaatcttccataacatgtctagcagattttgaaaaaagtttaacaagtcttaaatcagttggaaatttcaaaaaatgatcagagcagaatttttgataatttgtgcaactaacagaaacaactaagtaggtttcgtgaaggaggatttcttctgcttcgaattgtttcacatattcgaaacgagaatttaccatcctgcttaaaaatggtattcagtagcattggaccaccccgaacattcagtgcttatctggtcgatttggaaatgggagaagaatatgcaagtcaacaaacacattatgtaacaattccaacccactacaaatttgaagaaaaaggagttattagacgtgcagcacttgggttactaagtcttgttgaagatcctgaaattgataaaccaatgatgttatcatctcttaaaagctcccgaaaatataaattcctagaggacaactgtgttacccttgaaggaggatatcgtctttgcaggtccacaagatattttcctgttgattcaaataaatattattgggaatttgactttattccatcgcctgaactcgacagtcacgttagatttggaattgctactgtcaaagctgacatggaaacaccagtaggttttgattccgaaggatattctgttcgtgatttaggtggtgcttttcacaaaagacataaaacggggtctcctcctttcccaccaaatagcacagttgggtttggtatattttctaatgaaaatggttttgtacttcaaatgtttattaatggctttgatcaaggaattattttcgaaaacattgatttagagaaacattggattccatcactatctatttataagagtgctacagttcgcgcaaggttttcaaggccattcaaatttgatccaggtcttgattggaaagatgcaattcaagttccaaagccaataacaaattgtcaaatcactgcagatgaactgatatatgtgatgcatcacgcgttgcctggaaatgagaaacaaaaaattttatatactgcttgttcacaagctttgacacctgaatacgaaatgccaatatagttttgtttataatcgaataaataaaagtattacttagaaaattttgttctgtttttagaaataaaaacatcaacagccatattttatttacaaggagatgttaacatgttaaacatgatatgtggctttaatattggagcaaacttaatccgaatattgatgaaagtggtattaaagagtaagaaagagaccaaagcataaagtgtatatatgtccagtactacatctatagttataattatctattggagaactacagttgaaatatgagttcgtgtttttaatatgttttttcattatttaattcactgaattatttgaatcgaataataatataactaatgaacaatatatccatcaatacatgaatgatcagaactatttttagaagtttatcaacatattataattataggtaagaatgatttttttgcaattttaatataaatgtctttaacctataattttttttaaaatatgtggaaaaatgttaatattttgaactatataatctacattttcgttctaaaatattaagatgcaaaaatgtctctgatacttgtatttcgcgcattatggatttttatcaagtcttgctgacattcctatttgccaatgatattagttccaattattaattcacaaaaaattattcaactcagtttctgtttaactttaaatgaaaaaattagaacaactaatttttctgatactatgatacattttttcgatacataaacactttatcagagaatatcattaataatttgataatcaaaattcaaaatataaatataaaaatgtaaatccataattataataaaaattgatgccacgttccattaacatacgtttattttaacgtgcttttaacaaggagttcacttcaatgaggcaaacaacacttaactttatggttgatggtgattcaaagcctaaaaagaaggttgaccctattgagcctgaagaacccattgatgaaggaccaataaattatgataatatatttaattcagttgaagattttaaaaaatgtcttgaaccatcctggcggagggttttatctggtgaattcaccaagccttacttcagtaaactacttcaaacacttcgtcaagataatcgtcaaatgtttcctcccaagccagatattctcaatgccttcaaatattgtcccttcaacaatgttaaagttgtaattgttggacaagatccatatcatgaagaaaatcaagcgcatggactttctttttcagtacgtaaaggcgtgcctattcctaaaagccttcaaaacatatacaaagagctatcagatgagtatggggatgaattcacgcgaccaaaccatggatgtttagagagttgggccaagcaaggagtattactcctcaacgcaacgctaactgtcgctgcgcatgatgcaaactcgcacagtaagtatgggtggtccaacttcacaaatgcagcaattcaagctgtaaacgaaaaatcaaacggggttgtgttcatcgcatggggaggaaatgcaaagagcgtttgtaagtgcgtaaataagaaaaaacattgtttacttgaatctggacatccttcaccattatcagtgaaatactttttggggtgcggccacttcaaggcagccaacaagtggctgctagatcatggaaaagcgcctataaggtggaactctgtgaatgatgagtaaatattcgaatttgtcttttaacttagtttttaactatgtcgcgctggatgtttagatatgaattttgagaacactgcagtagatgaaaatataaaattcacatgatttcctttattattaatctgaaaaaatatttaatattcaattaatgcaataaattgaccaaatttttttgaaaaattgatgtattttgatgatacataatatttgaaattaacttaaagtgtatattgttatgtatatatttatttagaatttcatggaaaagatgttgagaaatttgaattttttgttttaggtgtcagtttttcacggctaatcagtaccattgcgccaaaaatattctcgaagatatatggccacatttttttttaattcatcgacttcgaaaaatacgcaagaatttcctgtttcctctaattttctatagctgaagttcctatcgtttgtaaacggtttccgataatcctatcgcttacacaaatctgacattttgcttatggaaaacgaagccgttgatccaacaaatcccttaacgataggagaaaaatcaggaggcacacctatcgatatggaaatattacatagcttggaaagaattatattcaatttatctgaagaaaatttaatgttatccgttcaacagacgatgaaattatttgacaataacttttcatattcattaaatatagcaataagtaatttagtttattgtgcattttgttctcaaaaaaattcatttgacatgtatttatgttatttgaaatcaattcaaacgaaagaagacgaaataacaaaaacaaaagttaatccaacaattattgaagtttttgtgaattatatatcagaaattgaagtacaagaagcatattatcttattgaaaaatttatcgacttaaatttagcagatgaaaatattgctaataataatcattcactctatttttcacatcgtaatcaagtaacgccaaacaaaaatcgcaataattctaataattttaataacccaagatggaataataatcatttcgatgatgattatgatgatttgattgaagatgaaatctcaagtgatgatgattcagataatagttttgatgattattcatatcataattcatatgaagatccaattgagaaatctttttatgataattatgaagaactttcaaagaatgattttgaacttcataagagatatgttaaagaaggagttaatccaagtgaaatagcaaaaatccttcgaaatgatgaaatagaaaatcttcaagatttaacatcacaaccgaattttgattttaatcagaaaattgagccatcactttatgaaagatgttcatatataaatcaacaagacattttacttattaattatgccgcatttttcggatcagctcaatgttttaaatatttattaatgaatggatccaagttaaaaaacacaggaaaatatgcaattgcaggtggaaatcatgaaataattcatttatgtgaacaaaatcatgcaacttttaaaggttcttatgaaacagcaattaagtttcatcgaaatgaaatcttttattatctatatgaaaatgaattagataaattagataataatgatcaacaaaatccttcaatgttaggaaatagaccaaatattccaatgtttccaaatcgaaggaattttttgaactttaatcatggagttaatatgaatcattattatgcaatgcataatccacatacattaaagcctacaaatgatgaaataaaaccaaaaaacttaaataagtttaataatatatgtattaatagtggaaattatgaaatactttcattcttagaagaagaaggaatgaaaataaatgaaagttcaataattgattcggcaagaataggaaatttattccttttaaagcatttcctttcaaataataataaaataccgaaaaatattttagtggtttctttgaaatctggaaatccagaaatagtaaaatatgttttggaattaaaaggaattgatataaatgttaaaaatattaatttgtttttatataatgtttgatttcatgatttgaagtttgagtttttgatatggaatttatttgttatatttaaaactgctttaattttagctactgaaaaaaatcattataaaatagtgaaagagtttattaaaaaagatgaaacagatataaatgctaaagatgtttattgatattatcagatgtttcttttggtaatttaatgttttatattgttgtttggagttttttggttatatttaaaacagcattaatgattgctgctgaaaataattatattgatatagttaaattacttcttgaacaagaaagaattgatgtaaatgttaaatcgaatatttattgataatgtttaaagtataatttcataaaatgatgtttcataatgttatttggaattgaatcaaatgatttctaacagcattaatgattgcaatcgaaaacttttatgctgaaatagttaaattacttcttgataatggaaaagttgatattaatgcaaaagataatgttgatttgtttcgtttagagcttttttagttattttatggttttaatttaaaatttggtaattattcaaagtatttcaaacagcattaatgattgcaataggaaatggtaatattgatatagttaaattacttcttaatcaaaaaggaattgatgttaatgctaaagataatattaaacatgtttatttagagatcattttgatgattttttatttaaacttaatatttaggaattattcatgttattttatacagctcttttaaaagcaatcgaaaaaggttatatagaaatagttaaattacttatcgaacaagaaggaattgatattaataacaaagacaatgtaaaattataatattacgaattttttcttatgatttaatgtataaagataatatttaaaaattatttggaatatttgtgtcagcttttattttagcagctgaaaaaggtaattttgaaataattaaattgttattagcaaaagaaggaattgatattaatgctaaagatgtttttttgttttaattagattttcttttattgttttaatattcaaaaatcatgtttgaaaattatttaaatcatttagaacagcacttataaatgcatctgaaaaaggtaaaacagaaatagttaaattacttcttgaacaaaaagatattgatgttaatgctaaagacataaattttgtttatttattgtttattttgataatacaatattcaaaaataatatttggaaatcatatataatatttgttacatcacttctgattgcatctaataaaggtcacttagatatagttaaattacttctcgaacaaaaaggtattgatattaatgctaaagatatttataaatcttctttaaagttatttttaacaatttaatatatcaaaataatatttggaatttattcaatttgtttaatacaacactaattaattcatctttatatggtaaaacagaaattgttaaattacttcttgaactagaaggaattgatatcaatgctaaaaatgtttatattttttgtttaatgatattttacaatatgatttggaatttaatttaattgtttaaaacagcacttattttagcaatagaaaaaggtcatatagaaatagttaagttacttcttgagcaaaatggaattgatattaatgttaaagatgattatatattttatttaaagttgtttttaatgatttaattttttgatagaatatttggaatttattcaaattatttaatacaattcttatgattgcatcttcatgtaaacaaaatgatattgttaaattacttattcataaagcaggaattgatatcaatgctaaaaatgtttatgtttttcgtttaatgatattttgcaatttgatttggagtttaattaaaatgtttgaaactgcattaatatatgcaaccgaaaaaggtaatacagaaatagttaaattgcttttagaacaagagggaattgatattaattcgaaatcgaatatatattttatttatatagagtttgattaattaattttatatttcattttaatatttggtaattgatcaaagtatttcaaacagcattaatgattgcaatagaaaatgattatattgaaattgttaaattacttcttaaacaaaaaggaattgatattaatgctaaagataatattaaacatgtttatttagagatcattttgatgattctttatttcaaaatattatttggaatttgttcatattatttaatacatctctaattattgcaactgaaagaggacgtacagaaatagttaaattacttattgaacaagaaggaattgatattaataacaaagataatgtaaatttatgttgtaaagaatttgtttataaaatattttatttcaaaatattacttagaatttacttcaattatttagaacagcatatatgtatgcatctcgttttggtaaatcagaaatagctaaattgttagaaaaatatgcaaacaattctaaataaaatattattaattaaataaatatttttttaaattatataatttcaaaaaaaaagtcacaattaccataataattcttcacattgcaaaagtattttataatgaattttgtttcatttaaaacaatgattcaataacaaacgataaaaaccgttgctgctcttagcgatacaaatgtcgtgggatggtttgctccattataacgatccaacatttatagaaacatcgtgtagaatgccagtccaaacatttaagcacaacaagttagatgtttgtatcaaatttaggcagattggtgatcgaacatcaaaagaagcagttttatttttcccaagcatatatgaaacggaggcatctgcctttcgaattgcacctctttttgagaaggaaaatcttcgattcatatccataaatacgtataatcatgcgcaattcaccgatctcatgcgaacaataagacagctctgcttataccttcacttagagaaggtccatcttgttggctgtgatttaggcggattcatctgccttcaaatccaagcctatccacaatttcccgcaaaaatcgagacgcttacgctcataaactcatacacagagaactcattttttattccacgttccatgtcatcattttcagtcttcggctatcttattgccaaatcgaagttggaggaagagctagagcaatccggcattgggtacgagaccaaatcgtatgcgtttgtacacaaagaaatcgaatacgccgacaaaaagaatgccgcgcaaaagatacaattgcgaatgtcgcaatctctcccgctaaaggtcaacgtcgacaagcaaaggataatgtcaatcgagcctctggaccgaaagctgcaaatcattaccccttttatttcatcgtcgacattctctgattgcaaaatcgcgctgatgaagaagggcggagacttcccgcacttggaggagcccgaggacttgttcacgtacttgctgtgccacatacgcaagttcatgaaccaggacgcagatgcgcagaaccagaaccaggaaaatcaggaaaactgaaacaagtcaacttggttttgctttgaacatttaataaaaagatttgatattcagaaacattatatggaaaatgtgttgtggattggctccaaaattatgatgaaatttcacttctgttcattcattcagtgttgtgtaaatatgattttgcaaaattatttcttgaagtttttcgtttgaacaatttcattttgaattatatgaaagttcttaatgtttatctttgatttgtatctgaatttgaagagaattctacgagtggtacaatgtttatttcaatattatgttaagtgttgatgatgctgttttaatgggatactttaaatgtttatattcttcttctttgttttgtcgtgttgtgctttctttttgacgaattggaatgttatcaaatatttttatgatgtttatatatctgtgtcttgtgaaaatgattgggcgtatttaatatttggatcacttttgtttcatggattttcatctgagttaattctcgtaataatggaaacattggatatcttgaatattatgtttaatttgttgtttgtactaaacagtgttataaatttgcttattgtctttacaacatcgcaaccgaataatacaaaggtgaatgaattggagctgaaacagggaattggctgcaaaagcattttagtttgatgtaaaataaagtattcaaattttcacagttcatcaactttttaaagtcaaactgaacgtatcgtcctataggaccttgaaagtttcagagtttaaatattttacaaaagaagaaattttaattaaaattcacaccaaaaaaaataccattaaaaatcttaattacttttatttgttaaaatttaatcttttttatttttagattaaaatctctttattgtattaaccattgatcttcatcatgttgtattgcattgttaaattcatcattaatatgtatggtttgcttttcatcgtctgatgaagactcagaaaggatttcagtagttttgcttgggattttcttacttcttcgaattgtaaaaattattattccaatgatcaataaaacagctataattgaaccacagataatgcctattaatgcattagttgaaatctttttagttggctgagattgagtttgataatatgtaaacattatcaaagaataatctaggttatagaaagaatactgaataattgtgtattcataatgtattatttctgtagaaatataagagtaacatgtattatataatgtaagtaataaggaatttgttaaatacattgtgtaaacagaatatgattgtgttaaatatatataatatgttaatgtatatgaatataaattagttattattgtgtcatcaaaagcattatcttcgataattggtgttatataacctaaaaagtaaatacatgtgagattactgcattgtgcaaatgctgaatccccaatagaatttacattttggccaataataattgttcttaatgatgaacaattctgaaatgtattagatccaattgttttcactgaatcaggaattgtgatatttattaatgacaaacagttagaaaatgctgaaattccaataaaatttacattttggccaataataattgttcttaatgatgaacaatattgaaatgcaccagattcaatccttgttaatgaatcaggaattgtgatatttattattgatgaacatttagaaaatgctgaagctccaatagaattcactttttaccaaagataacattttctaaattaatacattcttcaaaagaatatgctccaattgttgttatattttcacctatataaactatttttaatgttgtccattgtttaaatgccgtgtttccaattttcataagtgaatctgaaatttttatcgtgtcatttgatcttcctaatggataataaacaatttctgtataattcttatcataaagaattccatctttttctgcataatttaaattatctttagatacattaataaaataaagtttagtacaattagcaaaaacattttgttgaatagtataaactgattttggaattgtaataatttgtaatgaaatacatgaaaaaaatgcatattcattaatagaacttacattttctccaatattaatattttctaatttaatacatgaagaaaacgtataactttgaattgatgtaacaaaatttggtatcgttatattgattaatgaagaacatgttgaaaatgcattactttcaatcgtttctacattattaccaatagtaatattaattaatttaacacaattagaaaatgcataacttccaatcgtttctacagattcacccaataaatactgtttcaagacattcacatttttcaaaagcattagattcaattgatataattgcattctcgatatcaacagaaattaaagaaggccatcctgaaaatgagttggaatttattgtatcaattcctccttgaattataagatattttgtattctgttgatatgaatttttagatgcataatcatttgaattaattattgtaaatgttttagtactatcatcatacgttgaaaatatttgttgataaaagaaaacaaataaaaatggtaaaattttaaatttaactttctcttttggaataatttgataaattaaattcaataaacagtttttgagcatcaaaaacaatataaaaaggactgcaagaataaataaaatatttgacaaaattttctggaagaagaaagacaataaatttgaagaattttggttaacatgctgaaaatcagaacaaaatgaaccactgatttttggaagagatataacagattttctagtttcaaataaaatttgaagatagaaatcatgtttagaaaggattttaattctttgaatcaattcaatgttatttaactgaggtatttttaatacattggatacattgcatgacatcgtgaagactagaaacagcatcccaaaaaaaagcattaacaattttttttacataaccgaaacagtttgattcaaaagctgatgttaaaaaattttgacattgaaatttccttcactcaactttcatgtattgaaaagcttttcaatttttttatgacaaccgttcggacttccttcactctgggaagtcacttacttcccaggaaccaagaaaaccaacttttttacatattgaaaaacttcacctattaacggaaaatgtttttggtttttaaaagagtgttcttcaacatccttttgagatgatattggtttaaaacaatcatatcagttcaaaggcgatatcatctctataattagttttggttcatacaaaaataaactatgttgaaaaacagtaactgttgctttctaaataaagtcatttaaaattcatttaataaatgaacaaaattaatacattagtgatttatgatattaatggaatacatagctccttcccggttcaaactatttggttcatcccttggggatgaatcagaatggtcatgttaacatttaactgtttatcaatacgaatccccttgttaatggataatgatcgcgacaaaatactccttggctgtatttttgtatattgagtttgtacaactcattttttcttattatcaacatatttgagtgcaaacaaccagtcagaaaattgtttgatgcttaagtgaagattaaaggtgttttaatgccactttttccgattatattataacctgaatttctttcattttggtgctctttttcaaaaattttaactaagtctccaaactcattttgctacgcagaaaaaacattttggttttaatagattcaaagagagcaaaatatttacaacttcaaatataaatttgatcaatgttattatcttctttgaagtcttttgcaaatggatcttcatcaatatttttcattgacaatacacctgtgtttatattcgtttcaccattttcgtcaaaactttttgatatttgttcaatagaattatgttttttgtttttaattagaattaaaaccacaacaagtaaaataataataataacaattacaaacacagtaacaccaattataatgttataatttggattaccaccaatgtcattatcttctattgtatataacattataaagaaattagaataaaaagaaaaaacagaaggaaatataataattgtatattcataataaataaattctgtgaaaatatatgttttgattgaattaatttttgagaatatataagttaaagtaaaacaattttttagtgaatatgtttgtgtaaatgaaataaaatatgttaaagtgaaagattttgaaaaacttaatgaaaaattggatataaatgattttgattttacaaatgttttcgatttggtgtctgtagttgatttggtgtatgtatttgattgagtgaatgtgtttgtatatgtatttgattgagtgaatgtatgtgttgaccaaggatattgatcacattcatcaattggcgttcctttggatatgttaagttctccaaatgtttcattttgatataaatcggatgtcatgacaaaattagttacaatttcatcaaaagcattatcttcgataattggtgttatataacctaaaaagtaaatacatgtgagattactgcattgtgcaaatgctgaatccccaatagaatttacattttggccaataataattgttcttaatgatgaacaatattgaaatgcaccagattcaatccttgttaatgaatcaggaattgtgatatttattattgatgaacatttagaaaatgctgaagctccaatagaattcacttttttaccaaagataacattttctaaattaatacattcttcaaaagaatatgctccaattgttgttatattttcacctatataaactatttttaatgttgtccattgtttaaatgccgtgtttccaattttcataagtgaatctgaaatttttattgtaataatttgtaatgaaatacatgaaaaaaatgcatattcattaatagaacttacattttctccaatattaatattttctaatttaatacatgaagaaaacgtataactttgaattgatgtaacaaaatttggtatcgttatattgattaatgaagaacatgttgaaaatgcattactttcaatcgtttctacattattaccaatagtaatattaattaatttaacacaattagaaaatgcataacttccaatcgtttctacagattcaccaataaatactgtttcaagacattcacatttttcaaaagcattagattcaattgatataattgcattctcgatatcaacagaaattaaagaaggccatcctgaaaatgagttggaatttattgtatcaattcctccttgaattataagatattttgtattctgttgatatgaatttttagatgcataatcatttgaattaattattgtaaatgttttagtactatcatcatacgttgaaaatatttgttgataaaagaaaacaaataaaaatggtaaaattttaaatttaactttctcttttggaataatttgataaattaaattcaataaacagtttttgagcatcaaaaacacaatataaaaaaaggactgcaagaataaataaaatatttgacaaaattttctggaagaagaaagacaataaatttgaagaattttggttaacatgctgaaaaacagaacaaaatgaaacaaaaatatttggaagagatataaaagatttttctagtttcaaaataaaaatttgaagatagaaatcatgtttagaaaggattttaattctttgaatcaattcaatgttatttaactgaggtatttttaatacattggatacattgcatgacatcgtgaagactagaaacagcatccaaaaaaaaagcattaacaatttttttacataaccgaaacagtttgattcaaaagtcagaagttcatatgaaatttcaaatcagagaaagcttctcaaattttcaattaatttaattttcaataaacgatgactgtagttgcttcactctgttagaattattaaaataatatgaaattaatcaatgaaatatatgatatcaacatatgacacaaacaacataatgtcaaaataaatattatttcccttataaaacatttaatatttaatcaacataattagaattattcatttttataattgaatatgattatgaaaattttattgatataaatttctcataaaagtaagtaaatccctattgttataatgatatataccttccttgaaatttttggtttcagcattttctgttattgtattggatattgtttttctttatgtttcttatgaagagacccatcattctttgaaagctccatatttcacgaaacttccttctaactttcaactacaacttattttttatggaactctggtacataaattatttttaggaaattgtgagtttccaaatatttcgatggattttaccacaatttattgtacaataacgacaccattttgttcatactaaaacggatatttaaaaaattaaaaaattcatgtgaattatctttattgtatttaatatccatttccttttgcttaattttgaaagttcttgttggccatttccctaatttctctcattttttctatatattcattaatatgattattaataacatcgaatttttcctgatcacctaattgcatccactttgtgaaaacagtgtcataataatccattctatcaaaacaagggaaatatgtttgcattgtttccttcacagggtaaatgaatctaaatccacttgggattcccatttcttcaataaagtctctaattatcacgaagtctgcaaaaacaggttggatccaagggtccaccccaaattcagtaacgtctttcactcgtgattcggttactgaacgatagaactctttttcaatgagctcgatttcaatgcatggatggctttccctcgggtcgcagtctatgattcttgccatacgtaataagtctaagttaagaggatatttcatttcctgatcaagttttgaatccataccacttaaagatggtgaaatgttgatttcaatcaaatgtgcatttaaatctgaatcaagcataatatcaattccatacatctcatatgaagtatgatgatgtggaataacttgtttgtgttttagcttgatttcacacattcctgcaataatagttgcaattgagattctttcgaattctttcatgagcctcgttggatcaattccttgacttctgcaatactgcataaagaagccaatcgaccatttggagttttctattgactcatgaactccatcgcttctaatgaattctttgtcatccttattaagtgaaaagttggtaagatgcatgtgttggtcatcaggagatgagtcgggtttgtattcgtgtgtagcaaaacgtgccattccagcagaatgcatataaattctgagtggttcaattgatgtgactaatatataaagccttatatcaaactttcgcttggctacaagaagtggatttctaatgtagtattgaacaacacctggagaggtgggaatggtatcatgattggttaatagatgaattcctttccctcgagatgaagcagaaggcttaactatccataaagcatgactttcccaaactttgttaagctgttcttgatcacctggtaagaggtaactttcaggataaaaagaagcaaaatcaccaacacgttctcgcagttctgacatacgcatgtttaagttatctttgcggcccataagaaaagcacctgcaaaatgattgatcttttgccaacattgacatttcttgtattcagtcattgtgtattggcgaccccatgatgcattccattgtggggcattatcagtaggcgtgaatcctgcatgacgaaatgtggaacgcgtgaggtttgtgataactttatttacataatacttaattttgtgttttggaatatttcttggttgatctggtgttgggacattaacataactatacccaagtggaattgattgaaataattgtcctagctgatcaataaaagaattttgattcgaattcgttttataaatttggtctgactaactttttggggcgccccacgatatgagtaaagttcgcaaaactttgtgaagttttaaattcatatttcaaaagtttccttgttggtaagattttgaagcaattattcatgttcttcttcttcgcctcttcgtgtaaatgtttttgcaacaattcttttttttggcattttccacaatattatatttccatcatcaccggcagttgcaaaactttcaccgtttggtgaccaagcacaagaacaagtattagcctcatgcccttctagtgtataaagcatttgacatagttcaaggtcaaatatgtgtgacatgggatcaaatccagttgtcaaaatcattggtttatttgggtgaaaacgagcacaacaagctttggcgttatgaacttggataacttgtttttctggagaacggatatcccaaacagaaaggtgatcatcacttgttgctacacacataagagttcccgtatgatcataatcgatactaagaattgaaactcttttattgatcttaaatgatttgctccataaagattcttttggagaattaatatcccaaattgtaataagaccattatcatccccagctgcaaatgtactattaacaggattgcttttgcacgtagttatttgaaagttactggcgtgaaatgtgtttataaaattcaagtcatttgcattccaaagtttaactgttttatcatttgaggcagtaagaatgtgtccgcttgtttttaagatatctattgagtttattctgccagaatgacattttttatgaaaatttgattctgtttggttgagattccatatagaaacttttccatcagttgaagaagcataaattttttctctgtcgtttgagtaaacactacatgttggagtaaaatttttgcattggtatattagtggccgatttgaattattaattctatatgataatattcctaatgaacgtgaagatgctagcagcattgtattatttggactgaattgaagtgatgctatatcttttcttggagcaatgaatcgattcttaaaagttggtttcattttccatagtacgttaatatatttaaacggttaccaaatttttagatgatataataaaaatgaaggttgtgggattgtttatttaaaattatttatgttaaagcgaaacttaccacaagcctattctttgtttgttaagcataaattaatgggccataatcttcgttaatttcctcgatgtcaacaaaagttactggtacttgatcttggtttaccatctcttcagtacagggagaatcacttataaatgtaccttttgtgcaaaacatttgatatgcctctctcgttattctaaaatgagttacaggagggtaaagcaatgcgtcttcatcaaagttatttgtgaaatatttaactgctttagcattcctttttgcattaatttttaaaataaaatgagatgctttatcgtgaaaaatgtattgatttttagaaacaattgtgaaagctcttgttgtaacataatcatcaagtttgtataaatatggatctaattcttggttttgttcttcataatataaaattgttggctcctttattgtatatttcagcttatcaaaacttcttttaaacatatgaaagtaacaccataggttagaaatttctcctgtgtttatgatgctactaaattgttgataaactacaggagaatgaaaataataaaaaattgtgtttgcatcttctgttcttacataatccagcacgttttcagaaatttctttaagtgatacttgaaagaatattttctggaataaaacatccagcctcactgattcttcacctaaaattgtatcaatttcttgataagaacaatattcatattcctcttcttgatcagaattgggtataattaattggaatgttttttcctttatagaagtataatctggatagaatccatatatattatcagattgtaaaccatttctaagtaaatagataaggaaaaacatttaaaaaaataaatagtttagaaagtataaaaagttttaacataaaaatgtatcttacataagaaaaaagcaaataattaaataattttatgatattaaagaagttaaactttatatttgaactttctttactgagtttgaaaataatcatttttggttaaatgtgggaagaatctaaaaagatgatgaatacactcaaaaataataaaaattaacataaagataattttagattttttcataaactctattatataaactccaacaaaatttatgtagataattatcaaagtgaattacattatatttcttatttttttgtattataattttttaattcattttattgacataacaaaacataaattaaaattttcaaaaataaataacaatacaaaacaaattttaataataaaatgttaaagttaaacgtcaacgatcaattttggtggattttccagttttaaaaactcattttccatcattctctgattatttttagtttccagctcaaattttttaacattatttctattgactgattcttttcttgcatttctaatttccaaatccaaatttctttgattcgccaaagattggaatcgaattccatcattctctatctggttatcattctttaacctttttggaaacattttaatctttccgcgaataatatcatcgaatgttgaatcccaatccttatcccaatcctccaaaaattgcttttcattaataattcgaagtcttttactttctaatttcaattgctttaattgttcatttaatgaattgatttctttaatagttttaattctttcttcttcttctctcatatgatatagttgttgaatcgtttccattgtttgttttctttttgctttaagtttttcgatttcttccgattcttttctttgttttaatattttgctttgtaatttggtaagtttgtcttgatcagtttgtaacgaacgtaaaatcattgagttgtaattacatttaatgataggatatgagtctttattaagtggttgaaattgtttatgtgttaataatgttgttggacatttatttataatgttttgcgcttttttaataagttgtttggtgataatcgttcttttggttgaatgaaatgtatttggatcaataagaatttgattaatattgagttcaacccatgcaataacaagaaattcaataaattgtggtgatgaacagataataaaatccatgagttcaagccaatttgtattatataatagttcggaaaataaactcctatacaacggccagataataagcggattgttaagagaatctctaagtttgggattataatataagaatatcgtatcaattcgtgttaaaactttgggtggaggactacaaatatcggatatccattcagaaaatatgtttgtaagtatggtcattgaaacttcaaagcagaacaatagatcaccaccaaagctttgtgcaatttgttgaacaaaaaatggaagccaatcacagcctagaaggggcgcatgccaatggataagagcattggcaattgtaagtgtttttttcccaaatttttgttcatattgattttttgtttgttgaaattgaggacaattaacaagtgttttgaaggctttttcattgaaaggtaattgtaaaatttgtgaccaaagttctttcctgaaattattagggaaacaatgggattgattgagaactttttttagcttccttgaaggaatctcaactttagatccatttttattatagagatataatggtgtacattcaagctgatttaatgcacatttttcgttgaacattttcgcttaacgtacgaaattcaataaatacgtttatttttaaagacgtttattatttccgcataaacttatgaaaataatttgatggaaggatgaaattgtttcctgaaaaattcttcgaacacctcactaataagtcatataaaaaaagaagaattacaataacatccatttgatcattttaatcaaaaaacattatccggcaatagacaaatgatcataacatttttttgtaaaaataatcagtttttaatttaagcaacagcattttgaaattatcgaaaactcaacaaatagacataaaatttctggctgccagtaacaaaaatgtgatcgagtttcttgaagccgtcgggctttgatcgaccagttttgtgaaaaagcacagaaaattcaaagcagttttttatttttaatcgttgtcaaattgacggttgtccatttttcaaacagcttttgagaatacggcaaatcaatttgaatgcttcgtcgtaaaaacgctataaaattataatgctttacacttgtcaaaaagcaatttggaacggcaattgttgttgaaaaatcacttttcagacacaaatttagtgaatggaaaagttcgattcttctttttataatagcttaacaacaattttattaagttaacaaaattttttactatcggtcgggcgtttcgtgtgttgttgtgtacagatatatctgtatttacaaatgaaattaacaatattgaaatattaaacatgaaaatttatttgcattatttttttatttcgtaaatttaaggtagttaagggatacattaagcttaatttaattattgctttgatttgatcataaaatttgattacacagataagcttatctgcgttttaaaacaatttaagcttgccgtgttattatgttttgatttaagcaaaaagtttatgaaaaatggtgataaatcttgtttgaaaggtgaagccaaccgctgcgccaagccaaaggcaagctttttcaattaatcgttaacgaacgttcgttcaaaaatgtcacgaaacagttcaagcactcaaaattcagagcagctctcaaaaacttgattttttgtcactatcatgtttggactcttcctgatcctactcgcaagaccagccaatataaacaaaaaagaaagtaatctcgaacaagccctttttggccaagaaacagaactagaacgcttaacaaaatcaatgaaaatcctcaagtgaatcttcatcagaatcctcaagtgaatcatctagtgaatcttcatctgaatcatctagtgaatcctcaagtgaatcttcatcagaatcctcaagtgaatcatctagtgaatcttcatcagaatcctcaagtgaatcatctagtgaatcttcatcagaatcctctagtgaatcttcatcagaatcctcaagtgaatcatctagtgaatcttcatcagaatcctcaagtgaatcatctagtgaatcttcatcagaatcctctagtgaatcttcatctgaatcatctagtgaatcatctagtgaatcttcatcagaatcctctagtgaatcttcatctgaatcatctagtgaatcatctagtgaatcttcaagtgaatcagtatcagaatcttcatcagaatcatcatctgagtcctcatctgaatcagtatcagaatcatcaagtgaatcagtatctgaatcttctattgagtcatccagtgagcctgcatcagaatcatccgtcgaatcctcaaccgaatcttcatcttcagttcacaccactgaagaacactcttctgcagttacttctatagttactgagacaacagaagccactgaaggaacagagacacaagaaccagagcccgtcacaagcacagcagtttcatccgaacaagttccatcaacatcagaggaacccgcacaagaaagttctgttacaacagaggcagttgtcggcattgtaatcgccgctgttgtattagttgttgccattgttcttatccttgtatttacatgtaagaagccaaagaatccagaacctgactacttaaatcaatccgacgaagagaatattacattcatttaaacttactaaattccattgattcaataattttattattttttatcacactttgtccagacagatttcacttaacatttcacatcatttactgcttcggatagaagacgacgattccggtgcccgcgcgcagtttgtggttcatcagcaccgtgcggccgctgtttctgttgttggcggagtgcacccagaactcaaagatcttgaagtccccttcgtaacttgacggcatgtcccaatactggctgactttgctgagagaagtgggaacattttcaacaaggttcgagatgccaatgatcttctctttgaacgtctcaagcgcattcagcgaaacaagaacaagaccaaactccgtcttaacctcgttgatgttaagcgttttgtagacgagagagcgctgagagcatattggacctcggtaataatgtttattaaggtttaggtaggcaactcgatctgattcttccaaatcaatgttgaatttggtcgtgataacaaccgaatatggaagacatgactcaagagaaattggtgattcagtgactttgaaatgttctggtttaaaaaatggcacaagaagtgaaaatcgattaccaagtgcttcagcttccttaataaacgatgactctataacaagtgtacgccctgataagatggaataaagaatatgatggaagattcctgattctctaagatctaacatcttgaacttgcattcattgaattccttctctttgttaaggacgatagggaaagtgccaagggtcccaaacgtcaaaaatgggtccaatgtgtgttctttaccataagaaatggctgaactagagacatcactttggaaaagagagtgaatatgatcttcgagttcttgttcatgcgctttaagatctgtgatttgttcaagatctcgaagattattatcaatagtcgtgatttgttctggtgtaataccttcaaatgttttatcttcagacactgtggagcctgtgttaagggaatcaaaaattggtgaaatttcattcatgattgtgattatttgtggactttgttctttgtaggttctatgtaaataatgaagaacttccatacgatggacaatttcgcttttaaaaatgttaagtgccgtttgttgcatatttatgagaaaatctataaaataatttgtgtgatgtaagatttctctaattaacatagatatttggttagcaacaacaatgcataatgttctactaaatccacgtgcttcaatatctggtactgtacaataaaaagcaatataattataacttttatattttgattctataactgttggcttaggacaaactcgaggtatatctggaattgctgaaactgatattactgcccacataaaatcttcttcttgaatatcatttaaatttccaatatgccaatgtatcataggtttatgtccttgaagaaactcatatattgcagagtaatattcagatgatggagggtcatatgaagttataacttttggtgaagaagctgaagatttcattttgatcttcttcttaacgttcccaatatcgaatgaaaagtgacaacttttaggtaacagtaaattaccaatggcacaagttttcattacagaagaggaatataaaacagatatttatgatttatttaaattctttgctcttaagaatacaaccccagaagttattgatattcctgttttaaaaatgctttttgatgcattagacaaacctctatcccaagaacaaataaaaactttttggctcaattcaattaggagtggattagcaggagtaccttatcctgaatttgaaaaatattatctttcagtattcccttatgattcgtcagctttacttaaagaagcttttgatgtatttgataccaaaaaaacaggtaaaataacaattgatgacatgaaagatgttgttacaaaaattcgtggacaagttactaatgaagatcttgatcagtttattgaagttttcgataaatcagatgataaaacaatatcatttgaagaagtacaaaaatcattttgctagcaataaaaatttatttatccaaaaattgtatcgaaaatttttcccgaaatagatgatttccttggttgctctatacccgtttttattgggttaaatgtgacgctttctggtattgtttcgtttgtctgtatatattggcttttagttcttccaagaacacatgttacagccatattatttgaaattaattgtggtccattattaaaagttgaaacaactgtttttgcaatgtcaagtgaagcatatttaagataaatccaattacctggcgtgttatcaacgctgattatgtttccaaatcgtgaaaaaaaccgaagtacttcatttgtatgacctggaatcactccaataacagtaacccatgtaccaacatcagcattttctgtaactggttcgatacctttttgttgttggtatattgaagttgttggaatactggatttatttgcaaaagtaccttcagttaattgtggcgatacatttttatcttcttttggttttgctggagttgctgctgtttttggtctaaaaagtcttgtttctaagaatggttgttgattttcttgttctctcatttaagctacgaccaattaatcatagaatacattaacgtattccggagcaccttgtttacagacatgttatatgaaaaatcgtatttttcttttcacaatttagaaaaaaatatcaaataccaaacattttttatatataaatagttctatgttaatttactttgatttaaagaaaatttcatcatgacaaaagaagttaaaaacgaagctgcaacacctacagcaagtacagacattgcaaaaggaataatatacaccaaaattgttataaaaacttggaaacttcgaactttatgttcgaacaacataattctgatgcataaaaaagcaacaattatagctacaattagatgtactttaatatggtcttcgatccaagattttgttatttctttaatcctagataatgttcttattaaggaacatataccagaaaatgttatataaaccaaaaacgtcgaagcaaaagcatttaaatccggcacagtatcactaaagcacacattaaagaagtattcacaaagaggaaagaacaaaaaaatagaaaacaaaatttctaaaacaaataaaaattttgataaaacaggttctttcttttttgggacatttgatatttgtgatgaagcttcaacatcattttttattgttaaaaataatgctgcctttccaatagcttttgataatataaaagaaagaaagaaaaacaaaaaatcgaaaacaattgaatttgttgaaccgcctctatcggatccggataaaccaaagaaaaagttgatgaaatgaattggaaatatgtaaaaaacatcaactaaaagaattgctgtaatccacatttggaaaccggaaagaattttcaaaaagttatatattactgtaggcaaagctacagctaatacattaccaatgataagagatgtatataaatatttactacaattttcatttggctttttataataacaaataaataagaaagaagaaatacataaaattccaaaagaagttaatcgaattgtatatgaaaatgaatgtggaattctccaaatttcagaaatagatatagatggattagttacactggaattagtaagcgcattataagaaataatagcaacaattataattaaaaaaataaatgaaataatataaagaattaaatagtttttcttaattggaaattcttcgtttgcttgaatgctgttgttatgaattagatttaaatgaaaagaaaacacaatatgagaaccttctttgattggtttagggtcaaatgaagcaacagtaaaattgaattcattaaatattgtgattaaatatgtggaaaaatattgcaacgtaccgttttggattgtagaaaagtggactttttcccatctgttgttttgataaaaacgaagatacgaattttcctttgcaatggatttcatatgttctgcactttctttcaaaattaaataatcacaatgatgatattcatttgattttgttaaattaaatgggatcaattgctgcctttcaccaaagctataatatatttgatattcatgttgagagtcatattgttcatcacaataatgaattcctggaattttttgagaccaaaatggattatccactgtacttactgcgcctacaaaaactttatttgtggcattgtatattggctttcttatagaatataaaaaatgaaaaaagatgcacacaaacataaaaaggtctcatgaaattcagaatgtctgttcgaagttcaaagcatagttaaaagtaaaataatgaaaaatagaaagtatcatatcaatcatgaatcttaggccttaactaaatacaacctgcaagaattaaagaaggctcttttaatcataaatcttttggtttcttttaagtaatttaacaattgttatgattcttatttttatataataattgattatttatctcaattgcatcattattttgtaatgcaaaaaaatccaaaaaataaaatttagaaaatacaaacatatttattggaatttcaaaggttgtcctctgttatttttccatatttttatctgtttcatcaagaatatggctaaaaagaacccagccatcaacggtaacacggatagtaatccaattatcacaccctgttttatatcagattttatgtcactcgttttcccgtcgagagtatttaagtaatatccgacttttatgttcgggtcaaacaattgatttttgcaataacgcccaaatagcgactggccaacaaatgacactttgtttccagcaattaaatttgcttgttctgttgtacacaaactataaacacggatctcagacccttcgtcagcgtttaaaagcctttcacccgaactacatcccattatagcgcattgaagaaaatcaacacttgagtttgtcttttcaacacataatattgagccatatgattctgctacagcaagtaaaaaataacactgttcaattttggtattttctattccagttaataggatacaagttttagatgcagcataaacagttttcatgtcacaattccgtatcgttccataaccgccatcaagacaaaaaccgccgttttgactttgagctgatgtgaaagaaacattaagatagttgatagatgcaaaacatttggatttcttgatgaaacatccatgatttatagactctagtttggcaaaatctgtctgagaaatatcaaaaacggaagaatcttcattatatattgcaccaccagtttttgcatatccttgctcaaatgtcgagtgaataactgtaatgtttcctttgcagtagatagatccaccttttttacctgtgttttgaaaaaataaactatgcttaatatcaagatctgaaagtgaataaatagctccacctttaagatcataattaagacacatcttaaatgtacagtctgtgatttttgcaggaccgacataaatattagtagatcgtgaaacaattgtatcattaaaaaaatttgctttttctaaaataactgctgagcaagaaaacatttggaaagtactttggtataaattgagtttaagtctgtctgttgaaaaaattgctggtcctaaagattttgaaaaaagtgatttttttaagtctaaagaacccaaggaagaagaaaatgaaaatacggctgacatgggttgattaagattggttagtaccaagtgcagcaccgtaatattcattttcttaagatatgaaatgtgatgtgaaatatatatcaattcaaaacaaacaaatgaatttatgcttcagtaacacattaaatcaacaataagcaaaagcaaaataaaatatcaaatatcagttaaaaacaaatgtttattttgtttttgatagtgattgaactctatctataaagtttctatattgctgatctaggttctgttttggcctaaattcgagaaattctttcgataccacacttcctaaaatttttgaaacagatgcatttccaattaatttggtgtatacttcgatgattgacttggaaaggtgaatatcataatcctcgttaagatccatgagagcattgttcaatatttccaaaacaatttttgtctgttgttgattatttgcaataattgagtatccttcatcaatagaaatcaaacattttaagatatatgcagctgcaattcgaattactccattccattgtgctaatgtatttagacatattggcaaaaattcgcttttaattaatgaggaaattatttcagattgctttcctttaacaagacctgcaaaaacaccaatggtagcaccaataaagcgttctgcatcggcgttattggagtttaacttgaaaaatggaaataaataagttggaattcctgataaaacaaatggaagtttggtatcggaattacttgcaacaagttggaaaagtaaaatattattgtaaacattgtttgcatttggaacgttagtttcaccacttgctaaatttggataaaaatttaagatatcagaaagaagtgaaacaacagtcccaggagaaaaccatatcattaaagcaaggtctttaatatttgcgcgtttggcaagtagactttttactgcttgtgagcgagtattttcagaattaatttgtttaatttctgaaacaatctgatcttgactaaaagcttgctgttgagcttgttgaacaactggagtagattgtggtcgcttgatgtttgaagcaatctttgggtagctcattgtgccactttttacataagaattaacgtttttcttgtcagaaagtgacattatatgattcttgtaaaaaacttagttccaaatgcttacgtattaaaaacaacccttacaaataggtgaataaatcaggttagtacaaatacacgagttacccaatgaactgataattatcaaccactatattgctttattactgatcaaattgtcggatgaaaatcatggaaaaaatcaatcaaaaattttaacattaacattgtttacatattgtttataaagattgatttaattgatgaaaacgaagctataaattcaaagaaataacaaaaaaacacacacgccaaaacgacacactaattaaacaattcaaacatgatagaacaacctgccataagtgataatttttttataataataataatttaatatttaccaaacaaaatatttatttttctttttgtaaaaaatggttttggcaaaaaagggaatcttttatatttttttaatttgtttttgacaatcttactaagcgatttaacatggtttaatgttcgctttttttggggcacccctatgtttccggtttgtcccggacatttcatccgtgacaaacctctcaaaaattcttccattaacactttgtttttcttttattattatttattaaaagatgaccaaaaaagtttattcttcaccaataatataaagatttaataaaaaaggaattaaataaaaatataatttttctaaaaattattttaattcacatctaattctggggtaatttcgattcatttcgatattaaatatttttcgtctttcaaatttgtcagtattcaaaattgaacgaaaagttgacttcacttatttatgagcgctcctcaaagaacaggacttctcgaccgtggatgggaagaaacccaaatcaaggttttcacccgttggtgccaaaagtacttatcacaacagaaaattgagttcaatgatatcagaactgatttcagagatggtgtcaagttactccaacttttacaaatcatcggtaaagacccacttccaggcaagtggcatcaagttgtcaagaacaggtatcatcaactcgaaaacgttcaacttgctatcaaatacatcacagaagttaaagaaatcaaacttgtcggtattcacccagaagaaattgttgatggaaacttaaagatcactcttggtcttgcctggtcctgcatcaacaagttccaaatcgaagatatctctgttgaagaaaagacagcccgtgatgcccttcttatctggtgccaaaagaacacacgtgattatgatattagcatcaccaacttcaccacctcatggtcatcaggtcttgcattctgtgcacttatcaaccacttcagaccaaacgaacttgattacgatgctcttaacaaggatgatcatatggctaacgttacagctgccttcgatgcatgccgtcgtattggattaactgtcttcctcgatccagaagatcttgttggctgtgtaccagatgacaaatctgttgttacacaagtttctgaattcttccacttctttgcttctgaatccaagatcacagctatggctgataagatcaagtccacactcaagaaccaaaagcaaattgatgaaatgtcaaacctttatgaacaacaagcacaagcagctcttgatgccatggccaaggaaaaggaatccatcgaatccgatgaatatgaaagaacagttccaggagttcgtgccaagcttggtgatgttatcaagtatgcacatacagcacgtccacaaatcattgaacttcgtggtacagcacttcgtacatgggcatccattgttaccaagtgtaagccaatctcacgtaaggttccagttccaccagaaggcaaagaaccagagacattaaatgccaaattcgaagaattagaaaacgttcaagctaagcgccgtgcagaacttcaagaaatcttgaagcaaatcgaaaaggaaaaggttgactcattcgatcaaatgtgccaagaaatccttaacaaagttgacgaaatcaaccaacgttctaactcacttgaaggcacaattgaagaacaacatgatgtcatcaatggccttattgcagaagcagaagagaagcaaagccatcttccagaattacaaccaccatacaatgaattgatccaattaaacttgaacaacagatccaagttcacaccatatgccatccaaaaggaagtcgatcaattaattgttcaccttaagcatcttttagatcaaaacaaggccgctgcccttcaagcagataatgaacgccgtatcagagaatataatgataaggcacaaaagtatatcgatgtcgcacaagatatcgaaaaggaactcgattcaatcgaaggttcacttccagaacgtcgtgctgcattcatcaagcaacaatccgaaattgctgaaaagcgtgaaaaggttaatgaaatcgatccagatttcgaagacctcgaaaaggatggtttacatcttggtatctccaacacaccagaatacatcaagacacaatacggcaactcactcaagcgtgccatcacagaaactaacaagatcttcgatgaaatggtcaacgaatatgatgcattagccggcaagatcacagaacgtgttcgtgacttaactaaccaagcagaagctgtcaagcaaccagaaaaggttctcgagacacaaaaggcagaatacgaagaactccaaggaaaggctgctgaagttgaagccgaattaccaacacttgatcacccatacagtgaaattgttgaattcaaactcgccgcacgtatcaagacaacaccatcagaagccgcttcacaagttgcccaacttaagaacttacttgataagttacttgaagataacgcagctgctattgttaagcgtgaaaacgaacgccgtatcaaggaatataatgaattggcacaaacatatgttgacaagtcacgtgacttcgctgctacagtcgatgctatcgatggaacacttgttgaacgtcgtacagcatatcttcaaaagcaaaaggaactcaacgagaagcgtgatgacctcgacaacttaacaccacactaccaagcattagaaaaggatggtttacacatgaacatcaacaacacaccaatttcaatctcatcattctatgcacaagttcttgagaagatcacaaacgcattgaacttaatctatgatgaaatggttaagaacttcgatgaaatggcaacagctcttaacgaacgtatcaagaaggtcgaagccgaacataaggctatcgatggcacactccaagagaagaaggagaaacttgccgcagaacttacagaagcacaaggcattcatgacgatgttccacaactcaacgaaccatttgcagaattaacagagttcaagctcaactatcgtcccaagttcacaccaattgatatccaaggttacatcgatcaattgattgctaacatcaaccacgttaaccaaatcaacgacagcgaaatccaagcagaaagcaacaaggcacgtatcgataactacattggcaaagcacaagctgttgtcgacgaagctaaagaactcgaagcatcaatcaacgaaattgatggcactaacgaagagaagcttgagaagctttatgctaaggataaggaagtcaacgagaagcaaaagaagatcgacgagatcacaccaatctaccaagaccttgaaaaggatgacttacaccttaacatcgaaaacacaccatcatcaatcttagcattcttcgataacatgcacgcacacatccacaacttgatccaagaagtggataaggccattgccacagctaagggtctcgaaatctcagaagaacaacttcaagaattcagagatacattctcattcttcgataaggataacactaagtcactcgaaccatacgaacttaaggcttgtctcacagcactcggtgaaaacgtcgaagatgaagaatgcaacgaaatcatcaagaagtacacaggcggtaacacatctatggacttcgataactacgttaagttcatgctcgatagattcactaagcaagaaacagccgaaactactaaggacgcattcaaggcagtcaccaagaacgcacctgttatgactgaggaattaatgaaccaacacttcaccccagaagatgtcgaatacatgaaggctaacatgccacaaactgaagacggatatgactactcacaatgggcagattcagttttcgttgagtaaaaaataagtccaattgatcatatatgattttttttaattagttttttaacaggtacaaaccaaattgcaatgctacgatgacgattgaattaactttgagtgcagcggagtcacttcactttgtcgcattctattcacaggatcaaactgtggcgattattcgcttgctttaaaacaaatttaatgctcatgatcaattcaatcagtgcattacatgttattatatataatgcaaaattaatgttgtcggaaaataaacttaatctcattcagccaaaatatttaaagaggaaataattaacattttcaaaaatattagtaaggagaatgaatgttttattgatgtttcatcgtttttaataatggttttgattaaaaatataattagtttaaaaaaatattttattttaaatatttatcctaaaaataaatgcaaacaaggaatccttatatttgcatttgtttcattttttaatcagacatttgaattttttgacgaaacaacaaaaacacttacaatcacaaattctaatgacttcaatactaaacatagttcagcagaacatgccattaatgaaggtaaaattgctaatattccacaatcagcattttataactacaattcattaatttcagtgaatgttacgagtgaacttaaattgattggtatgcaagcattttttaattgtataaatttaaagtcaattgttttttcataaatagtttagaaaatattgaaaattatgcattttataattgttatttattagaatcatttatttttggtgaaaatgttaaaacaattggtaattcagcatttgaaagatgtatgtcattagttaacatcacaattccatcatcaattacaagtattaaaacaagtgcatttggttcatgtttgaatttagaaattattaatgtttccaaagggaattcgtattattgtaattcaaataattgtcaagttttatatgacataaacctcactgaaatttattgattttcgccaaaaatactgaatgaaacatttaatattccaaacacagttgaaaccattaaatccaattcattttcttattgtttattttgttatattaatattccaaattctgttatatcgattgagtcgaattcatttttatcaagtccaaatcttgaaagtgttatatttggagaaaatgtttaaacaattatgaactgtgcatttcaaaattgtactaaattaaagaatgttactctaccgaaatcagtttcattgttaattaattcatattatgcactagtcttcaatttattaatatatcaatagaaaatgcattttattcaaattatggaaatgatggtattgtttataacaaagaaatcaccgaaattatatgttatccgccagggaaacaagaaataacatatacaataccatcaactgtaacatctattggaaattattcattttattcatgttcatcattaacgaatattcaactcacaaataatattcaaacaattggccgtaatgcattttatttatgttcatcattaacgaatatcacatttccattatcaattacaataattagcagttatgcatttgcgaattgtaattcacttgaaacagttattataggggaaaatgttcaataaattcagaattatgcatttttctcttgtacaaatttgctatgtgtttattattatgggacaaataaaccatcatttggtacatacgttttcgatggaactaatttttccgcagttatgacattagattcatattcaagtgatgaatttaattcatctgaagttttgaatggtacaagtatttttattacgttagaaaacatattcactaaaacaataaaatttattgttgaaaatgataactcaataaatttccaagttataataagtcaaacatttgaattaaaagaaaacgaaattaaacaaatcgaaattcgttataacccaacaactataggtaaaaacgaaatcgcaaatattaaatcagacgaacttggccaatatctttataaagttattggcataggtaaaccaccgccaatacaattgccattaacaatcgaaacaagtataaataaaacttcaattggtataatcgaatttataaatccgttttattttcccgcacaattttctataactttaaataatgaaaaagcaaatcaaaatgtttttaatttattatcacggaaaaaattctctttaactaattatggagatacaaatgaaatacaaatttcatttttgccacgttttaatggcgaatttaaatcgaatattattataacatataatgatattcaatgggtgtatccgataattggaatttgtaattcattaaatacgaaagatcaaaaaattatttatggaatgagttatcagaagatacaaaaagaaatttctttatttttaataggcgaaaaagaaaattataaaatttcggaatataaaattattgttcaatatcaaaaaggatttgaatttgtttcgaaatatttaaacatatttccgattaatataataaaaaatgaaaataataacaaatatataaatcttcaaattaaatattatccaaaacgtccaatgaatacattcttaataataatcattaaaaaccctttagaacaaagttggaaatttaatgtgaaacttcaaatagaaagttctgagccattacaaaatataattttggaatgttcgctcgataaaataataaaatataaacctaaaatcgttgatgagttcgatgagaaaactccttttcatgcttacctagtaaatggttcttcatctgagttctctatttcgagttcgaaaggttttatcgaaccttttgttgatgaaatgccttttgatgttttgtttagcccgaaaatttatggtaaagtaatgaaggcacaattaattatcgatactttagaagtgcaatttaaatatgacttaatcgggagaattcctaaatatatgccgccaaaggtttgcggtggaagaattgatttgtctacgccggaatctctgaaaagaaataatgcggtgaaaagaaatatcgttaaggaaaatatagaaaatgcaaagatttcaataccaaaaactgctagatcaccaagaaaaaaatatttttatgcataaatatttgtttttattataaatttgaatgtttgttttcattatttagataaaagccttgatttaatacaaaatgacattaaaataaatttagtatctgttaaagttgaaaatgatttgacacaaggatgaattactcatcagaaatgtgatatacaatgatttaggagtaaaatatgtgatattaattaatattacaacgaattgtaatattggtaattaagaaatggacaagaattaatataatgaacattttcaccaataaaaattgtttcaaaatcattacaataagcaaaagtattattcataatagaaattcaattaggaattgtaaatgttttacttttctcattcggataactaatgattcgtgaatttctttagcatataaaatgccatcattttcataatttgaatattcaaatttttttctaaagttcttgtttcaagtactgtacatttgtaaaatgcattatcaccaatgccattaaaactgtgagtgtttttgtctctgcttcatatgattgctttgtgttaacaaaaaatataatcatcaatatcaaaaatgttttgaatttttatcataaattaaataacttttataaaaatatttaataaaaaaaaaataaggtgaagcatacttgaatccccaaaaattacatgatcataacaaaaattcccgagttttgtttactgggttttgctaataaaaactttttgtatacatatttggtcaatttataaaaacacatccaaactaacgcaataaatatttttaatttttttcaacatcataatgattaccatactttgtgttttttattttctatatcatagcttatattttcaaacaagacaaatgttatagttcatgatatatgcatatatcatcaattttatttttctactccgcatctctagttaataaaaaatgattcttgtaggtgatatgtatatggctatttttaaaaaatcttaaagaataaattttgtgattccttttttatcaaatgatttgtcactttttatcaaattcatgaaaaacaaagggaaaaaaacccaacaaatacaaaaattgaagacgagttaaaaaagctttcatttattaagcaaaaaattattgatttaaagaaagaaaattttaccaaatcattaaattcattaatcaacaaatttaacaaaaacatgccattactttttaacacttttataagtcaaattatatattcattatgtgttataagaattaatgattttgatattgaaatatatttaaatttaattaaaggaattgaagcttttgaaatacattccagaaatttttaatgtgttttcacaatttcttcatgaaaaaaatacacaagaatcgaattactttcttgaatatatgtttgaatattattttcataaaaattacaaagcactaccaaagaataatccggaacttcataagcaattaattagagaaggtcataatccaaaagaaattgcaaaaataattcgaaatgatgatatagaaaaacttcaagaaatatcatctcaaaatgattttgattttgatcaaacaatagaaccatcatattatgaaagatgttcattttttaatcaaaagaatgtgacattaattgattatgcagcatttttttcttcagttaaatgttttaaatatttattaatgattaatgcaaatgtagaaaacacaggtaaatatgcagttgcaggtggaaatgaagaaattattcatttatgtgaacaaaatcattcatcatttaaagatgcatatgaaacagcaattatgtttaatcgaaatgatatctttaaatatttttatgaaaataaaattgataataatttaaaggaattaggaatgaaatgtatttgtaataataattatgatattttttcatttttgtttgaaaatagacttaagtttggggatgttatttctaaaatagtacaaactgagaaattatattttttatatctttttcacccaaatcgcttgcctcataatattttgtttttatgtatgaatgtccgaaatattgagataataaaatatattctaaagtataatattaatgtcaattatagagaaatttgtttttataatttcatatttaaaaataatacttggtaattatttatattatttttgactgcacttctattggcttcttataatggtaatacagatatggttaaattacttcttgaacattaagatattgatgtaaatgctaaattttcattttaatatatctaacattagattaaatgatatttcatttttagatgtaatttttctcaaattctttttatcatatttatttacttcttcaaatgtatatgccattaatgatgaatcttcagataatattgaatattccaaacattcattccaatttttttggtttagtagaattggtacacatcttgatttagtagaacataaatcaagtaatttaaatgctatttcttctttttgtattaaaaatgcagtcatagctaaacctatcaagtcaatttgcccttccatttctaataatttctcatttatttctttgggcgataattttgttctgattaaacaatttgcccaatgcgcagaaataaaacttgtatcaattcccataaaattggcaattcgaagtgcttcgaaatgtaatgaacgattacaatgtctttttaataaatttgggattgttaatgtttttaattctgcataagttataagaatattaaatggttgatgattcattatttcacatatgcgtaaaattgaaatttgttctgcaaattgatcaaaattacgtaattgaataagcttttcactttcttcagatccatcatctttaggtatgggaataattaaatgtaaccttgatatagctaaaagtaatgattgcctttgtttaaacttagtgaagaataaagtagcatcatttaaaccaattaaaccttcttcaatttcatcaattgaaaaataccttcttttgtaaaaatacgtgcaccatctatttcggtaattatagcaaaatctgatttcatttcccaataaagtgcacgatcagaattacctaacatccaaattttattattttttattagtaaaacagtatcgttaccacaccaaattatctttttcgggataacttcatcaaaatgaatatgaatttttacatcatttagatttttccccagaaagaaataatttgtatctgatctaattaaagcaaattcaagtgaaggagaaaatattatttcatcaacaggatattgaaagaactcagtttcaaatgatttttgcaataatttttcaaattataatttaatttgaataatttcttaattttttcttttcttttatgtgattgatagattgtacatcgcaaactaatatacaatttcagataaactttctgatgcattcagatgctcatcgatgtttaacaccgatagaatcggccatactcagtcaaatctcatcgtgttttgaatactttattcttctttattctgttgaattttgtcaacttttgtgaaaaggtaaatcacacggccatgtcgattcttgagtccttgatcaaaaaatacaaagtaataacaggtgtatatttcctctcaaagccagaacgaagagtttggaatatatttttcctcgttcttttcatcgttttcattttcggcttaataaatttatcaaaaggaacaatgcattctttccaaaggctacttggtttcgggttagaacctcaaaatcctgttaacggcgattcatatcattagctttattatctatcgaattagcaatcaataaactttgattctatcaagcatttacttttctatagcacacaaaacttatgcacccatttaaaattaaaagatatcttatttaaataataaatgtagtgtacttatcataatacaatgttttttataaaaaattgtctcagatattaataacatttattcatatggtgaaaaatacgaaccatcagagtaagcaatcttcgttttttggtcatgagctctttttgcttcttttcttctcaaagatgttaaaaattttgatgtattctctaagttagacattcgaatatcttgcacgtcccttagcttccttctcatttcttcaaggtagaaaggtccagtgttaggacgttcaataggatgatatgaatattcatttggaagtgaaataggttggaaagaagaagaccatttcgcttgagatgctgttgataacaaaatttgattgttttgatctgtcatttgtcggatagaatcaagatcatttcttatttcgcgaagtgactgatattgtttagaaatatcatagttctttgtagttgtctcagatgatgataggtagtattttaaatcattcacatatccggaaattgtttctatttttgataagtcgttttcaccatcattttcaaagatatttgatcgttcattctcaatttcatcaaatttttgtttgattttttcggtttcttctttttggctttctcttttgcactcgagttcaatttgcgcatataaacattggcgtgctcttgcactgttctttttagttgattcttttaatttgtttcttattttattgagttcattaaattgatttgataatgtttcgtgagttaattgagtctgaatactttgcgtacaagaacggatatcttctttaaggcaattgatctttttgattttgtcttctgaattattagttttaattgtttcgattcgattgaagagatcacgaaatttcatgccaaaaggatcaatggtatcaacagctaactgcgaaaatttattttgatcagttgtaaaaataatttcatctcttatcatctgccttattgattctataaacgaataaataatctcatctattgaggaattatcttggagtgaatttttaattgtattcgtaaaatcatttgatactaaatttaatttatgctgaagatattcaataatatttctttcaatagaagactgcaaactaaaatcatctttgtgattatttgattgaatattttgtgaaattgtggtttgaatttgattcacatcagaatcttcatctatttctttgggaatagcttcagaaaaatcactttcatcaagaagtgcatcaatatttaatggctttctttgcggtgtcctacctcgagattggggtaatttcttttttttctttttcttttcagtttttggccttggctttgactcggccatgccttcatcaaacagaccaagatctttcagtcctgcaataaagtcactatcaacttctgaatccattttggatccaaaatcagttagaatttaatttctgaagctcatagaaaacattgaatacatataattatttactatttttatccttaaaaaacaagaacacttcttaatttacatttattctggaatgtaattcatattttatttatgtaggcatgttttccatacattattacaatattaagcgttttgaggataaaacaaatcgttcaacacatttctttcatcatcttcattttcgtcaagccactctctaaatgaactattgtcaagtgcgtgttgtatcatttcatcacgagcaccttcatcaacttcgttaagcaatctttcaaatgcgtttacaatcattttcgtatcgcccaaagaaggaaaatcgaataaataaacaaaaatttctttttggtttaacatttcgaaaatgtccaaagaagactttaagtaaaatataattattaacttaattatttgactttttactgagtatactccttcatcgaacttagatataagtgagaaaaacatattaatgataaactcttcgttaatataaaatggtaattcgtaaataatattattaaatatttcgattgcatttgtaaatcgctttgattcaatcgatgtgtttataaaaatataattaataaagtcaaatgttccaatatcaacaaaatactgaatttgatttttagcattttcgataatgaattgtaacaattgaattatttgtttttgaagttttttatttttatcataaagatgaaagaaacaaactaaaaaattattttccacataaaaatttaaatacatttcattaactaaaatacattcatatgaaagttgaaaaagatcacagatttcatcaggatcaactggaataattcgaaataataatggaatgatttcaataaattcttcatcaaaccgatttaagcgtttcacaattgaacatgcaagtttcgttatgcgattataaatttcgaaatcatttgtttgtaaaatgccagccactttttgaatgtatggggattcaatgaatttgagaccaagatgttcggccgatagaactaaaagtcgcgttaatttaattgatggatgcgaagggaaagtctcaatgcaaaattgaaacaaaccttgttccatcgaaaaatcagccatttctgatgggtatgataatattcgataaagtaagcgaaaacatgttttggaaatgtcatacttgtctgagaaagaattctttataaccataataataaaatcttgtggaaataaaacttgaaaatcatcaaggatactacttaagtctgctgctgatttaagaatatcgctggatttagaactattcataaataattgataatttaaattaacccttttcaaaagatcttcatctgttagactttgggattgtgtgttcttccatttttcttttttcattaaaattttaagttccaatttgtatccagggttcatgtcggtgcaatgctgccataaaaaattataataaatatttttggcaatatttttttcactcaaatttcctgtgttaaagattcgaaaattgaatctgatatataaataaaattttacaaatttgaactccgatatcgttcatcggttaggatatgtggttttcatccacgggagcggggttcgactccccgtatcggaataaattttttcatgattattttttacaaaatttttacattgtctgagtaaaaataattttgggaaaaaatctttaatcatcaatgttggataaacatactccaacttagaacaaagagtaatactttgaactcagttgatattgacataatgttaatcatgattttcatttcattttaataatgttcttagaagaagaaagaaattcatagagtacagtttaattcaaataaatggaatttattgatatttatcaagtattcagtgagcgaaaaaaaaattggattcaacagaaatgtgatataaaataatcaatgtccaaatttttatccagaggaaacaaggaattttcaaatgaaaatttttccaaagcaattgagtactatgatctttcttcaaagaaaggtaataagcccagaatattatctgattctcttttaaatcaatcaatttcagcttcttttttagatcttccaaaattagcaagaaactactttgcagaagcacttgaagttcctgttcgaaatgaagctattcaaacatcacaaaaagaaatgaatgaagttccaataagacaaatttcacaatctttttcagacgatgatcttggtttttttgaagaaattgaagaatcctctttttttaagaatataaattcagtcaatgattcttttgatattgatagatggtcaccaacaattttttccaaaaggtgtttcatttattctcaaatcggtgattacaaaaatgcacatcaagaagcacagatcatgactactgttgatccaatgtctcctattttttgggaaatccgagctgaatgtgcatggctcattaaggacataaaatcccttgaggaatcggtaaagaactgcaaaaaattgggagcgagtccaaaccttcatatggccaagtattattggcttaaaaaagaatatgatcttgctgataaatacctaaatgcagcagtagaaaatcatgaaagtgcagctgtagttaaccgctccaagttcaatcttttaaggggacgcgtaatgagtgttgtaaaagatactccaaattcaccaatatcaatcttcactcaaaaaatcttaccaacaaaggtcaacctccaaattctcagccaatgtccttttcttaattatgttctatattcgttttatcgttctttctctgttcctttatcctctcttaaaccctcaatgttcatagaaattccagtacaaaaagcttgggtccatggaactccaacactgtcacagccttctcttaattcttctgtcgaagacattcctcaatgtttttgcctaaagatcaaagatatggagaccgttaagcacattcacgaaagcggccgtttattcggccgtttaattgataaggattcaattaatgaaagagcaacaatatgttatggacttgcgaccttagaagtatcaaaatgtatttccagttatcttaatagcacagataaaccaagtaatattcccgggttttctaatgtcattacaattataatgaattggttacgtcttattgaccctacaattcctgttttcataagaaaccaaattgtgaatactccgttatatattcatgtacaaaaaaaaggaatttcaactgaactttattcttataatcaacgtttatttgagaagcttaaaaatggaatatctcactctacctcaaaggaaatttatgttcatatctcctctgctcaaactatcgatgaactttggagtatttttaagtcagatattaaatatccaattcccaattcacctgcatcaattttcttatcttcacataacaacactttagactttgggcttgttgtcgaagaaggaaatgaaagtagaatacatgcaaatgatgaagttataactttatggtataatctaatgaacacagcgcgtgctggaaaagttggacaaaatgtatttgagttcatacgtacctggatgagagcttcaccacttacgaattactctcatgttgcaggttccattttgctttttgcacttttgcattcaatttttggggtaaccccagaagagaacgttatgaaaccgtttgatttgcaaatcgaagcacttctttcccaaaatttagagaagtttatcgaatatttaaagggaaatgatatgaagcttcatgttgatagttcagttgatcagaatttacctgatatagcaaaattaatgccaaatcttcacatgagaattcaaatgctacttgatatcccagaacactctcagacaaataatgagaacgaaaccaatgaagaaaaagaaaatagttaacaatcttaagatcacgaaaaattacaaattttctaaatcgaagaaaattaatccaaaacttgaatgcaattcattcatgtttacatttcctttattttgaaccgtatcatatttgtaaataatatcttattaataagaacaattattttttgagaaacaaagtttattctttgaagtcactttcaaaacgagaaaaagttcggtccattgttttgaggaggtcctgaagttgaagcacttaaatggttctgattattattttggaagttattaaacgttcccctttgaggtgtactttttgctaaatttctgaaatccgagtaagggtcataagggttcggttggttatccagttgcaaaggcatttgatttggctgttgtaaagttgtgaaaggcatatttgaattttgaggggggcctccaaacgtattttggttgaaagggtcgaactgatttgattggtttatatttgatgttgttggctggaacacatcgaagttattattcggaggacttccaaacgattggaatgtgttttgctgctggtttgaggaactacggaacatgtcatatgatacttgttgtgacttattgtcttgtttcggtggcgatgaagtttgctgattaaataattcgagcgatattatgttactgttgtcttgcttaggctttggcgtgcttggctcgaacagctcaatctttgctttgctgtcttgcgctgtggctggcgatggcgatgtctcaaataagtcaatgattatgttatcttgctgcggcttggacgcactcggcttgtcaaagagctcaaactgcgacttgttgtcctgcttgggtggctctgccttaacttgtttgctctgttcgaagatgtcgaattgcgaattgtctttcttagcttgttctggctttggtttgttctgttcgaatatctcaaatgacgccttgttgtcctgctttggaggctccgctttcttttgcttattctgttcgaatatttcgaatgaagctttgttgtcctgctttggaggctctgtctgcttcgctttattctgttcgaagatttcgaactgtgaattatctttcttagcttgttctgtttgcttttgcttgttctgctcaaatatctcaaattgcgaattatcctttttagcttgctctgcctttggtttgttctgttcgaatatttcgaatgaagctttgttgtcctgtttaggtggctccgctttcttttgcttattctgttcgaatatttcgaatgaagctttgttgtcctgctttggaggctctgtctgcttcgctttattctgttcgaagatttcgaattgcgaattatctttcttagtttgttctgtttgcttttgtttgttctgctcaaatatctcaaattgcgaattgtctttcttagtttgctctgtttgcttcgctttattctgttcgaagatttcgaattgcgaattgtcttccttttgtttctgcgcttcttgcttcttctcttccactttttcttctttgttttctttcgttactttttcttctttcggtttcggcttctcctgtctaaatgggtcagcgaatgcaaactggtcttccttcggctgcttgcgcgctggctgcgtgaactgatcgaatgtgtttgatattggcgatgaagggccaaacgcattcatttggttattactaaatgaaccgattggactgccgaacggatcgccgctcatcatttgattattactgctgaatgagccgatgcttgggctttggctattagcgaacggatcgctcatatttggagtgtcgaatgagccgatgctttgcgattggttattgttattaaatgaactcgtgcttgcgctttggctattagtagcgaatggatcagtgattggcggagtgtcgaatgatccaacagttggcgattcattcattgattgattactattcatatttgaagtatcgaatgatttaatgtttgcgttttggttattattaaatgaatcatttgcagtttgtttattatcatttgattctgttgaagttggatgtgaattattgaataattcgaatgaatttgacttgtaatctgattcattttgtgcaaatgaacttgattcagttattgtattattttgattattttgcttaaatatatcgaaaggatttacatcgcctttatttactactaaagactttgatttattaattgttttgttttgttcatttttattaaatatttcgaattgatctgatttatcttctgatgtaatcttttgttcaacgaatgaattagaagttgaaattttattttgttcatttttattaaatatttcgaattgatctgatttatcttctgatgtaatcttttgttcaacaaatgaattagaagttgaaattttattttgttcattttgtttaaatatttcaaattgatctgttgttatatcatttttattactttttgcataagaacttgatctattaactgatttattttgttcattttgtttaaatatttcaaatgaattcgattctgattcatcatttttatcattaacaaatgaatttgatttattaattgttttttgttgttcattttgttgaaatatttcgaatgaatttgaacttgagtttttattacttgcaacaaatgaattcgatttgttaataaatcctttattttgattattatttggtttaaatggatccgaaatatttttattagatttaaatggatcaggaaatgtttgattatcattagcaaatgaatcagatacatttgcattggatttaaatggatcaacaaatgatttattagcgaaaggatcagggaaattagcattagcaaatggatcagggaaattattattactattattagcaaatggatcaggtaaattagtattattcgattgatatggatcagttgagttataatttgattggaatggatcaatgaatgtaagattttcttgtttaaatggatcgacgtaattacgattaaattgttcgaacaaatcgacattattattgttattattattaaatgtattattatcattttgttttataggtgaattatcaagttgattttgttctacaatagtaatattatcttgtttaaatgtatcagtaaatccaatattaaattgtacaaatggatcaatgatttgttgttgatcatttttattctgtttatcaaataaatcgaataatttgttttcactttcatttgattgtgatacatcactttgttgttgattcattgagttaaagaattcatttgtatcttgttcattttgatctaatgatttactacgtttatattcagtatcattaaattcattagaacttctttgtttaaataattcgaacggatcattttgttcattattaatagtattatctttaaattgatctgatttccttcgcttaaaactatcttcatcttttcgaacaatttctgttggtgttattggtggtttaactgttgatgttattggatgtttaacagtagaacttcgagctctaattttttgtttgttatataattcattttgatccaaatcacgtttaagggtttcattttgtgcaaataatttgttttcgatacttttttgttggttatcaataatttcattatttttaggagaagaatcaatttcaacagaaacttcttgtgatttataaatattttgttgttgttgttgttgttgtacaatttcttgtttaacaggtataggtttagttttaattttacgtacaactttcttaacaactttcggcttttgttgaatagtattatttttaattgattcaagcatatcttttaattgcatgaaagcggattctaattcttcttgtaaaggtataaatgtcggattatctaaaacccattttccatgaacttttaatcctttcttattaatctttatgaataaatcaaatgcattaattaatttttgtgtcattttatccttatttttaattttggatttatcagttaaaaatgtttgaatgattttagatggaccttcattaacagtagctaataaagatccatgtaaaatcctttggatttgtaaataatcctcactttctaatgacttttgtaataattcgattcttactttaatttgatgataagctacacgtataggttcataatcaattatatgaattccatctttttgaactgggaatcgttgtaatacatttggtaattcataatcagtatttaagataactcttcgtacccattgtgtagttaatgtaccatgagtttgatcagaatctttaacaaatggtgtatcgaaataaaattgtgtaattttattaatttctttgtttttataaggctcgacaaatgtaatttgtaaatataatttattcggttgaagtttttcttgattcataaataagttctcagtaattaattcaactttatcattaccataaagttctttatatatcgaaattaatgattctgagaattgatatacatgtgttaatcttttttctcgatatatataagttttaccattatcattattaaattcttctccataaaatgtaactctaaagaagcgatcagtattagcatcagtatcagaagatttaaaattagagatatctttaaataataaagaatatgtcgaaaatattttcgataattctaaataagatcgttcattctcaaataatggccaataaatatctaataatataattggtaatatatatgttaaacctttttgacataaatcaaagattttctcaagatttgataataaatgaaacttttggatttgttctgaatcaaataattcgattatatttaataccgatttaatagcttcattaggcattgctaaattattaactaatgaactacatttagaaaatgctaaacatggatgttctaattcgaaaatatttggtaaattaccattaaatgttaaatattctatgattatagcactttgtaatacaattgtaaatgctgattcaactggtttatctttcttttctaaataattcgataatgattttaatattatgatcatatcattaggtgaatatataaataaaaatgatctttctaataataattctgatttcgattcaattgtaagtttgttgttgtttaatagttttgtatttgttattaacttcttaaaaatatcacaaaagattaatatgtcatcttcatctgtatcattttgtattaattttgttaattctattaaattatttgatgataaattagaattcggtaataaaaataatatatgtgttaatactccatatattaaatatttatttttacaagtttcaaatatatcaaatatcacttgtttaatttcattcgaaaaactattattctctgataaatatattaaatatgtttgtaatatttctattaatgaacatttctttaaatataataaatctttaaatgatgatttaattatcatcgaaaatgtttcacacataacttttaatgtttcattattacatttaagatttaatatatcataatataattcaattgtattattaacattattattcgttgaattctttaaataattcttcataaaaactgataataaataatatgtttcattacatattgataaaaaatcaatttggatcggggtttgatcaaagtttaattctaaatcttttaattcttttaatgtatctgcatgattagacttacgtaatattaatgtatgtgatttcttacgaaagttttgtggtaatgtatccaatttcttttcaggtacattttctttcttttgattttcatttttattatattctttaataattctttgtaatattttccttaatattatatataaattcttctcttgtgaaacttcggtttctttatatgttataggatcagtattaaataatataaataatataaagaaaacttcacttaattggatatcattagcttggaaattatccggatttatagaatatattgaagattctaatgtagttgatatagttataagcatttctttaggataaaatctaaataattttaataatataataaatattttcggattaattttattttgatatgatttaataataatttctaaaacaattttttggaaatctacaaaatattttaatgaaaaatagaaaaacttcggttgaaatacttttgtaatgaaatgtgtcgaaattgcgttttcaaagaagttatcttgaaattgtttattttgatgttgaaatatttggaatgatatttcataataaccaacttcaaaaagataataaataaattccgataaatattccagtaaatttaattgttggttttcagtatttgttattaacttacaccaatttatcataaaattattaatttctttcaaatcgaaattcttttcatctgataaaattaataatttaataataagtctaaagaatcctctaatacaaaatattatagattttaatgaaccatttgaagattccaaaaaattatttaattttatcagaattttttgatggaaatctttatataattcataatcgccatgaaatgcaaaataatgtatatataataaaaagtatatttcaaattgtgatgacccaatgacaggaactaatatattttgtaatgatacaaataaatgaattacatttttcgttgttaagttattaattccattaattaatatatcaaagataaacattaaattatcaattaatattggaactggtatagtttctaataattgttgatcacctaaacttttaactattgtataaatcgctttaaatttctcaaagttttcatcagatgaaactaaattagatataatttccgtactaaatgttatcgacgctttcgattcttgattagtactttctaatattattggtgttgtatgtttaccatcacctagaaatgatttacttgaagagattttatatgtcgatttaccaattaaattaatttgatttaacttatgattaatattatatatagtaaaacataattgcattgtgtctttaattggatatggtaaattaatgataaaaatgtcttggaaatttggacttgtttcatcataccaacatgtagtataactataatttacatatttggaagaatcaaatttagattgaatacaatctaatgcctcatcattattacggatttcaaatttgataattaaacttttggatttaagttgatgactcttgtctgtaatggtttcaatcttaagtgccatttgatgaaataccgaaaaaaatggaaaatgatttgttaaatgtaaacgacgtaaaacattgaattcagtgttaacgttctccattgtgacggttattctgaattgtttcggttttttatgtgtgatttcttcaatataaaacgtgacaaattcttccttaagtggcttttggaataaagatggatttggaaatgtgattttggaatcttttcgaagtaaagatgaaaattcatgttctgttattgcaaatatactaaaagcatctttatgcgcttctgttgatttagataatttggcttgagctatcttcttgtttttttctgtgctatcaagataatatttaatgacattttccccattatgtattgatgttggatgacaaaaagcaattatcatactgacattatttgttacagatgctggatcaagatggaaagtaatgtttgatgatgatgaagtttcttcatcaaaaaattgttgacattgtttgggataaaaatgccatggttgagaaatataagttcgtgtcttgttgtcataaagatatgcaatacatgtaatgggttcaataagctcgaattgaaaatcaacttgaacttgaagattaattttctttaaaaatgatgactcaacattcggtggtgggaaagaatctgatcccttgatttctgtattgtctgttgatttaagttgaggcataattatttttaaagaatcatcaagatatttatcaaccttcgactcgtctggaaacaaagattggggcgtgcgttgaacctccatttcatggatttctgaacaaaagatattgccaattggatctgattgtatttcattagttgaaaattctggaatttgaaacggattttgaatacccttcttgacactgacactattttttatccatggtatatctttttgttgattttcatttatttcttcttctatttgaggttcacacataattttgatcgtttatcacccaaaatataaaaatgtcaaaaaaaaaatctgtgaaaatctttgtctgccacatattccctatcaaaactgattcaccgaaaaattacatttaacattttttattattttatagaattcatcagccaatttattcaaataaaaatgattttttgaaaacattaacttatatgtatttgagattctcaattatgtatttcattttttaatgaattggatatttatatgttttttactaatgacaaatattgtaaactttgccaaaaatataccattccctctctgtatacaatgacaggtaatcttttattatgtattataatgcctattttagttgggatatagttttcatcatatagttttattttaaagaaaaaaaattgaaatgttttagagttagcaaaatataaacacatgtttaaacatttgctcaattgctgattacaatgatttaaaatatttgtatacaaaatttatatgtaaaatagttggtatgtttgggaaaccatggaattttaaattgaaaaaagcacttttgcggtaaagtacaattttaaaaagtgtcaacattttttcacttggcggttttacgttgaactttaaccgtctgactttctttaaaaattaaatccaaaaaactgttgtaatgcaacttttgtgtgaattttcttttcagcagcggttttggattttggaatgataaatgtccaaatcttgaccattgtattgctcaaaaaccaaatttgcagttcaccacagcctcaattaaacctaatgttttacaaatataaatttaatcaattttataatttatttaatgatgattttcagatcaatatccttcttaagatcattaaattttcctacactcctcataaaaatttgtttaatcattttgaaaatttactatttcaccataatcattgcatttcagaaatcaaaactaattcgtatatgaatttattatcgaatgagttcaatactaatttttcaatcccaaattacaaacttatacgtaaacattttaatgataaattcttttatcttaataatttcgagtttagtttcttaataattggacagtcttttttaatttattatattatttttaatttgctgagatcattaaaaaaatttggtatccataagttagaatcttattatacaccgaaacgaacatttggtttaatttttttcatttttctctttattgtgcattcatacgaaacgtcacttattataacatcttcaaatgaattcactgaagaagcaaaaaatacaacgacacatgttacaatagaaggaagtataacttctataccagatgctttccaagaatggcctttgctaatttatgctcaaattggagattcagtagaaacaattggaaaaaatgcattccaaaattgttataacttaagtaatgtaatctttgggaatggagtgaaaaatattttagataatgcattttattcatgttcttcattagataatattacattaccaacatcagttcaatcaattggaatgtctgcttttgcttcatgtacaagtgttaaattttttgctgtttctaatgaaaatcaatattatactattcttgataatggtgtgctttatgataaaaatcaacaaaaattagttcgttatcctgttggaaatattaatgaaaaatatgaaattccaaacacagtaacagaaattgatcactattcattttattcatgtgtttcattgaacacaattgttattggtgaaaatgttaatgctattggttcacgcgcatttcaatactgcactaatctctattgcattatttatcgtggtacaaaaattaaaacttcttattcaagctcctttggtaatgtacctgcaaaatatgtttataccttagatacttatgaaggaacaaatttttgtggtattaatgtaattaaaggagctacagaagaacagtgcactgttccaacaaatacattcattgtatcaaaaacattcactaattcaaatatattttctaacttaaattcatttaatagatcaaatacatttactcagtctaatacatatactatatcaaattcattcaccaaatctaacacatttactaagtcaaatacattttcgcattcatatattgcttcttgttcgtcagatataagtataactcattctttcattttaactgctttttcatatatttatgaatctttttctttatattcatttataacaaattcttttttgctctcaataattgattcttcgcaaacatatattaatacatatattatttattatgattatactgttgtattatatacttcttactatatcttttattcagatttttatacattaatgaatcaaaacaatattttagtgaatgataatacaaagcaaaatataatcatcggtatatgcgttgcaattgtaattgtattgattatttcaatagtcatcataataattatacataaacataataaaaaacaaaacagtaatagcaatgattatgaaaatgaaaataatttgaaaacattgaaagaagaagaaaattcagcattaggaaacttttctacaggattgtcaattgcaaattctgaggaagatccgtttgcaaaggatttcaaagaagataatatcattatgaattttagcaatatataaacattgtaaaatatctttctcctggtcctttcataattacacattaacaaattattattaattatgtaaacacgaaataaaaggtgtgtagatggtgatgatctttgataaaacgaaggatatacatacaaagaagaaaatgcaaatatttaaagggattatatatacaagaatagctgttaagtgcattaaagaatttcgtttgattgttgctattataaaaatgttattttacaatttttatcatttattttgtcttaaattatttatttttagactttagattgttctttatttttctttttaaaaaataaaaaaaacgacacgaaccagattcgaactgatgagggataaacccatagggactcaaatcctacgccttaaccactcggccatcgtgcctgacgattccttccaaaaatggaagcaacgaattacttactttaacaggatagtttcaacccgcataaaaatagggtaaccctgtagacacgatcaaaacggattcaaaacattcctatcgtatttgtgcaaaaaagaaagaaaagaaaaaaaaaacaaatggaagaaatatcaaatgaaagtattcaacaaatccttgacgaaaattctaaacttcttgcagttataatgaaatgtcaaaatgaaggaagaattatggactcaattctttatcaaacacgacttcaattaaatcttgtccaacttgcatctattgcagataatagacctcatccatcagttggaccacaagcagtcaaagaaataattacatcatctacagaagcgacagaagaaaagttaaagttatcaaagtttattcaaacgattcgaagagttggacttcgtgatttagaattaatttcaacactcactgatatacctattaaagaagttcgaacactttcgacaacatatatcgaatttttaaaacgtcaaaacaggaatcatgaagcagaagaatatgaagaagaactttcatcaagtatgatgtcacaagatattcaaagttcaaacgtataaaaattgaaatcaaaaatcactattattattattattttttgataaataaattaaaacatagatttatttttattttattatattttatttatgtttaataacttgaatagaaatttctgcatctccaattatttttgattcttctgaaagacaaagaacatgaaaaattgctttctgtccttgaatatcttttactttaccttgaattaaaaaatgtttaccaagtgataaaggtgctttatgttgacaaacaactttagaagtaactgttgaataatcctttggaagaaatgaatttacatatttacatgtttcatcattcatttgactaatcattcctggtgttgataaaatatcatctcctgctttttgtgttcgatttgtagaaagattaaaagtaacttctttattactttgaaattctgactctaattttaataattctcttaaattgatatctttagttgaaatccaatgacgtgaaatattttttgttgatgaaattaacatttttaaataagaaacaattcctatcgttatggtttacttctgtttaacggtttttattatttttcatgaataaacaacaaacacaaataccttgtcgaaaaattaaaaataaagaagatattaacatatggaaagaaacacctgcttattatgatattaaaagaactttttatcaacttttaaattctgttcaaagtaagtctcgaaaaccaaaagaaaaatcgaggaatattattattcaagaacttctagaaatattttcacgattaaaacaatatttaaatgaaacagaaattatcacacaaaaatccatttttcgtaataaaggattttgtcaatggttatttaaagtcaaagaaaatgcacatgaattattttcaagggttacgaataatgaagaagtaatatattattttacagaatcatttggtaatcttcaccgtgttgattttggtacaggtcatgaatttaattttttagcatttattacaatttttaaataaaatttatcttttaagtgaagaagattcaaagtttatagtgtttaatatcttttgggaatattggaaccttatttatcaagttattaataaatttcaagttgcaccagcaggttcacatggagcatggggcattaatgattatcttattcttccatttgtatttggttcgtcacaacttattggtaattcagaaatcacgccaagtaatattaatgaagaaaatatttcaacacattataaagaagaattttgttattgtatgagtatttcacatttacaccattgtaaatatgggaattttgaaacatcatcacgaatgttaaattcattaagatatgtaccaaattttgaaacattacgagaaggaatggttaaactttatttttgatgaagtcgtgaataatttttttgttgttcaacaatttggatttggagaacttttaaaatgggaaagcaaagaaaataatgaagaaaattttattaaataatgtattttaataaaaatattttttttaatttcaatttttcaatttatctttttgttgtaatatgaaaagtggcaatgtaaataaatcaatgaaaccgttattttaaaacatcgaaaatttacggttatcgattcaattttctattgatttgacaggcaaaatgcggtttgaggctcataacaaaaaatgattttcttccttttttcgctcttatttgattctcaacattgtaagaggaaatgtctttcgctatttgcaggttctccatctaagaaaaggatgtgtctaggaacatgcacaaacggttttatcgaaaaagaaaagattcaatttggtcaacgtaaaatgaaaaaagaagttagccaatgtctatcgaaatgtagtcataatgttaattcatccacagactttaaaaaatggcttaaatgtcgtaaaagttgtgtaacgattccaaattcagatcaatatgattatttttcaccagatcaatgtgtttcagagtgtgatcaacattggaagggtacagaccatcatcaaccgtgtcaagaacaatgttcaatgtttcaacaaaactttgtcaattcgaagccaaccaaagcagatccaaggcgtgttcaaatctttaccatttggtaatctaccttgtttttaataaatctttgttttcaacgaaacaatttccaaaatggtcaaatcaacattttttttcataacaaaaccgcaataaagttatgaaaatgcgacacttttacggttataaaattttgtgatttaaatttttattttttcttcgaagatttctgaaattatttataaacacttgggatctatgctctaacaacgccataaaaaatttgttaattgattatttaacaaataataaatattaattcatattcatttctaatttaaattattttttatcatgatttatatcattaaagaattttactcaaagaacccttcggttatggagtagattatgcatgatatttactttatacaaagagttttttattcattagcaggctttcaaagccataagttccaagtgaaacaacacatcaacacccaaaatcccattaaattcagaccaccaactggcctataattagaacttgtgattaaatatgaaaatcatctcatttgattatcatttgagaaacaaacgcttgagagcttggcttaccttaagcaacagtttaaattgaatttaattgaagataaaatgaaagatgatgtcaatcatatcaaatttaattttcattccaacgggcattcaatgtcgcttagttttgctggtgtgttcaacgtctttaaaggaattttgcttgatatgaaaaatatcataatcttcaaagttttacaataacatcatcctgatgttacaacctaagtgtatcaaatcagttgaactgttcattgatatctttcttgaacgagaagcaagtacgagaaagtccgcgaaacgatcggattaattgaaaagcaatcacttcacatgctataaactttcaaatacaaccggtcaacgcttaaatttctgttaaatttaacacaaatcccaaaaaattttttgtgtaacacattcagtttttcaatgccagacggatacaattatttttcaaataccagcactgtcaaattacccaacatgtcaaatcaattttcacaatcttattcagattgataacatgagttatattattatttatttttcccaatcgcttgtgaatattatttctcgcttttgaaatttaaatcaatgtttttactgagatatttctgtttaatttgattgctataactagttcgattaacaattcaaaaagattactttttctatgcaagtggtttaacaattcaaaattttgtacagttttgagttcattttttccatgctcttccttcttctcggaattgctcaagcaaggtttgaccaattgactgttggttccccagaccaatgttatgaaattagcattttgcctgatcgcttcaaggacatttatgatgaattctgcaaagacattccagttgaacttgaagagttctgttctaactacaaggttctcaagaattcatattctaaagttcactttagctgcactgctccaggtcttgaatataaggttggtacttttatcgatactgacatttgctatatccacatgttttcccaggtttccgaacttaacttcactggaatcgcagaaactccacgtatctatgttgcacttgatcaaacaggaagtggaaggattccaattcaagttaaaccacaagatatttccgacttaattccaagcatcattttccaaaatgatgttttcatcaatggtacattaattgctgatgatatcacattcttaggccgtagatacggtactgttgaagctgaccacatatactctgtaaatcaagatgacctcaatggcagcatatcatccaaaaacacatatctttatgatatggtttcacctttacccaatggtgaatgtcatcttattttacgagaaaacaacatcactgttccaaccagccgctggagaccaatggtatttaatgctgatgttcaattccaattcagtccatatatcactgaagataaagtcattgaaattgaactttatgagaatgttacccagccaactgatctcactatcttattagatcaacctacaatcgcttactatacaatgctcttcagggaatatttttacaccaatttaccatggtacctacttgaagatgcacataaagcacgagtgaaattcaatttcactggagattgggcaagcacaagcggattcgagttaaggctcaaatatccaccacacatagaggaaaagattgacttctcgagcattccatcaaacattcaagtcgttagggaaagcaatgatgatacatacttcgaagaaattagcatcggaggattgtcgactggcgtaattgtcgcaattgttgttgttgtcgttgttgttgtagctgtcgtagtattcttgattatcttctgtttatgctgcaagaaaggcggtaagtcttcttcgtaaaccataggaatatataactttatcattttaatatgtaacaaaaaagatttgaaataagaaatacttcattaaacactttttggagagtaaacataacacatttctatgattcagatccacatttatagcaattggtataagtttcaataactacagaacatacaagtcggcttttcctaaattaaataaggtattatttatatttaatggatgttgaaaaatttcgctgttagggatggggaatttgagtatttctatagttttaaaagtactctatcgtccaagtatcgaaagtgccaatgccgataggtccgacacatttttgtgaaattacgtttaacttgagaatacagttaattaactgtatgatgtatatcattgaaattttctgaacaaaatctttccttatcaaatcaacagaaatcacaagcggtaatattcggaaaaagaagaatgatcttgttcactgcgctctgccttgctttcgaatcaaattatgttacgaacccttcatttgaatcagggctgtcaaattgggggtttgattacagcacatgtaaagtaacatctgaagtatcacattctggaaatagttcaatttattgtcatgatacatcaggagagaggaatgcacttgcataccaatttaaatccaaaggatcattaccaagtggattttattataaactttcagcatggattcgaatgaaggactgcacatcaagattattagtttatgctgaaggccaatggaatgcatacacaattggtctatatgtttataatgataaaaatcgttcatgttcaaaaaatgataatcaactctataattgtgatgatgattggtattatattgaaggcaccacactagaaccattagaatccacacaaccatgcgttattggatttggtcttcgtgacaaaggcactggcgaattttggattgacgacatcacatttacacctgttatgacgaccacattactcaacagtgccgatgttacatgttggcgtcaagaagcgtatcgagacaagaccaatgtaattgttgatctagcagtcaaaaacacgcattgggagaatggcgatgatttagcattcgatgttgatttcattaaccaagaaacaggggaaacagagttaacacttcatgaatttacgatcaaacgtaacatcgaaaacatttatgctaactttgaattagatccaacacttttaacgccaggttattataatgttagtgttacattatataatcttttgtttaatattactgagaaaactcaaacatacattcacatcttatctgaaaaacgtgattatgccatttatattgatgataggatgcgtactattgatcatgggaaagtcttctttccacttggcgtatactatgattattgcgattattccgaagatatcattcgtgactatattgcatctgatgacagtccatttaatttagttataggcggcggacgtagtaaagcagcgatggatcgtgtatataacattacaaatggtaaaatccgtgttatagacttaggcacatcaaataaagttgcgtatagtaatgttacacaacgtaaagaaattgcaaaacaacttgctgattatgcgagaacagtcaaagattcgccaggtttatttgcatattatcatcaagatgagcctacgtcacaagtagttccatcaatgcatgagaatgttatagcattacgtgaagcagatcctgatcatcctgtttatactgcagttaatcgacgattagagttacattatattaaagaaggcttagattgttacggaagtgatatttatcccgtacaacattacgacgatttccatgcagtgtatacagtgacttatcaaggacggaatagtgttataaataatagagcgaattggggaattccacaattctttagttggaaaataattgatgaaaaacaatttcctaatgaattacctccaacttatgatcagttacgtcaaatgacatatcaaatgattgtcggcggcgcaaatggaattatatattatgactttagtgcgacaatgtgtgggccacaacagccatggcaagatgaatgggagaagttaaagaaagtcgcaaatgaactaatgaatgattacgtgccaattatattatctgggaatgacgttgatccaggttatgcacagccaacgtatgaaaaggaacttaatgttggaagggaatgcgctgtacggttctttaattatgatggatatgattacgttttggcagtgaacatttggcaatataatgcaaaggaatgcactttctttaagccaaatactacttcaaaagttaaaatagtgtctggcgaatcagaagtgaaagaacagacagagacaacattgactttgagtatgcccccaatggacgttacttggctgagaattacaaatgaagcatttaatggaaaaagtggattatcaacaacttcaaagatagtaattgctgtggttgtggttgtagtggtcattgtcgttgtcgttgttggtgttttgatatatctcaagaagagaaaccaaaaagaaatctcttcttcggtttaaataaatctcgttgactctttgtttatgtttttgatgaataccaaaatcattaattgaaacattgttaataaataaaataaatgttaaaatatgtatttcatgccaaaatcattataatgatacaattgtttttttagatataaactgaaatttttttctgtttaatgaaattataataaattgttatgaaaatttgtttaaggaataggtaaaatatgttatttaatgttgaaatatttgaagaaaatttacaaaatcgcagcatttcacatcataataaaccatacaattattcaatagctctgctcgactccaaacgaccaaatggataaaacaaatcttcttagaaaacgacatacctttcgaagttttaagcaaaaaatcaatgccattaatgcggatattacgaacaatttcgaattaaagcgggattcaccgagaggcggcgatttcggcacatatttctacgatgagttacaaaacagtatgaggggttatcttgatccagagtacgcgattttcaccagggatttacttcccatatctcgatcacttccaataattcttcataacaaagaaaaattatttaattattttattgattttctgaagaaacctcacgaggaaattaaaggttgtcttgaagatgtaatgaagttaattacccaactttcgcgtgatttaagatcagatttttatccatatttcccaacaattttcaagttattatcagaacaatttgatgctctaatgccaacagcttcggcagaattcgttgacgcctttttccaatgcgtttgtttcctattaaattttcttaaaaagtcattaatcaatgatcttgacaatgtcattatgatgttctatgaattcttcttagtacataaacgcgaattcgtcagaagacttggagctgaatcgttagcttatcttcttcgacaagcgccaaataaaattgattctcataaatcattagttgaatctggtcgaatattcatccaggataaaacgccagaagaagccgaagtttttgagaaatctcttggtcttgttctctgtgctgaaattaagaattttagtcaatcacttcgatcaaatgcaaccaaactcattgatcccttattttataataacgacgacttcattattaatgcgttttcatatgcgcaagagaaactttcgggtcatgtccgtgaacaatttgcaattccatatttagaagtattatcggctaagttgccgaccgttaactcggacatgtgctgtaaagtattcaatttctggatggagaaatctgaatttaacatttgtcatatttcattaaaagtattaccagaattaattggtcatacggacagtaatttgttatgtgaatttctatgtaacttagacaaatattcactcgaagacggtacaagtgaattgatttctaattctgtaatttatttgattgaatcagaaaatgttgaagaacatatagaacatttaaaagaatgtcgccgaattgtatatttaacgcaagagaatatattgaaatatatcactgagaactttaatcgtttgttaatgcatcttaaagttatccttgaatggatacatccgacgcaatatttaatctcaaatgagttaatacaatgtgttaaagataatttcgatgttaatcaagaactaatgatcgaattatcgaattatattaatgacaaaagtatatatgaaaagatcaaaaatataaataacttaacaattaatgagcgtaaagtattatattcattaatgggtaaatatgaaccagacttattaacagaacagcctccatatttaataacgttattaaaagatccggaaaacattaacgaagagtttttagatcttttatattcattaactattatttctataactaaatcaccaaattggttaaataagaaagatgaaatattgaatgaattatataatatatttaactttaatatcgattctcatgaaatccaacaattatcatcaaagattttatatgcattcattcaagatgataataaaactttcgatttattatcaccaaaagaacttttaattagagctgcaaacgctgtctttaattgtgaacatacattagaaagttataaaattggcgaaagttatatttctagattaacatcatcaataactaaattagcaaatgatatggataaaacttttaatctttcattaggattttctaatcaaaattatttacgttttcgaacacttgatgaagatttaatagttgaaatcattaaattcgatcagaattatgcaattgaaattattgatattttatataatagatatccatggaatgattgtagttttttagctgaaactttattaaaatctttagctaaagtttcatatgttaatgagaaattagtttcattaatttatctatttgctaatgataataataaggattataagaaattggaattattaataaattcgatttcatcattaactaaaaaagatgaattctctgagaaagcagaagaagctataatggaattattaaaatcgacaaatattaatattcgaaaagcagcttttaatttgttatatcaatcgaatatattaaagaataaagatattaaacaacaattaaaacaaaaaattaaagcacaacttgattcatttcttgaaactcgaattaatactgatttaatatcaaatttccatgtgtttatagaagaagaattaacatttgaacgtaaatttgttgtatcagttggaattaatatgtcgattggaataatcactgaatatttaacagagaaaagaaaagataaaaagcgttatgaacaaaacgcacaaattataatgcaagcaatgtcatatctaaatgattatgaaatagaaccattaattaaagcatttctaaaagagaaaccaaaagcatcagaaatacgtaacttcccaaaatttgcaatacctatgataacacgtttaactaatcatttaataccttatttagatcaaatatcaaatttattattattggcattaaaacaagcaccgaaaccacaaattaataaggaattaaagaaatcattaaatgcattatcaatctttttcgatagttttgaagcacaagaagattatgctaatgaaatattaaagtatatgaattcgataatgaaatataataatatatttggaattcgattattattatcaataagtaaatcaacaccaaaagtatatgaaaatcattatgaaatagttaatgatttaatagaattagttaaattaatgaatgctgatacaatcgatcaaatctttttaatatttgctaatataattcaatatataccagattcacatgaagaaattataaatacttttctaaatattgtggataatatgaaattatttaaacgtgatcgaatatggaaaccatttataatatttttagggaatatgaaagaatgtaatcaatcgaatatatataatgatttaattattaaattcgtattaaattatcaacatattgaaatgattgatattattcaaggattagaatttgatgataaacaatttgaaggattatgttcattaatagcttatcctttatcaactgaatttcgtaataatttcattccaataattagtgaatatttggatgaatattctgaatcatttatacaattaaatcaaaatgattttaatcaaaaatcattaatatataattcattagatactgttggaaagttttcatatatatttgcattacaatcatttgctgatatccaaattaatgatttccaattacgttcttcagcgataggatttttatctagattaatatcaaattcatcaatagaattaattaatgattttatattaccagcaattaaattccatttaaagaaaaaacattcacatataccaccgaaagaagttttgttcatattaaattcaattgtgaaaacttttccagatgttttaccttcaattacaaaaatatcaaatcaatcattcttcttaactttaggtagtggtgatataaatgtacgaattgaatctataaaacaacttagtaatttcatagaacaatttgatgattgggatattaatgaatttagtacaattttgtttccatttttatgtcaaatttatatgactccagaaattgaagtcgcatttaaaagtgtatgtaaatatactaataaagaatcaattaaatcattattaaagaaattattaaaagaaattaaatatggaactacattaacattattaattgcattatgtaatagtaatatatttactcctgaagattgtattcaaccattattaaatgctattgatgataaaaagattcaatctaaaattaaacttcgattaatacctgcaatattaaatatatcaaagacaccagaaattgtacaaaatttaattaaatcaatttctaataaaatttatagtaagaaagtagaaagtcgaaaaattgctcaagaatctttaactgctttaatagaatgtatggaaccaaatgatttttatgttctatttcaagctcttagaaatagattaaaagaaaatggtcaaataccatttttatatgtatcattaaataatatgataattcatactaaacataaagaatcatttgattcattcattggattattaacagaaactttattaaaggatatatttgaatatgaatcaattttaagaattaaacaaaatttcatcgatgctaaaaaatgtttatcatttgaatcatttcaatatttagcatcaaatataaactttcggaattctgttaatgaatttcttgatataattataaaacaatttaataaattacattcattagaacaagctaaaggagctaaaaaattaataatatcattatgtaaaggatttgttgagaatgaatcagttgatgctaaaatacttgtcgatgtaatcaataaatttttagatatttctgataatcaacaaaataaatctgaagaaaatattgaaagtaatacattagataatgttaaatatggaatgaaatatcatgatgatatattcatcgaaaaacctgaaagaagtgaaacagaaaatgcaaatgatatagtgaaaagacttggatcacatttcttaatatcattatttggtgtacatttattattaatctttttcgaacaagaattatttgatgtagaagatgaaaatcaagttaaattacttgaacaacttttgttaaaactttgggcatttacacaaaaaactaatgatactgaaacattaataatatctttaaagatattacaacattatattaacttatcttcattcttaactttgttacctgatattataacatttttaactaaatcgatttcgaaattatctaatgcgactgatgcttatggtcaagaaatctttaatttattacaaacaatattagaaaagttcccaacaatggaattcccaatacaatttacttgtgctcttgtatctttttgtaatacacaattagatatacatgaatcttgtgatcgaatatttggcgttttgttaatattaatggatcgaagaaatgatatacctgaaatttatgatactgctgaaatatcatttgatttaatgattagagcattatctgcagatgtacgcaaatattctgctaaattatgttcaaagtttttatctaaatatgaattatcaaaacaacaatttcggaatcgattacaatttgttttaggtaatttatcatcaccgaaagttaatgcacgtaaaacattaataacatttttgaaatatttcattaatgaaacatctgaagataaatatgatgaatatatcgaattaatatttacacattgtggtgtacgaattgcaaatgaaacagatgaaaatgtcatcaaaaaattaaataaattcattggattattattaaataaaattccaaataatcgattcttatcattatggaatttaatgatacgttggacttcaactacagggaaacaagtacgaactggattattattattagctacaactgtttcttcatgtcctgatgcgatgtctaatttaattaatgaattacaatcaatcattgatatacatattaaaaatgataatattaaagtgaaaactgctgcaattaacttacatcggaatattgttatgagttatcctgataatgaaaatataaaacttttatcgatttcagttattaatgatttaataattggaaaaagtactgcgaaaattggttgcgaattattgttttggtatctttctacttttaatgatttcgaacctgatgaaaattcattgttaaatacttcaaatattttattggattcattaattaattggaatggtacaattaaagaagctgcggattcattacatttgattttaataagaattaacgaagaaaattgtgttaacttcttaagagataattttgaaaaatattatgaaaacgaaaatgaaaatttggcacttgtattaatgagagttttcgttgcaactattttagaaatcgattatgaaaataatgatgtttcatattatataataaaatatataacattgaaagtaaagaatatgaaagataatgaaaaggcggcagataaagcgatggaattaatgcgtaataaattatcgcctgaactatttactgaagtatataataagataatggaagaagaattagaaagaaaacgtaaagaaaaacttgaactcgaaatagaggctcaattggatccagaagaatacagaagaagaatgaaagaaaagaaagaaaagcaaatcacagaccaaaggaagaaggcatacttcgaaagtggtggattcttgacaccttatgggcctgatggtaaagaagtagagaaagttcctttggcacctgaatttagggattaaatatgtaataaaatataataaatataaaattttatagaattcttgtttgggcatcaaaaatgatgcggttaagaaaacgtttaccatttaattgaaaaagtgtaatacttggccgggaggttattaacgttcgttttgatgagcactttttaactatgccctcataaatattcggctgttgtgtaatccattgatttaatttcaaattttttcaattattaattcattgtagacttatgaaaagttggattctgagtgttctattgaatttcttcagaaaattttatagttctttatttggtcgggtgaccgttaatttggaaccctcagcgttttcattgtttttggccgttaatttatacaaaatcttcaaaaatctggttgaaaaaaaattgatttaattatataacactgattttcttcaaaaaatgatttagtgatttagtggatatttattgtcctaaagtcaaataaaactaattctaaatgtttgtagaaatctttaaagacaaaatattttctaaaaaaacggtttattgatcaattaaagctcagaaaatagaaaatcttttactcacaatcaaaatttttggtattgaaaataatccttaaaacgatttttaaattaaaattatatcacatttacaaacggatgtgctccttttttgtaaatgatttcgatagtattggcgtggaatatggtgatgacgagtgttgggatactgggacatcacctacagaaatagatattcaatggcttaaagatactattcatgacctttgtaacaaatcaaatcaaccagagttattcccagaaatttgccaagagcttgtaaaaagaaattttattccccaagatgacctttcagaaataggagatcatagcaaagataaatttccgattaattgtggatctttatcacaagtctatgataccttagaagtgataggtgaaggagggtatggaaaagttttaaaaatccataatttggtcgatcaacaaatatatgcattaaaaatcatcaacctggagccttacgaagtggaaacagctgttcacgaggttcaatgccttgctcatcttaattttccaaacgttctcagatattatagctcatggcttgaagaaagtgaaactgttggacttttatcgctttgcatacagacagagttcatcgatgggatttcactttcttcatacttaagcactcgaaaatttgttgatttaccaacatcgcataaaattcttgttgatattatcaatgcccttgaatccatacacagcgctggagtagttcatagggatttcaggccatccaatataatgattcgaactgatggatcaattgttgtaattgatttcggaatatcatcagttcgaagattgccttttgaacgtcacagtgaatcaccacctcttccagtgacaacacaaggtagaattggttctctgacagttcgtccattagagcaattttcgttaaatgttggtcagaattcttcctacactatgaggaaggttggaaccccactatactcatcgccacaacagttgaacggaaagaaaagctgtaaggaagatgatatttacagttttggaattgttatgtttgaaatactatatggattcaaaacagaaacagaaaaggctaaggtaatacaacaactccgaaataaggccgttcttccagagaaattttcgaaggatttccctgaagagagtaagatgataatcaagctcaccgaccataacccgaagaacagaatgtcggcaaaggacgtccttcagtcaaatcttttttccacttggaaaaatgaagccaaaaaattgtaaatcatttcgaaatagacttttttaaataaaaataaaactttcagtattaggggtgtcccttattttcaatgtatgatggggtgctcctctcccactgaaaagcaaaagttgataaacttctgaaatttcaaattaaaaaacgtttttaacacttttttatgatttcttattattattatcaaatattatctcataactgtaaaaaccgaacaaagttgttacagtcgaaaactgcttttcatgaaaaagtttcgaatcatcgcagcagaatacggattatcaaaaattgacgaagatctatttgcagttgatttcaaagaagataatcatgtacaaaatatttaaattaaaatacattaaaaaatttataaaatatataaaattcaaacatatatcaagttctaattataggccagttggtggtctgaatttaatgggattttgggtgttgatgtgttgtttcacttggaacttatggctttgaaagcctgctaatgaataaaaaactctttgtataaagtaaatatcatgcataatctactccataaccaaagggttctttgagtaaaattctttaatgatataaatcatgataaaaaataatttaaattagaaatgaatatgaattaatatttattatttgttaaataatcaattaacaaattttttatggcgttgttagagcatagatcccaagtgtttataaataatttcagaaatcttcgaagaaaaaataaaaatttaaatcacaaaattttataaccgtaaaagtgtcgcattttcataactttattgcggtttttgttatgatgttgatttgaccattttggaaattgtttcgttgaaaacaaagatttattaaaaacaaggtagattaccaaatggtaaagatttgaacacgccttggatctgctttggttggcttcgaattgacaaagtttttgttgaaacaatgaacattgttcttgacacggttgatgatggtctgtacccttccaatgttgatcacactctgaaacacattgatctggtgaaaaataatcatattgatctgaatttggaatcgttacacaacttttacgacatttaagccattttttaaagtctgtggatgaattaacgttatgactacatttcgatagacattggctaacttcttttttcattttacgttgaccaaattgaatcttttctttttcgataaaaccgtttgtgcatgttcctagacacatccttttcttagatggagaacctgcaaatagcgaaagacatttcctcttacaatgttgagaatcaaataagagcgaaaaaaggaagaaaatcattttttgttatgagcctcaaaccgcattttgcctgtcaaatcaatagaaaattgaatcgataaccgtaaattttcgatgttttaaaataacggtttcattgatttatttacattgccacttttcatattacaacaaaaagataaactgaaaaattgaaattaaaaaaaatatttttattaaaatacattatttaataaaattttcttcattattttctttgctttcccattttaaaagttctccaaatccaaattgttgaacaacaaaaaaattattcacgacttcatcaaaataaagtttaaccattccttctcgtaatgtttcaaaatttggtacatatcttaatgaatttaacattcgtgatgatgtttcaaaattcccatatttacaatgatgtaaatgtgaaatactcatacaataacaaaattcttctttataatgtgttgaaatagtttcttcattaatattacttggcgtgatttctgaattaccaataagttgtgacgaaccaaatacaaatggaagaataagataatcattaatgccccatgctccatgtgaacctgctggtgcaacttgaaatttattaataacttgataaataaggttccaatattcccaaaagatattaaacactataaactttgaatcttcttcacttaaaagataaattttatttaaaattgtaataaatgctaaaaaattaaattcatgacctgtaccaaaatcaacacggtgaagattaccaaatgattctgtaaaataatatattacttcttcattattcgtaacccttgaaaataattcatgtgcattttctttgactttaaataaccattgacaaaatcctttattacgaaaaatggatttttgtgtgataatttctgtttcatttaaatattgttttaatcgtgaaaatatttctagaagttcttgaataataatattcctcgatttttcttttggttttcgagacttactttgaacagaatttaaaagttgataaaaagttcttttaatatcataataagcaggtgtttctttccatatgttaatatcttctttatttttaatttttcgacaaggtatttgtgtttgttgtttattcatgaaaaataataaaaaccgttaaacagaagtaaaccataacgataggaattgtttcttatttaaaaatgttaatttcatcaacaaaaaatatttcacgtcattggatttcaactaaagatatcaatttaagagaattattaaaattagagtcagaatttcaaagtaataaagaagttacttttaatctttctacaaatcgaacacaaaaagcaggagatgatattttatcaacaccaggaatgattagtcaaatgaatgatgaaacatgtaaatatgtaaattcatttcttccaaaggattattcaacagttacttctaaagttgtttgtcaacataaagcacctttatcacttggtaaacattttttaattcaaggtaaagtaaaagatattcaaggacagaaagcaatttttcatgttctttgtctttcagaagaatcaaaaataattggagatgcagaaatttctattcaagttattaaacataaataaaatataataaaataaaaataaatctatgttttaatttatttatcaaaaaataataataataatagtgatttttgatttcaatttttatacgtttgaactttgaatatcttgtgacatcatacttgatgaaagttcttcttcatattcttctgcttcatgattcctgtttttacgttttaaaaaaattcgatatatgttgtcgaaagtgttcgaacttctttaataggtatatcagtgagtgttgaaattaattctaaaatcacgaagtccaactcttcgaatcgtttgaataaactttgataactttaacttttcttctgtcgcttctgtagatgatgtaattatttctttgactgcttgtggtccaactgatggatgaggtctattatctgcaatagatgcaagttggacaagatttaattgaagtcgtgtttgataaagaattgagtccataattcttccttcattttgacatttcattataactgcaagaagtttagaattttcgtcaaggatttgttgaatactttcatttgatatttcttccatttgttttttttttcttttttttttttgcacaaatacgataggaatgttttgaatccgttttgatcgtgaatgtctcaaatttttgtagtttataaatcgaaaagtaaatatttactaaaatccttaattttttctaactttaaagtcttgaatcaatttcaaaattctttttgccttgtccacttccttaccaattttattcgttttttcattttccgaattctttaatttcaagttaacgttttcctcttcaatttctttttgctttaaacgttcttctgtacttttcacatcgatttcaatcaatttcaattgctgcactttttctttgtattcgcctttcaaaattgaattcttttctttttctttgttcaatttttcctcttcgctaattagctgcagccgtaaattgttgatttgctcgttgtttaatgaagtggctttaaaccttttattaaaggttatgggaagtgatggatctgcgggaggaatattggtttcgttcttttcattataaattggaactggaacttgaatctgtgatcgttgatttagagggctttgacgattgttaagtggattgtttcgattttgataaagaaatgctggtgcacctggaacaggtttaaaagaatttaatggtgatgctcgagttgatggtaatgtattgctgccatgttgacgcgtacgggaaaaatcgcttggtttgatataatttatttcgcctttaaagattttgttgatagtttgggataattgaattattggaattcgtgatgaaaaagtttgcttaaaatcattactttgatcaaaataagtttcgcaaatattaacaaatgttatgagagaaggagattctataaaaagattgatatctttgtcaagttgattccgatcaaaattttcaatcgaagtattgagttgtatatattgggtgacttctacacgaaataattgaacttgcttatcaagaagttcttttgctttaagtaactgatcttttgtgatattattgtaaattgatagcttgattatatcttgcttttggacaggattgtcgcatgctgcaacacgggtgcaggtatcttctgaaatcttggataaatcttgaaagatttctttggattctggaattttatcaaatcctatttcattgatataatttctcattgactctaataatgatattaattcaccgtgcttgtctggttgtttttcttgtaattttttgaaatattcttctacatcatcgctcatttcctgataaatggtactcgggaatgtaaacttattaaaaagtttaactggaactagtcaaaaattttattgcgcggtttttttattaatggattctgatccttactgacaaagcaaggctcattcttcttttactaaaaactcgaatttcttttgatccatttcttctataagtgatcagtgcataaaagatttagatattttaatatgaacacacctgaagaagaaaccaacgaagaatcatttaaataattaaaaattttttataaaatgtcaaatcttccataagttagatattttattctcttgagtttaactttttttttacgaattctttccatttattaatgttataaagtttcaaataatgaattctatttagagaatgaatataatgtaattttgttaatattttcatcttgtgtaattcatgatgtattatatttgttttaagcagagccatcgaaaccattgatatccatgcatttgtatgaacaatattgtaaaggaaaaaagtttttgattttattttttttttcatgagtataagacatattataaatgttttacaaatagaacattaatatctaaagcaaagacgaaataaatgatgaaaaacaattattcaaaatttctttaatagaaatggaaacacaaacattaaattttgctcaaagttattttaaattaattacgaaaatatttattgatacgcaaaagtaaaaacataaaaatcttctgcaaatgatttcattcagttggtactttatcatctgcgagaatcagcacaccattttccaagtcaatactaaatggcttatgttcatctgtttgtatagacaactctgggtatggaagtaatccttgttgtagtccaatgaattcgaatgatattctttgtgaaccatttggtcttaatacatcagttttaattacatgtgttccatatggcaataactttgtttcgcttttacattccgcgttaattaagaatgatctgtcttcattcgacgtattgtgaacatcaaatttgactgaaaaaggcgttagcaactttttcaattggggcggcccaataattgaaacagccaaagggagtttcacttggctttgtttgtttaggtcgaatgtgctgagttccaatgtgcaatttgactgaaatccagtgctccatttcacataaagatgttcgatctctttgaggtcattgttgttctcacccctttgaagctcaagaccataaacagctgaaacttgtgatgaaggaaggagaatttcggcaacttgaacttcagattcatcaactacatagttttctgttgggaatacctcaatagaaacattccgcataacatatttggtgttgttgcataaaattacttcgagaagaactccttctcgacgtacttttgttgttttgagatgatatgaaaaagatggagaaacatcaatcttgaaattgcctttaatattgtggcttttgctttcagttgtgcaagaaccagatatatcaaaatgaaatgatccatcagtatttgataaaaattggataggaacaaatagttgtgtaaaggatccatgttgttcaatatgaacaggagtattagtatcggtgcgtgtgagcttaacattgtttgaatcacgaggtttgatatccattgtaatttttgtaatgacagagtttgaatctttgcgtttgattctggcgagaaggaaagatgtaactcctgagtaaattgagtttggattaggaaatatctcccatgttgaaaaagtatttttaatttcattttgtgattcaaagttaaccaaatgacctggaaattgaaacgaacatgttggggctggtaatgaatataaatctaacgttaaatgcttgccaagaggaatactttggcagcgagacatttcaatttattttagggcaccccaaaaatttttttatttaattaaggaaaatgttttcagggtaagtcgaattcatatttaatgaaagagtaataaaacataaaactgtctcttattaaattcaattttttatttatgcacataacactttcgcaataatgatttaatcactttcagagaatttgatttttaaaatggagtactgccaaaattacatttcagagtttttggagagatacaaaggaaaaaaggaaaatcttatttaatgtttaggaagccatccagaagtcttccatctatggtcgttcgcaactctcacgtaagctgcctttgcctcttcgagagaatatggggatgtgttggagaaatcaattcgaggatcacttgataagatttctgaaaacaagttaattaacatactctcgatttcgtacactggtttccatgactccattgtcaaaaggtcattgcaaatactgcctccaacggtaactcttcctttatggaataagaatcttggtctgacaactctaacgaaaggaggtacttctggatagtttggcgggaaagaaacttcaaattcgatgtaatcacgtcctgtcttcttcttatacttttggatatcatcgtaaattggtgtcttcttctcaaagccaaaaagatggacagtccaaacaaagaggttgttttggattggttcagcagtgaaaccattgacttttggatctgatcttaaaatcatgttataatcttcgataagacgaattgcagcagaaccctttggattgaacctttccatgagggtttctctgatctcttcttccttagtctttaccttcggttcaggtgcagatgcaacaacttgtgaaatatcaatgtcatctgggagctcaaactcaacatcatcatcaccttcatcgatgacgcactcttgatcgaagtcttcttcataattttctgggaattgttcttcttctccaaaatcgtcagacattttaatgcactttttctctttttgaacataatgttccattgtaaaaataatgtattcaaaaattgagaagagagtttggcaaaaattcaaaccatcatcaacatttgaaattgtttcatatttccctaaaaatttatctcattttcatatggaagtaaaaatcaaaacgtcataactattttagtatggaattacattcgaaacaaaatttttactaaagaatgccaaagaaagtggccgtttaatttttgttaataaaaattttaaacgtacatatcaaaaatctttggttggatggataaaatccaccaaattgatcaattagtcaaaaaagcaattgataattcatttaacacagaagcatttttggaaatttcagataaaattcgaaggttacttgcgccaactaatccttatccaggcattttagaaaaaatcgaaattaaccttataaacaaaattatttgtatcctagaaaagttttcatccatagttttttgtgataaatataaatatattaatagtaattcacatacatttcgagctcttgatgcttgtttattagctcaattagggaaaattattatatactgcaaagtgcaaataccagaatttgatattaatgaagttattgaaaagttcgatacatgtttaagattttcatccaaaaattcagaaaaaagcaaatcaattacagaatcagaaatttttaacatgtgtgcgtatttatttaaatacaaaaaatatgaaaatgtatatagtattttaaaattaattgaaattactcaaagtaattacaaacaaagattgtatcaaaagattatttctcttattataaagtcactggttggtatgaaaaggtgtgatgacgatgaaatttttaaatggttaaatctgattcacccagaacaaatgacagattgcttattttcaataattgtcaattacccaccacagagagtagatatgatgattccttttttagaaagatgtattgataaaaaatcaataattccatattttgtattaaatggttattttgggtcatatcctgaatttaaaccttatgaaattttttttcctgctttaattccaccgaatatagtctgttttaatgaaaatatatttaatgaatatatgttatgttatcaattatttgaatcaagctcattttataaatgtgcaatgtattccattgaagttttaagtaaacttccaaagagtaaaatccctccatcaggtttaatgatgatatttttcttacattattggatttcatatagttttgacgcgtgcggcttttgtacacgtgccaaatattatatcttacaaatgcaaaaaatcttttcacattatccattttcattacaaattatatcatctttaagtttaaaaatccatcttaatcttaatgacatcgaaagtttcaaaccaataaatacaacaaataaatatttttataattattataattatgattggatatcaacacaatatttatatgaagcaataaaattatcttttgtcaatgataatttaaatgcgttaaaatattatgagaaaatattccaaagtaacaacgatataattaaaagaatatcatttcattattatataacacaaaaaagagttaacaatgaaaatgttaacattgaaacattcgaaagtttttgtaagcaatataaagatacatattcattatataattatcataaatcaatcgaacttcttaaatatgaagacttagataaaatttggagtttaacagaaacttcaacaactccaaatcaaatcatcttaaatcttttaaatgaagccgaaaaatatgcgcatggttattccatattattacgaaagattaaacaacttaaggcattaattatcgggcgttctaatcaaagtgaaactgcttggttaataacaacttcattatcgacaacatttgataattttttgaaaaaacaaaatcaaatacaattcaagccgaaatatccgatattatctatagcttattttaatatcataagtttaaatcgttgtttattaatatcattatattatccgaattcaaaacctttagtcattcgtttacttgttagttcaaatattgaagaaattctcgagaaaattgatatcgctgaaaagaatcttgaaatcccattaaacattgattccaaaaattggtgggaaacgcaaaagaaaaaagagaaaatatttattcaacaacttcaagaatttcaagacaaagttttaggtgtttggagtgggttattaatgccgtatgaatactccattaagataagtttgatacaatcgatttgtttatcatatttgcaaactatttcatgtaaaaagcaacaaaaaatgatacaaatgaaactcgaacaattaattcaattaccaataccaatgaacaatataaaatgtattaaaaaattaccattaatattaatattaggtaaacatattcataaaattccatgggaatcattaccaaatatacgtaacaatggaacaaatatatcacgaattccttcaattaaattattatttttagatcaaaaaatccaaactattaataagaaatcaggttattatgtaattgatccatgtaatgatactaattttaataaagaaactttggaaatatttaagcgaaatttatgggacggaatatttagaaatattccgtctcatgattcattaattaaacaattacaaaataaagatatttatacgtattgcggtcatggaagtggtgcacagttttgcgattatgaaaaattaattaattaccaaattcattcatcaatgtttttgatgggttgtagaagtaatagattagaagataatggtgagtgtgaaccttatggtactccttattattgtattgccgcgggttctaaatcaattgtcggaaatttgtggaacgttttatgcgtagatactgaccgagtgttggtcggaatctttaaacagttcgcaaatcaaaaacataaggatttggacgaggctatagaaaaaggaagaaattgttgcaacaacattatgatgcgaaaagaaaattgattaaaaatatataagaaaattttacatgattttagtaaaaatataaacctttaacaaaaaagtccattttatttgtagcttatcaattaacaataacagttaccttcaaacttgattcttatgatccattttaaattttggatttatttctggattcatcaaaggttttgagtatagtgtactcacactattttcttgaaaaatatgatacttctggaaaacattaatttagaataatattatttattctactcgtttattattcttttaaagtgaagagaatcgaatatttaacatgatggaattttgtcagatagtaagagataaaaaaatctagatgaatcatataaaatttattttccattttgaatgttcctgttaataacaattccaacaataagaacaattatgaacatttaaaaaaaattcatttaaaagatatttacattcgatttatatatttacaataagattgtcttctttaaaatctgaagcaaatggatcttcttcaacatgagatacttttatacctgcactgaaattgttattaatttcttgttcattttgtgaatatttttcatcttcatattcaaaactattaagtttatttatatatttatattttcgaataagaaaaataacaagaaatattaaaattaaaattataacaattccaacacaaacaccaataatgatataattattattgttatgattatctgtattttcattttgttttattatcgtataaaaatcggaataaaattgataataagaagaatatgcaaaaattacatattcataataaataatcgtattaacatatatacgttcagaattaaacattgatattataatagtattcgttgatttagttattattaaatatgtttctgtatttgataatgaaaatgtttgaacataagaatgtgataaaattaaaccttcttgtgttaattctgtgaatgcattactttgagaatatgtatttgattgtgtgaatatattagaatatgtatttgacttagtaaatgtattagaatatgtatttgacttagtaaatgtattagaatatgtatttgattgtgtgaatgttgctgtcgggagtgggttacatccttcaattgtcgtttcgctaatattaagataaccaaatgttttatttacatataatgatgttacaataactgtatctgcttgaatgctttcaaatgcattcgttccaatatttggtgatatctctccacaataatatatacatttgagtttaatgcaattatgaaatgcagagtcaccaattgtttgaacattcccttcaatataaatcgtgattaaatttatacatcgttcaaatgcattgtcacaaatccttgtaactgtttcaggaattgtaatatttattaatttctcacatttataaaatgtagaatatccaatttctggaatatttccataaatttcaacaatttctaaattaatacattctgaaaatgcataattcccaagtgatgtaactgttgttggaatcgtgatgtttttcaaatttgaacattgagaaaatgctcttgaaccaattgtttttaatttgtttccaataataactgtttctaaattattacaattttgaaatgcactatcattaattgtttcaatattatctccaagattaatagtgattaaacttgtacatgaagaaaatgaatattgaccaactgatgtaatcgagtttggaagtattatacttatcatgtttttacaattataaaatgtatgatctccaatttctggaatatttccataaatttcaacaatttctaaattagtacatgaataaaatgcataattcccaagtgatgtaactgatgttggaattgtgatgtttttcaaatttgtacattgataaaatgcttttgaaccaattgtttcaatcgtatcactaagttcaatcgtaagaagtgttccccatgaaaagaatccttccgatggaattgttgaaattcctttcataataataactttttcggtaatatttttataattttcaatatactcaaattcagtttcaacatttatcgtaagtgttttcgtatttttgtcatatgattctgaaaatgtttgaataaaataaagagatattaagaatggaaatatgtttttcgtgatatttattcgaattttatgtttgttattattcttattattctttttattaaaataaattattatgtaatgaagaagaaaaatataattaattataattatatttaaaaaaataaaattatatgtataattataattaaataaacatttaaaattattttatgatgttttaactttccgatgaaagaattgaattttttaatttgtgttattttattgttcaaataaccaaatgattttgtttcatttaatgattgaaatgtttgaaatgatttaattttaattgaaattttatgttttatgaaaatgttaaaaataattgggaaatgtctgcttatcatatcaattttatcatattctttagtaaaagtaacaaaagacataaaaatttgttttaatttatcattttcatcatgtaaaaataatttatttgagacacattcaaaataattagtcgtcattgagatagttaaatcgattaagatgagaaaaaacatgagaaagaaaggctttctgaaacctccaaatttggaggtttgaattcaaattcacaaattttgttacaaattttttatttgtaaacattagaaaaaagtgcttttatccaacacatcttattctatgattaaataattgtacatacttttttattacttaaatgacgaaacagcaaactgcttcttcatattcgcatttggtttgataattattgaaccacaaaacaaagaaaatttgaaacaattttattgatttttgactttgttgaaggcttttcctaatttaatatatctactatgctttcatatatatatatgcctttggatgtcaaaagcttttttacacgtgattttcttatgagatttgtaaaagtataaatatttagaaacattattatataggaaaatatctttgtctaaactttgattttgctcatatgtttttgaaaaaggaggatggttaagttcattagtgtctatactttgagcttctgtcaaatcaactggcggaaaatcgatcgtaggctcatattcaacatcatctaaaatatattctttatcaatgacatattcatatcctttatattctttgtttggtggtgcgtgttttatatgatctatgggttctattatattttgtcctttacatttggactcaagaccttgagcacattctgtttcagaatgcttcattaaatttgactcatcgcaatatctaagtgattttttaaaaaaatgcaaaagtttgaaacataaaatatttggagcataatttttattataaatattaatattttatcaaatatgttactaaaaaatgttgtaaataattttcatagttaaaaattcaaatacattttattttaacataaataatttacatttttttccttaaaaatcagaataattaaaattatattcaaattcaaacattaaatacatcaacgcatgcgttaatgctaaataattatttaaatgataatttttaaataaatcaaagttcagatatattaacaattttttttgatatatttaaagaattctttcattatttgattagaatttgactgtctgcaaataattatttaaataatttcattaactgaagtaattattttaaaaatattataaaatcattttttactaatgaattggtaattaatgtgataattgatatgtataataaaaacatttaatgaaggtaaaaaataatattttaaagtgattgatgagcagtgtaacatttgaagataaataatgaaattatttatcaaagtaattcgcatttattatatttattgatttcatagccattgatctgtttcttcaagaatgttttctttgcatgttttgtcaatttcgttcgtgttcacttctctgcttccttcaagttctttattcgattctttgtttattcttgtcttcgttttatgtgtaaataaaaagataataattccaacaataagaaggaagatgaatacggctgtgcatgtgactgatataataatcgttttggatatacttcccgatgtaatttcttcttgtgtttctgaataaattataaaattagaataataactgacgtacgtcaatatttgatatatcgtaaatatataactgatgaatttcgttggcgtataataaatacttgatgagaaatatgaaacagtaaatgtattaataattgatacatcaataatactcaatgattgtgaaagtgataatgtgaaaattattgaaaaagaataacttgaatcattatttataaatgtattcaactgtgaatatgtatttgattgtgaaaatgtattagaaaatgtatttgacttagtaaatgtattagaatatgtatttgacttagtaaatgtattagaatatgtatttgattgtgtgaatgttgctgtcgggagtgggttacatccttcaattgtcgtttcgctaatattaagataaccaaatgttttatttacatataatgatgttacaataactgtatctgcttgaatgctttcaaatgcattcgttccaatatttggtgatatctctccacaataatatatacatttgagtttaatgcaattatgaaatgcagagtcaccaattgtttgaacattcccttcaatataaatcgtgattaaatttatacatcgttcaaatgcattgtcacaaatccttgtaactgtttcaggaattgtaatatttattaatttctcacatttataaaatgtagaatatccaatttctggaatatttccataaatttcaacaatttctaaattaatacattctgaaaatgcataattcccaagtgatgtaactgttgttggaatcgtgatgtttttcaaatatgaacattgagaaaatgctcttgaaccaattgtttttaatttgtttccaataataactgtttctaaattattacaaacttgaaatgcattatccttaattgtttcaatattatctccaagattaatagtgtttaaacttgtacatgaataaaatgaagaagaaccaactgatgtaatcgaatttggaagtattatacttatcatgtttttacaattataaaatgtatgatctccaatttctgtaatatttccataaatttcaacaatttctaaattagtacattctgaaaatgcttcattcccaagtgatgtagttgttgttggaatcgtgatgtttttcaaatatgaacattgagaaaatgcaaattcttcaattgtttctaatttgtttccaataataactgtttctaaattattacaattttgaaatgcactatcattaattgtttcaatattatctccaagattaatagtgattaaacttgtacatgaagaaaatgaatattgaccaactgatgtaatcgagtttggaagtattatacttatcatggctttacaattataaaatgtatattctccaatctctggaatatttccataaatttcaacaatttctaaattaatacattctgaaaatgcataattcccaagtgatgtaactgatgttggaatcgtgatgtttttcaaatttgtacattgataaaatgcttttgaaccaattgtttcaatcgtatcactaagttcaatcgtaagaagtgttccccatgaaaagaatccttccgatggaattgttgaaattcctttcataataataactttttcggtaatatttttataattttcaatatactcaaattcagtttcaacatttatcgtaagtgttttcgtatttttgtcatatgattctgaaaatgtttgaataaaataaagagatattaagaatggaaatatgttttgcgtgatatttattcgaattttatgtttgttattatttttatttttctttttatatatataaaatattatgaaatgaagaagaaaaatataattaattataattatatttaataaattaaaattatatgtataattataattaaataaacatttaaaattattgataattttatgatgttttaactttccgatgaaagaattgaattttttaatttgtgttattttattgttcaaataaccaaatgattttgtttcatttaatgattgaaatgtttgaaatgatttaattttaattgaaattttatgttttatgaaaatgttaaaaataattgggaaatatctgcttatcatatcaattttatcatattctttagtaaaagtaacaaaagacataaaaatttgttttaatttatcattttcatcatgtaaaaataatttatttgagacacattcaaaataattagtcgtcattgagatagttaaatcgattaagatgagaaaaaacatgagaaagaaatagctttttgctgatatatttgtaaaaggtttggaagaaaactggtgttaaacgatcaatacaactttttgataacgttacttttgtgttgctaacaaaaaacaactgaaatttgttggtcatgcaaattctccgagcgtttctcctattcaatttccgagtaaatcattcaaaaagcaatagctgagcaaatttttgtatgtatggaacagttgaagtttgtttggacacattcaaatcatttgtgcaataaacatggttgaggatgggcttttcagataaataaacggtcgaaaattatacgttaagacaacaatttaatcgcaaagctttcccctgatagaaaaaattatttcattaaacaaagctcttgctttatctaatctatctttctatatcctttgtatgttgtgattatgctttgttaataatttttatttttatttatgtttttttttgaattcagccaaatcccatttacagtaaaatttcattatattaaaatataatgaataaaaaaatttaaggaataaaaaaaatgaatgcaaaagcttgtactgtcactgcattttaggttggaccccttttcaggggaatttccatccaaaattcaatcaaaccgttccaactaaagcaaagtgactgtaaaacgagaggtgctgcctttaattaaggaaaataatataggggttgcagaagaaggcattcagtatttcctgccgatttctcgtaaattgtacataaggtacttaccatcctggaataaattccagaattttgcaccgcccaaaaaaaactcattttatgacgacggtttggcctctcaaaatgttattttacaaccggatatcaactgtttcattaaatttaaacatcaaaagtttgcagttcttcatcgaaaaatctaataagcaaaaaacaaaagtatttttatgcatttactttgtttctttccttggaaaaaagaagtatgatcaataaaaaatttcaagatgaatgaaaaatttaggaaagaaaagcatattcaaatatgaattttatctttcaatcaagctgaaacttaaaataactaatttgttatcatctatattttccttgccaagttcataacacgactaaggcgaccgttaatttaaaattgcttccaatggaatctgaggtattccctcgtgattattccagtgctgaatattgggaatcgaggtacaaagaagaatcaggaacatttgattggtattttgggtggaatgatgtttttcaaaaaaatctgttttcattaaacatcaaagggccaattcttgtagttggttgtggcaattctttgatatcatataaccttgaaaaatttggcatctatcctgttatttcaacagacatctctcatacatgcgttcaaaaaatgcaaaaagaatttaatggatgttatttgcctatggatgtatgtgatcttcagttcaaggataatttgtttccatgtgtaattgacaaaggaacattagatgccatcttatgtacacatgattttgagttgcctatgtcgaaaatgatgcttgagatctctcgtgtattagctcctaatggagtttttattgagataacatttggtaaaacagctgaaaagttaaacattttagattctcctgatttattgaattggacactagaaaaaaagattgatattgttagtggaaagggcactgcaaatatgtttgttttcaggaaatttaaagaagttgtaatagttgatgataatggaaatgaatatttttcaaaagattggaatgttaaaatgtgaaccataaagcaatgcaatattatgtaaacaattatattatatttatttactcaattttttaataataaaaaattagacataaaatacggaccgtttaatttttgtcacttttctattctttaacggttttgtcaaaacaaaaatgagctctaaacacaaatcaaagaagcacgagcatgataaggataaggaaaaggataaagaaaaggacagaaaaaagggagaaggcgaaagtagacgccatcatgaacatggacgtgatcgtgaaagagatcgcgatggtgaaaaacgtgaacattccaagagagatcgcgatggtaaagaacgagttaaaaaagaaaagaagattgatcgttcggtaatacctccatgggcaagagaaccaatcaatcctgcagatgatcgtttttacgaagattttgaacatgaaatcactcttccagaagagcttctatctattgatccaacgcatccaatgatgggcggaaaataaatttcatcttaattttgaattaaagttaatttccatttttttttaagcatttttgttatacgatttttaatcaatttgaaatagacaatttaaaaattttatgtaaaatttttcattgtttttaactattttaattacaataaaattttatttattctttttcttttcaagaatttctttcttttttctatttatttccgctaaactcactacaatgcccacacttacttcccgcatctgttttgcttttctttcatcgcatccgccgattaacttttttactatttcttgtgccattagaaccaacgaattctttgagaacgaaactctttcttcaagttcccaaacttcttgttgtttcttagcgatttgtccgatgagatctttcgactctaaaaacatttgtgcagagtctttacgaggcgcagtcttcgaggaatgcacaacaatgcctcgtcgcttgttgatctcgttttggagcgcccaaattttttgatgcacttttttctcaattactcgtttcgatgattccgaatcttcaagcttacgatcatactcagcaattttggattgaagctcttcaattcttttcaggtgtatagtttttttttcttcaatttcttgttcaagagatgagatcttacgtaaaactgttttaagatcatctgtacttggactattttgttgagaagcagtggcaacttttatggcttcgcgaagttgattggtctctgattctaatttttgcattatttcgcgtgattcatcaacactcgcaagttctgtcttttgttggatacgtagattagataactgttgttgaagttgctctccagttcttcccaaagatttagtttttttgccaagttcattgacttgtgtatctagaaatgcacgtctaacaatttgttgtttaacatcatctataagctgggcaacttccgttgcgatagggtgaagttcagttggaattgtatttatatcaggcattgtatttgattcatataaattatgtgcttgcaaaaattttgatatttttacaaactttaattgttctgtgagttgttctctttctttcattgattgacttattttgacacgaatttgaagattttcattccgaaaattttcggcaacttgttgagggcttaagttacttctcttctttgctgcttctatctgttcaagtagattgtaattttttgtttttaattctaaaagttgagcttgaagtgtctggaaatcttctattgttacagacatgttttaagagaatcctatcgttttgaggtacaccccgttatttacaaaagtgacggtatagaaatgaagaagaaattttgcattataatcgatatcgacatctagtaattcagttagaattaaaagggagatttatgtttctaagatgttaatgaatgcggatcaaatataccattgttttgctattttgcagaaacagtttttgttctaatcagttcctatagaaaaatttcagaaaaaaaccaaattttcaatgaacctcaaactttgtttggtttacgttttttaatgcgccgaaacttctttcgattgttccgcaggttcacggatgaatcttcagatgcaattgacgaattcggggcgatggtatctatgaatcctgttgatgtgcaacaatgtttttcattttatcagcaaaatttttctaatcttgatccaaatcaaaggtttcccattaaattagaaaatgcaatgctcactttattaaactcgtttattccatatacagttacacgacttgaagaaaaagcgcaaattacggatgaattaaaatttatttcaacaaccttaaaatttggggaatatgacaaaaaattctccaatctcattagtcaattttgtgttcagcttcttaaagttaactttcatgatgaaaattgcctcaattttatgcaaacagcattaaaaaatgacagcgttttaacgacatttgtttcacccatttatttatcagatatatttatttattgttttgatgtcaaagacaattattattcagatttaatacttgatacaattcaatcatttcaattcaaagtcacatccaaagaaaatttagaagcatttattgacgcctttcgtaggggatctgttttaaacgtatattctgctttaaaattcatcttttgtgtcactcgatcctttcatcctaattatttcattaatgagttctttccaataatatccaacaaaatctatgatcttgaatcgttagacttttttgaatattatctccaaactaacaacaaagctacatgggacttcttatgtcgctcatgttcaccatcaaaacttaacgaaaactttttaaattcaatgatttcacttttgaaccaattcaaagagaatccgttaattctcaatttccctatcggcgattttatcacaaacggaatcaacttaacgttctccacacaagaagagttattagaaataattctaaaatttactgataagaaacgactacaatttttgaagcaatgtattacaagtcaatttcattccaaaatcatttatgaaatttctaaaagtttaaatgattatgatacaattgcacagttttgtatatttgatattccaataaatgaattaaaacaaaaattagaaactgacaaagattattgtaatttattatattatatttccacgaatttaaaatcagaaaaagttataaacttaattccaatattactcaaactttcagacttaaacatctgtaaaaagtcattaaagaaaatattaaagcaaataaatccggagaaatatatcaaaatcatcaagaaatcatttaaacaaagtattattacaacagatgtctttcaaatcttaaccaaaatatcgaaagaaaatgaaaaatttgtttcattaatattaacttcctcgaaaaccataaaatatttatttagttcattccaaaacattaacgatttaacatttctaatcactataattcaaaatggaccatatgaaatcattgatgaatatattaatgaacattttaatgaaacgattttaaccaaattaaatgagaaacaattatataacttaatgatggggttaccatttgattctgaatcgattggaatattacgaattccatcattattaaaacatgtgaaaattaatgaattgttaacaccattcgatcgatatgtttatggtaaatatggaatgaaatacatcgaaaatgataatggaattgatgaatatttaatacaatacattgacgaaaacaaaaaatttgttgatatcgtaaataacacaaaattaatgttaaaaatgactgatttgaatcaatcgtttttgccaatatatcaatgccattttaatatgccgaattctttcgcaagtttcgaaggtaatgtttcgatttcgttttggttttatattaatcatttgatcggaaaaactttaatacttcaaacttctttcggtgagatatcatatgattgtgatggattaacaatattcgatttaataacaatacaatgtaatatgaaaacttggaatatgttaacattaattatggcaaatcaaaatgtgaagtgttacttgaactcaaaaagtgcaattgaattttcaataccgaaattgaattactcaatgcaattcggaagtaaaacattcaataattcaatatggtacttaaactcggaggttatctcaacaaatgaaatgtttacaccagacgaaatcagaaatttgtatttgaaaggtttacctaacgtccggaacgataaatataaaattgcaaaaattaatccgaaaaatggatttaaatttgtggattataatggaattggtaattatttatatgatgaagagtttatctttttgttgttaattggttgtcaaacgaaagaagaatttaatgatttatttgaaagttgttttaatttatatttaaagtcattaattaaaacggaatatttctattcatcaattcgatatataatgatacgaaaaaaagattttgtaacaactgatttaatcttaaaattatttattaataactttaattgtaatgattatattaatgtcttcagtgactatcaaattattacatcgattaacttcaattattcgtttttcttaaagttatttaagttaaataataactcgttaacatttttaatggatgttttaattgattgttatatcttctttgatattaataatgacttaaaacaaataattttagatataacaaaattaatgattaaaaatcatccaagtatattagaaaaattaattttatatttatctaatttcgaagataataatttatttgaaattatattaaaaaatttaaaacttttggatttcgaccgtttactatcgttctcggccgttttaactgaaaagtattcaattgcatttatcaaaaagttgacgaagaattcaatcagattgaataactacaattacaaaagtttaaaattaaataaatcgatttttattaaattaatacatgaaattgatatttggtgttgtttattatcatttttaactaatagttatgaaatgaatttagataatttcatcacacaaacatcaaaaaataataagattctaaaactcattttagatgttttagcgacgtttatcggaattgaaataaaagaaaaggcaaaagaaatgttatcatttaaaatattggaaattattttctcgattacttcatcagataaaattcttttgtgtacaaaacaaattttacgactttccgttttaggtcttgataattatccttatcaagtaataccttttaatgataatgataaaatagaacaacaaattaagtcgcagaaagaagaatataaatttaatttatcattacttcaatccttacaactcaaaaatttcgattttattaatgaatttaaagaaaataatgatgttaaagaagatgacaataatgaagaattggatattcctgatgaaatatttgaatcgaaatcaatttcattaattactaattttaatgtgaaaatattcgtctccgaattagtcgaatcattgttcatcaaaaaattgttttatgtttttacgatttttggcgcaaatgtaccatttaaagtttcattaaaaatgcacaagaaaataattttggcatttttcgacctgaaaccgaatttgacagaagatgtaatgaactctttgtttgagttcttgattttaaggattaatgaaggttggtgggaatctaaaaaagaattaaaggaattgctgctaaagtcagtgaatttgatgacgataacaaaatcaaaagtgtcaaagttattcatatttataattctgacaaaaattgactcacaaaaagttttcatttcaatgttttctcaaaaaattttcttgaattttttagcgaatgataaaacattctttttaaatatacaatatttcatttgtaaattaaataaaataaaaaaacaattaaaagatttaatggttcaaaaattaatttgtttcaaaatagaatttgtaaaccatttaaaaagtgatacattaaatcaatggtttacaaataacgatgaattgaaaaacgcatttgaagaatataatcaaaatattaaaaaattatgtatgaattcattacaattattacatcaaaaacgaatagaagttacaaaatatccaaaagtatcagcaattaatgaaaatgataaaattataattttaaatgcattaaaacaaaaacttttttatcgattaaatttaacaaattgggaaatagaaaagtctatttctaggttatttaaacttaaagcgcaatataattatatgttaaatccatcagaaaaatttatggttgtctcttctccgaaccctttatcagtgccacagaaattacttccgttggtatataacttcaattatcccgaaggcaaatttattggtaaaattcatactccgaaatcattacattcatataaatttaacacaaaattaaacgagctaaacgaagaaaagtcagctgcgctttgtttaaatggttggttcttacctccgtatgtatcaaattgtttgaaggaagtaatcaacgcgcaaattgaaaacgttacattgaataactgctattatttgccaacaaccgaaattttggagtccgtttatttcatgagcagcgacactttttacgtgttgttaaacgcgacggttgacgataacgaacgtttaattttgaatgaaaacgattcaacaatgatttgtcaatttgcagctttcgaattaccgatttatggatattatggaaattctacattattttgtcatcatccattgttatatttcaaatattctgatataatattaataattcctcggagatatgcatataaaaacgtttcaattgacatatatttaaataacggaattagccatacgatcattttcaagtcaaaaagtgatagaaggaactttgtttcaaaagtgaaaattaaggagtttacaatccctcaaaacttcggaatttcttatgctcagaaattattgtattcgtccattgaaaaagtttcgaagaaatggtccaaccgtcaaatctcaacgtttaattatttattatatttaaatgtcgtaagtggtcgatcattccgtgatctttcacaatacccaatcttcccatgggtcctgggtgactttgattcagatacgccaaagtcatcacgaaatttatcaaagccaatgggtgcacaaactgaagatcgagccaaacgttttattgacaatttcaatgagatgaactatcattatggtacccattattcccactcagcagcggttttacattacatgctccgcatcgaacctttttctctttacgaagttcacctccataacggtctcgaccaccgcgaccgtttattctgcaacatttcagaaagttggaaaagtgccagcgatttcaatcagtcagatgtcaaggaacttattccgcagttttattgtttcccaaatatgtttgaatataataacgtggttgatttgaaatgccgtacagatgggttaccattaaatactgtcattttaccaaaatgggcaaaacaatcagcagtcaaattcatatatgaaatgcggaaagcacttgagcaatcaaatgaaatacatctatggattaacttgatattcggatatcaacaaagtgggaaagaagcgattgagtcattaaatgtgtttcagccattatcatattacgaaaagttcaaaagtacggaatatgatgaaagcgaaatgaaagctgttattgacactgttaataattttggtcaatgtccgatgcaattatttaatgttcaacatattccacgacaattaattgaagtcatagatattcataattgtgaattaaatatcacaaaactaattactctaaatccgatcccaaattatattagaattaatggcgatgagataatttgctccaatttcgatttgttcgaatattcgacggattatttatacgccgctaaattaattaaccgcaaattcatttcaatcgattcaattagcggtggtttcattcaaaaaataccggttttcactttcggtaaacttcacaaattggcgttctcaagtcagcactttttggtatgcgcttcttcatttaagaagcttcttttgttcgatgcatcaaccggttatttcatcaggagcaaagaacttcctgatacaattaaacagattcagtttgatgaggtttataatatcatatttgttataactgaaaatcaaatcttcgcatttcgccttgaccttaaagaaatagcatcagcaacttacgagatacctttcaattgtatctctgcaactagttcgtcacaatggtatcgatatccatttgttatcgcgggacataatgacggtagttgctatatatggcgcataagcttcatgtctgacgtccctacttttgaaagcttgttcgttttcaaggttcaagattcttcaatatcaattatcaaaagtttcgactccgataaggctatactcgcaatgtgcgctaatggacagttattcctcgcttcagctgcaatggtaagacataagttacttcgttcaaaatatttttgcgaatgtccatgttgtggtacgaaatcgccagcaagtctcttttgctgttctgtgtgtggtctgtactgttgcaagagctgtaggataagtagaatgccaaatatatgctcgagatgcgcaaaattccaaggcgatcttattgaagagtcaagtgattcatcaaataggaaaataagaagagaaagcgtatactcagatagcattggcaatgaagtgtaagtaaatatataaaatcatgaaatagttttagtgctcactcaatttgtttgtgatatttcttgaagtttttctgtttcatcattccgaattatatttgcaattggatttggattatgtccttctttaatatgttttttatgaagttcaaaatcattttttgaaagttcttcataattttcttttatttgaagtttaaacatacagattttttaagtgattgggtttattaaaaaaacaagatgtacaaaatataaaatatatattttatgatttaatgaaatcaaattcatttcaagcattttttcaaaaataaaatttgattcttgtgagtctatattaagaaaaaaatttctaaatgttttaatcaattcaaaattttttcatttaattcattttgcttattttctatcttttgaataaaattaaaatatatatttaaatctttcatttgtgaaagaattgataaatatattattctactaagaatcacctttgaataaaatataatatcattattatctgttaaatttatgtttttactaatacaatctcgaatgttattttcactcaaatcaaaaataatttcttcatgtgatttcaaaacttgcaatgataaaatgatcgattatttatttatccatttatttttgctagtgtttgtcctcattaaactgatattaaatttacataaaatatataatataatttattcattgtattacattttattcatttaatcgacttcttccacgcgtggtcctgatgaatgtccactatttgctgatgctccacttcctccctgcatgttcgcgcctggcattccgccttgtgcgccgcctgccgcatgttgataagctgcttgcataattggcatcagtttgccttcgagttccttctgtttcgcttcgattgtagcgacgtctgcgtcttggttagactccatccatgcgagcgtgtcattgatttccttgttgattgtatccttatctgattgtgacaatgcgttagcgaactgctcttgatttaatgagttgcgtacgccgaagcagtatccttcgagtgcgttcttcgcttccactttcttacgtatttcttcatcttgtgctttgtacttctctgcgtctgcaaccattttgtcgatatctgcttgtgaaagacgtcctttctcattcttaatcgtgatcttcttcacgttacctgtcgacttatcttgtgccgaaacgttcataataccatccgcgttaacatcgaatgtaacttcaatctgtggtacgccgcgtggtgctggcggaatgcctgttaaatcgaatgtaccgagtaagttgttgtcgcatgttcgcgaacgttctccttcataaactttgattgtaactgcgggctgattatctgagaatgttgtgaagacatttgacttcttcgctggaattgttgtgttacgtggaatgagcactgtcatcattccgccagctgtttcgatacccaatgaaagtggtgcaacatctaacaacaaaatatctttcactgtgtctgatgtatcacctttgataattgctgcttggactgctgcaccgtatgcaactgcttcatcaggatcaacaccacggcatggctgcttgccattaaagaagtcttgtagcaattgctgaacacgtggaatacgtgacgaacctccaactaaaactatatcagtgacatctgacttcgacatgtttgcatcccttaaaacttgtgcgacagggttcattgttgacctgaaaagttcatcatttaagttctcgaacattgcacgtgagatgttatccataaagtcgtggccttcatataatgaatcacaaacaattgatgcggatgtggctgtggataatgttcgcttagctcgttcgcatgctgttcgtaatgtacgtaatgcacgtggcgattgccttaagtcacatttgaacttcttttggaatcgatctgcaaagtaattaaccatacgattatcaaagtcttcaccgccaagatgtgtatcgcctgctgtggcacgcacttcgaacatgccgccatcgatatcaagtaatgaaacatcaaatgtaccgccgccaagatcaaatattaaaacatgacgctctttatcggatttctcgttaagaccaaatgcaattgcggcggctgttggctcattgataatacgtaatacatttaatcctgcaataacacctgcatcttttgtggcttgacgttgaccatcgttgaaatatgctggaactgtaatgactgcatctttgactttgtctgtaagttgactttctgcaatttctttcattttacctaaaaccatagctgagatttcttctggataaaattgttttgtttcacctttccattggacttgaattctcggacgatctgcttcgccacgtacaactttaaatggccaatgttgcatatctttttgaacaactggatcactaaatttacgtccaatcatacgcttggcatcaaatactgtgtttgttggattcatggctgcttggttctttgcagcatcaccaacaagtctttcgtcttctgtaaatgcaacataagatggtgttgtacgattacccatatcatttgctataatatcaacacgattgtgtctgaaaacaccaacgcaactgtatgttgtacctaaatcaatacctatagctgacataataaaaaaatgatcttatgaaggcattttttatttgagcatttattgattcaaattatgtattcgaccatttaaagtattcaaaaaattagaaggacgtttaacacggactgccccaagaagtaatcaatcttgtaataaaactttcatgattatgttttaatttggattatattttatgtgaaattaactatattataatgaatttataaaaataacttacttttaaaaaaatcattttcatacttaaacaaaaattacttgaatacatgcaatggcaataacaagcaggcttgaataccaatttgaagcatcccaataaacgttcacaatgataacaaattcaataaaatataatacttgaaaattgtatgaaaacgtttggtaataacggtcgaatgactatttaaaattttgaattatttttaatcgttcgagctttcttctggtttatgaattcctatttcccacccaacaatgatttacacaaagtttttctagaacggcctaattccttcgactttagagggaaaaaggaaagaatagaaaagcaccagcattatcaaaatgattattatttttcagaaataagtcaaaaagatattaacctagcccttgaagcaataaaaaatagttctaatgcaatagaaataatgcctgctccgaaacaagagttaaatccagatcaatattgggattaaatgttttttccaaaagcattcgtattgtactaaccctactattttcatgtatgcaaacatcagcgatgattaagtttcattatttatcactttttattttgtatgagtaaatgtattatttttaattttttaaaaaacaagtttcatatgtttctaagttaatgtataattgatatgcttagaatagaagtgatgatttagaagatctgagcttaataaattttacacaaagatgtaatttcatcaactgtgttgttaataaaatgacaatactttcaaaattatctcattattgaaatatagcttgtttctatatgctaaattaaaataatttaactaagactataataatttaatgaaaatttaaaagcaattttttattttttcttgttggtaaaagggaatcttttttaatgaaataattacataaacttaattttgattgaagtcatcatcaaatggatcatcttgagccatattgtaaagaggattatgatgttcaatttgtacttgattttctggtacaaactcacttaccatttcagcttgtggatgtgacttagaaaatatgattagcaatgtgattaatgtaattactaatgcaataacagcagcagcaatgagtgaatatatcattattgattttttggttgactttcccttatcttttacttgccaattctcagaaataaatgattttggacttttcttatcattagaagtagaattttttgtaggaagagaatgaggaattggtgaattacttatatttaatgatctaggtattcgtgtattatttgaagtagatatggtggaaatattctcttcattcaatgtaatatacatagacttggtattaattaagttttgagcttgaatatataaagatgaaatctcaccaacattctcggcaccgtctattgcagcaacatgtacatatactcctgtttgaatttgatcatctgaaagtgggataacaggtccagttacacaatttattaaatcatcaaatgatggttttgcattatttgaaattgcatatttatatttttgcacccctgtaattgcatgaacatcgacagcatttgattgtgcaataaatatatcatttgcttcaaaataagcttcaaccatatacttatagtttgatcccaaatcagtggatttaatttttacaaattttgtccctagatcaaaatttagggaattaatgataggtgatgcgagatctcgtgatgaatgttcgattagattattatcagttgtcctttgttttaaataataaattgtgtttgcaattatttttctttcgtcttcagttgagttacaattgctatgcccggtttgaatcattgcagtgttattttttgttgtaagataaaatcctaatatatcccctatttcgttataatagattctatcattaaatgtaaaccagacatcacctgaagctgcttgatctgtagagtgagtaaaaggaatacttaatctatccccgatatcgccaatttcatatggataatctgttaataatcctttcttttgtattgaaatgttcttaccttcatcatgaaaataccttaatataatctttttaccagtttttggatcaatataataatcatcagcttgtagtattttgattccgaataaatctctgattgccactaaactttcagctttttttttatagaaatcatcagaaattatatcatgtccaactaacactccatatccttttttaatatattgactaataattcctttggctgtttctgtcttaatggaatatattccattggcatcccatgttccaaaaaccactacatcatatttataaataaaatttggatctttttccacattatcttcaaaatcattaatagaaataggttcaacaaatattaattgttttccggtttcatggtcaattccataaggatcaaattccattaattcatcgcctttttttactgtaccaccttccatccaaacttttaatgctgctgacataggtaaattatatggttttgcattattaccgaaagtaaatgtagcattgtaagttagataacctagcacatctccagagttagattttactcctttatatgaattttcaaagcttggatatacatttaatacatttacagggtttccatgttgatatgtgcttatttgtttccattctgaccatttaccatttgaattctgactcttttggaatagcttataatacactttatgttttgatagatctgtccaagtaagatgtgccagtcctttaccatatgtttgtgtgggttcaaatattgcgtttaatttaatattaatagatgatgttaaaacaataagaatcccaagcatattttaaaaaaattgcaaaaataaattaaagtaatgtttttttaaatatgttcataaaaattcttataagaattaattaagttaaaattgaataataaatcttatataatttccgacaacctagaaaaaacgaatagaaaaaaaagcttttttagtttagtatgtttatataattttatattgataacattaaaatattttgagtcaatgaaaagtgttttttctcaatttttgatatataatttgtttctctaaacaattctaagatttagtttaatatatttataaacatgttacctctatatacagattacaataaaacaaattttattttatattttaatgttggagttttattgcaaaaatcaagctatgctttgttcaacttaaaacaaagactataagaaatatcacaatacttcattttacagttcatgtatagcagaattcccaaaattgaagtatcaattcatggttggagattgataagaaagtgtgtcgacaaaacaaaaaaatcgtaatatatatattgctttctttaaaaccaaaggtaaaaagatataataaaacaaatgagaattttatcatcataaattgataatcacttcttcaacatatgaagtttactcacaataatgatcataaaagaaaattctttgtgaggaagcatatataaattctttatgaggaacaatatttaaaaaatatttgtatagttcacattcctccaataaataaaattttcatataaaatatttattaacttatttcaacagaagaagtttattcatcttcaatgttgttattgttgtatttctttttatgacgtataaccaaaacaacaacaacaactgacgcacagatgcacactgcatttgcagccttgttgtttaagcttttagctgagccatgtccattgaatttacacttttaatatttggctaaactctttcatgtactcctttcacgagcagctcgtgtccgcataagtttaactcttgagcgcatctttcgcattttgctttagtttaatgattgagtcaattgattctttgtgatttgcattgttaattctttttccatagttctttttattttattcactaaggtatgtcaatgatttaaaatgttgtcattacttcttatttgatgtatctttaagttcttcatctttagctttggcttcttctataattgaaccataatacttagtaaatacattttcttctgaataaaaatatctttaattggttcttgttcagtaattacgatatttattataaacctaaattttaggacagtaaaagtgacggcagttgtaacggttatggtctttctttcagacccaatgccagctaattttgttccaaaacacaaccgtgagcatgctaaaggctctttcgaacgtggctgccgctgctgccaacgtcgtcgtggtgttatccgtagctatggaattaacatgtgcagaagatgtttccgcgaacgtgctcatctccttggattcaagaaatatgactaaacagaccaattactaggcattccgttcttattattttctgatctttttttattattttatttcatgaaataattcttgatatcaataattcttttttatttctaacaattttatgtttttaaaagcttgctttaaaatacatttttttggaaaacgaattgaattttcaagaaaaacatttgttatctgtaacttataatgttttatttaaacttttctgaattatatcaatattaattttgatgaaattttgctcaaagttttcaaggctgaacttttgggattcttttctgaatcttattctgacatcatctgaatgatcatttagagctctttccaacttttcaacatactcatcgcatgtcaatgccaaataatttgtgtccttaacaatatccataagagggcctgcgcttctattagaaattggaatcaatccagctgccatatattcaacaacacaaataccgaaatgttcatcacgcattgtgtgaagtccaatatctgctttcctaagtaattgtttcagctgttcatatggaacatttggacataattcaactttcagctttttttcgtctatcaccttttgtaaatcattcaataataaacggtctatttcatttctacaaccgccgacgataaccaaatgagctttttcattaattttggaaagcttttccataatttctaactgtaagaaataatttttttcaggacggaattgcccaacactcaaaatgaatcctttttcacgattttctattgggaattctccaaattgtctacaatcacatggaggataaagaattacaggctttttcccatagatagactcaatgtgatttgatgtccatgttgaatttaccattgttatatccatgaacttacttgttaacgaatagaagaaacataatatgcgataataaagaatcttaatatttgttaaaaatgatgactttgcgatttcttgatcattgttgaatgacgtttcattactttttacttttgagagcatgtctgttgaaatgtatggataatgaatataaaaaataacagtacagccaccaaagagtttccaaacaaaggaagcaaatggtgcaccagtagtgtctataacaacacttggaacttctttcattagacacttaaatacatatacaatagaacttaatgcttgcattattaaagtaaatctgggatacctgcctggctttatgaaatcagctgttcctacgtttataaatcgtaagtgagaaggaattaccatatcgaaactcttgaatattttttcttttgcttggtcatatgtacattcttgggaataaattgcaatatctatgtttttatctttaagagaatcaacagcagcccagagaacgcgttctcctcctgcacaatcaagacaatttggatggaagaaaactaccgaatttttcttttttcgacggaaatataaagctgccattatagaaagaataattggaagtaataaaacacatattaatataatcatgtttcaagtatttgtccagaagctaacaaaacaaagatagtcaattacctccttttacaaaaagaaaaatttttccaaatgaaagcacctgcaccaggattattccaatacgaccaaattgttcacagaaatgcacttaagtttgatgatgatttatgttgttcagttacattatctacaaaaaacatctatgtatgtttaacatgtggaaaaccatttagtggcggatcttcaacatctccactaactcaacattttgttgagaaattccacccattagcaatcagaatgagtgatacagaaattgtagttcttccaaattatgatgttttaccagatgttccagaacttcaagacattagatttacagcgcatccagtttacacacaaaaaacaatagctttcatgcatgaaaagatgaaaaatggcggagaaattattccaggtgcacttgggttagagacactcaaaccaacacatgcgcaaatttcagtaattcgttttatttcatgtattgatccacttcgtgattattttcttttaaaagattttgatgtaccgatattaaaagaattttcaaccttcttcaagaacttctttaatccatatttttacaagaaacagatttccccttctaagctctttcgctcgcttcctgagattgatgatccattcaatttcctatcggtcattttaaacgagctcaacaacaaatttgggaaaaataatcttttaagtactctatcacgagggcttttaaacattgagaagtatgaagatgcaggccattggaaatcaagcaaacgaaagatttggattcttccacttgaaatcactgattccccattatatcgttctggtctagaaaaagagaaaattattccgcaaacagaattaactgagcttttaatacggtataatggtgttacaattactgagacaccaattggtgatgggaaagtcgaacgtaagaaaatgaaaatgtgtaatgcgccaagttatttaataataagtataaatagaattaagaaaaatgagtttaatcttgagaaaagtaatatgcatgtgatattaccaagagaggcattaaacatgagcgaatatggtattaatggtgagtataaagtgagagctataatttcgcatgaaggaacgccgaatgatgggcaatacttaacatacataaggaataaagacgctggaaattggataaaatgcggaactatagacgtgaatgagacgattgaagatgtcgcatttttgtcgcaagcgtgctttttacttatggagaaaatttaataaatgtttacatctttttgtttattccatttaatctcatttgaaccttcattaataattataataatgaaaatgattttaattttttgaagaaatcaaaattaaaaaacatttattaaagcaaacaaaactgaaattctttattttttttattcatgaatttttttcaagaatataaaatgaagagaattaactgtaaaaaagttataaaacagtattacaatttcaaaaataaaagaataaaagtattttattataggaagaaaacaaaagaaataaaatcaagcattgtttgttaatgcttgctgtatttgatttaatgcattatcgagatcttcaatggaatttgattgtatttcatgaatcatgttagcaggaaagtcttcgataacttcatcaagaattgttctgaaaatttctgcttcgacattttcgcgaattttatcttcactatatccacgggcagcgagtcgcttccaaagtaaatctgattcacaacgaagtacaagcacgaagtcaagattttcaatatcaacaacgtcagaacagtgaaaatcaaatactataccaccttctggatgacttgcaatgatattgttcaattcggcttcgaggaggttttcgtcataaattgtgcaatcgcgctcttcatcttgttcagtccaaagatggttatcacgaattaattgactgattggcacatgaagtaaaccaaacctagatgccaacattgatgaaaatgttgttttgccgacaccaggagttcctgtaacaagaaagtttggttttgttctttgcatggattttacccggccacagaatttgccattattaatttgagtgaaaataaaatgacatttttgaaattttatgcaaaaaaatataaataactcagattctttcaacaatgaaaatgatacaactagttcagatttttcagcagccagcagtgaattaattgactcgtttgtacaaagaaaaaacacaaattcaaaaaatgtaataacaaaaattaatcaacaacaagaccctgaactttggattgagtaccaaaccttaagagatgaaaatgaacagctaaaaaataaattagaaattttgagaaaaaaactccaagaaatcactcaagaaaatgaatcacttctgttgattttggagaagagcttaaagcttcgatatcactataagaaaaaactacagaaatgaaaattatgataatttgcaatcaatataattttacaaaaacaccaatgggatatgacaacttcatcagcacgatgaagaagttcgaatttttcatgattttcataataaataaatctaaagaagatattccatgacataattctttactcttatctctaacgtttcttaaacatattggcaaaataacatttgtgccatttagtaaacaggatcaatattcgaccaattgtttgttgtaaatgaaccaatgctatagctgtaattatcgaaacaataatctcctccatcatcaatttcgatgttgtcttctagcacgaatggtgagtcgttttcggtactctttatgattggaaccataacaggtgattccttttcatacctattattaacagctatccatggtctgagttgatgtggcatgtggtcagctagtgttcttttagatctagactttgaagatgctgaattttcaacgtgtttgcaaattgcatgtaaattttgaatattaatcgaaaaagattcattacaatttgtgcaggttagaagaaaagattttgttccaaggctactatgtaaaacttctgatggagaatttattaaaattccttccattttaataacaaactgtgtatcatcatgttggctgtttgttactccagagcctctagagactataaattttatatttccgcatttgcaggattcttgagtcgctgacattaactgtggttcgtcttcacaaaatcgttctctcaaaattatgctcacaaaattgaatgcatgtgattgtatcggcacaattttgtgaggagaaaaaaaaaaacaaaataatcgctgttgactcaatttgtattaaaatctgtactcgacaaatttgtcatcataaaatgtttaaacacgttcccattaattaaaggcgacataatagtttttatatattcaactaaattgcttatttatttttatcattgttaaacaattcattttgttgagtgcactcaacaagtttcatcatctatttgtttataaatttcctttctttgattacaaatgaaaaacatttatgaatataaattctttaagtataaaaataacagatgaatgacttaaatgatgttgagtttttcgattttcttcttctttactgaaaagtgccataacaggaaatgaatgcaatttgatcgtttagcacgtttgtcatcctctttgctgtcaaatttttttataaatacttagatgattggctggcctatttttcgttttatttcatttccactaacatttcttttcccaggttatcgttcattcattgctgttgtaagtgaaggttcagatgatgattttagatggctctgctattggttggtttgcgcattccttttattaatcgaagctgctgcatctttcttacttaacacaattcctttttattacgaattaaaatgcattttcttactatttttacaatatgataccgcaaaattagcagaagatatatataacaaatttttgggtcctgcaatcaaacactatgaaccagctttggataagttcattgcttcttattctcaacaagccgaaaagatcaaacatactgcaaaatctcaagttgcagacgcagcaattaaatatgcattaaataactaaacaagcacaacttttatgaatgatgtttttatcttataagacaagtgcacatgtgaaatttgattctgtcaataaaaaatttcaatctgaaaagaaaaataaaactatttcaaaatatttgttggtaaaatcattattttacatgttgaacttctgattttaatttcatcttttccccaatcatgtgcaaaaataacaaagcattttacgagaatttatacaaaattttaatatgcgtttcggattgtttaatattattaaaagtaaatccattccgagaaaggtattgatttgaagaatttctgaaaccttgtttgaatttcgctttggtcaagcagataaaataagcaatgtctcaaaacaaagatatacacaagatgctcgttaaagagctcaaagaaaagctaaccgaacttggtgttgaaccatcgacatttgctaaactcaaaaaagctcaattagtcaaattacttgaagagaaactcgcagaggaaacagccgaagaaagcgaagaagaaccagctcctgaaactaacgaagaacctcatgaagaaaataaaggcgacatcccaccatctttacctcctgcatctgatgaaaataaaggcgacatcccaccatctttaccacctgcacctgaagaaaataataacgatattccacctccattacctccaacacctgcagctatttccgaacccgtcaaaataagttcaataatcagtccattccagtcaaaatctcaaaacacatccgaagaaaagaatggcccacccaagggcatgaacttccaatttgatcttgcccatttaacagcacttgatcccaatcattattcccaatccgatgttcaagattccaatcttcttttacaaatggccacttcctctctcaaccaactatttgcgcaactcaattcactcgaacgcgagggagataaccgcgtcaaacttcccaatgatgtcattagtcttccacgatctcagccaattccaaccgagaaagtcatgacgcgttgggaagctttcaagaaagagaaagggctcaagacacaagcgaaagagaaaattgtccaagatgaagccacaggcgaatggcgccttcgctatggctacaaacgcgcgaacgcgccaaaccaagattggctgatcgaagttcctaatggttatgaaggcgatccattcgagaagcgcgagaacaaacgaaaggagagcatcaaagagcaaaagaagagagaacgaaggaacaaaaatagaatcgcaagagcgaagttggacatttcgaacgtgtctgctaaaggaagttatactaaggaaactataagaactgcaattaaggcttcagaacacccaacgtcatcagcgtcaatgaaccaatttaacaagctggagaataagccgccaatattcgaggaaggaagtaagctgccgaagatattcgatagaaataaaggaaaaaagaaaaatggaagaaaatagaactaaataaaagaaaaagtaataaatttattttgtgtatgtttaagctcactcacagatcaaatcttcttatgggtggcaacatgaaacggatgatcaaaataaaatgagcaaaaactctctgcgtgaattatttttttttcttttgtcttatttttattgatttgctgtttgtgtttattctatcgttctctatcgtgctttctattttttggaattagtcgaaaaattttcaaaataattcataagaacaaaaatattataataaaacatttaacaaaaacattattgaagttgaatcattcaatcgagaaactatcacaaaggatagtcaatgataacctttcattcatgtgattcatattctggcgtttcggttgagacaaaacaagtatgtttaaatatttcacatattaaatgtaagaagatattaaatatttatcgtaagattggaatatatggcgaaccagtgacgtactttaataacttttgtatatttaatttattacatcgaataacattttctttaagttttcagattattttgtattatgtttgcaatcttcgatatcaattttaccttctctcgtgatttaattcatttgtattaaacattctgcttttaatattatacaatagaatcatttaggaagcgttcgagttgttatttaacatttttaataaatatgaaattaattacttcttcgatatacatttttattttcgtttgctaaccattttcaacaacttcgaattcattgatagtgaaatttaaataaagatcatctgctgagtttgaagttaaccatttcattgatttaataaacaatcaactcaacttttttattaagaatttgatttaaattgcatttataaagtttcatttcgattaaataaatctccttaaatgtgtcattaaagatatcttcgagtaatgttctataagtcaccatctgtttcaccgctataactaccaaattattaaagaaacattacaagttttgcgataatttccttattcgcgaatctcaatgtataatacatacaatacgaagcgttactcaactcttgtagagttaacaagtcaggtgttaatattgcgtagataatttggtttaaaattttattaaaacatattaaaaattattaaaacatattataaattattcaaatgaatagtttttgcattaacatcaatcccttctttatctaaaagtaattttacgatttctatattattatttctaactgctatatgaagtgctgtttcaaattattaaaacatattttaaattatcaaaacatattacgaatcattaaatcatatttcaaattattaaaacatattttaaattattaaaacatattccaaattattaaaacataatatgttatttgctttttaacttgtatagatggctcaaataaatttgttatgatgtttgatttgagacatgtgatgtgaaacattaatgaagccaccaaatgatccgcatttcctgactccagatggaaaagaaaaattaaaagtgatacttgaagagtcagatgacccaatgagttttattgaatctcttcatcattgcgaacattatgatttttctcaatattcaaaagtttttcaaattggagattttagtggatttgacgcttcaaggatatttgaaaaatatatcgaacagcaacaccaaacaatcaaaaataagataagtacactatatcctgatcaattgaaagagttactcaaacaacttcagcaatattcagatattcctatcttccatgacctcatcaaggatgttcttgcacggatgcgcgaagttcctaagtggtttgaaattccagaatcaatcaaatcagatttatcacctccagatcaactcagagttttttctgatcaacccaaagaatttaagctttggcttgagtccgtttttaatgagagtatgtgtaatttccaagaagttgatgatttctcatatcttcatttattccaacaaatttcagagttctgttttcataagcgacaaatgtatcaaatagttgtcaacttttgcgagaagaaatttttagaaacatatcatcccatctattgtgtgatcaggattcgtctatcgctttacaattcccctctttcccgtatagattctgcgcgtcctctctcgtatttggtcacgaaggccgtcagcggcgattgcgaggtgaatttcactgagattgaaaaggcggcgaccgtttgcggcgcatcatctcaaattgttttgtcacttccgaactttacgatgaaatatcccattaaagattatataaaagcatttggtgttacgccacgagacaaaatgatttggtcgaaacatttgaatactggaaattcagatgcggttgattttatgaaaagaactccttttttcgctcgtatcatagggatatcagtgattcaaggaataaagctgaatggcgatcttttcatcacgttaaaggattgccagcctcaatgcgacgttgcatatttcatgtgcagaagatacaaaaccgaaaacgattcaattttgagagagtgggcctcaaaaagtggatcggtgttcatcgactatttgacactttgtatatcgaagaaaatgaaattaccggatatacaagtgccggaactaacaaaagaacaagaggctatttataacgcctttttgcaaaaatgatttttgcgtttaatttgtttgaaattatatcaataaaaatttttcgaatatattatcaaatacgaaatttattaaaatagtaatgcgacgttttaagaaattatataaaatatgtaatttgtatgttatgtaaatagtttgtgttgcacagtaattttatctgtgaatgtgttcaccagatgcaaagagatttttattatacttaaaagttatttattgatagacttgtagttgaactaaaatcacttaaacatcactatgcgcagtgttcttacataaaaaaatatgtttttcataagcattaaggaatttaaacttctgttttttctggttacgtgtttaacttgcgtgtgcaaattatagctgcgtaatattatgtaaagaatttttttttgatattcttattggcaaaagcttacgatctgttgaatataaatggaaattggcgtatttagaggttacgcacgaagagcaaagataatatgttgaatttttttgagaataagaaaatgtagcgaatttgaacacatttgcctgaaaacattttctagttatggatctacatgatgtttgcatttgcatatattgtaaaatgtcataaaaaatagatatttgtaaacgatatgtttttttaatacatgaaataggtagcactgaactcgaagatagtagtaatgtgatgtgattgccttaaaattgcaagaattattgaatattaacatttttttgatatatgtaaaagtatcattttacatcattcaacaggtcgtataattaagaccgaatcacccgcggcatgcttattatatgcatttttctctaaaacaatccgattccaagtttttgttcaataaagatcgggatttttttaacaaaagtttggatggaatcactcacaaattgtattcaaagttcaatcaatttttgagagcaatttgcggttattggttctggtcattcgaattgaataatgttctttcaacattaattccgcttttctgataaagatattggaaacaaaaagcatttttacacaattgtgacaactcctagaaaattctttaaaaagcctctcaagcgacacagtcacagttgttgagttgttagcttacgaagattttgttattgtctgcacgttattttttgtgtttgtttaaacttctgcattcaaaaagtaaatttttctaggttaattgcatcgtttccgttcaatttttaaactgaaaatacattctggaacggtttttttctgggaattgtcaaattgttcaatcttgccagaacttctgatgctcttaaatcaatcgcctcaaattaccctcacagagatccaagaaatcctcccagagcaccactatcattttacaagggctataggggttggaggctttggctcagtgtttctggtgaggtctgataaatataatcaagatttttgcatcaaaagaataaaacaaaaagagccagcattcgaccaaacaaaaaacgaagcggaaacattaattcgattatgtcacccaaacatcatatcaatgtatgaatttttctttgatgaaacacggacatatttgtacattgtactcgagtattgcaaaggcggctctttaaaagatttggtacaaaaagaaggtccgataaagccaccaaagttatattcatattgttaccaaataatgaatgcattgtttcattgccatgaacaaaacgttgcacatagagacataaagcctgcaaacattcttctcgacagttacggaagaacaaaactcgcagacttcggtctcagtaaaaagtttgaaaaaggagaagttctaaagagttgtgctggttcacgacctttcatggcaccagagattatcaatggccaaaataatgacccatttttggcagacatttggtcgctgggaataacgttttatacaatcgcattcggaaaacttccgtggaaagttcacgacgttgatgaaatggaaaacgctattagcttagggattttcacctttccttcttatgctgagccagggttttgtcagctaattcgatcgatgacagctgtgaacccaaagaaaagagaaccattagcaaaattacttcgatctccaatttttgatagcattaaaaagtataattattcttcactacctcaaacacagagtgaacgttcgtatagaaaatcaacttcatttcttccgtcatctgtatcacataatagaattatcagtaataggattaataacaattcttttttgttgaagaagccagaggtaaagaggacaccagtgataccgaaaatttttccattttaatgtttgaataaatcatgctatatgtttgattgtaatttttccattaaattaaaccttgaaacaagatcgcttagatcaaagaaataatggtcatcaagtattatctaattgtgttgattaattgcaataataattatctattatgatgactaacttcttggattttggaaaaaatctatatcatgaaattaagatctatgtgggcaatataaatcataaaactgatcaagagctgaatgcatcgatcatccgatgctcgatttttgtgtccttctgttgtggttgtccgtgaatttctgtggtaggagggcaaatttgaatgattttaccagcagattttgaaaattgtgagtggtgaactgatataatctaattttgaatttgttgacagaggaatttgagttaatgtcatttttgtttagggctcaaattcaaaccgaaaatgtaaccacacccaattcagttttgctttttcaaagcttttcaatcatgtgggtaaacaataaagaaacttgacccgattataatcgtgtttagtttttataaaatcattttcatgtaaccaagcaaaaaggaacgccctggaagagacaattttggttataaagaagaaaagatttatgtccttcaaatgatcagtaatcagaaataatttttgataatttgatgacttattcaaggattggagttcattatacgaagagtaaaacgctatatatcttttaatgatgtattagttctttactccactagagtttttatccaaacataaaacaaagataatcatgctgttcatctttaagcttgctgcgtctgcagtcggttttaataagtgtaatggaagataagggaatataattatcttaaaatattatttgacttatataagctaaatattactacacacttactggtaaaggattgcggttctgttatttaataaattttgtagaaaagtattgctttaatcccataattataaatataaaaaaaatacaagatttaagaacgttgaacggatcatcaaagttaagagtttcttatgaataagctgttcataaatttaaattttcgtaaatttttgttggtaaaagccatgttcacgcaatagaagattgttttagtcaaatgacccaacgcgttaaaagattttcatctgtttgaatttttactgtttttttttggggttgaccaaattacaatttaatttagatatttgaatacatcgtaaactttttaaagttttcgtttcccaatggccgctcattaacctcgtatctatacatatcgggtttttttatccatgtgaagtaaacggcataaaaattaactttttcaatacggtaccgttggaaacgctgcgaaaagtttggtataccaccaagcgttctaacccaacatatgaacaaaaaattaacaattactgtttcttccaaaggtatgttcatatgttccttttatgtgtaaagcagttatctggttccatctctattcgaactttttaattaaaccactgctaagaataattttttgaaattttcacttctcaagcctttttaaaaagcaaatcaatacaaacattgtaaatgcttgtaacaaattttgttaatttttttcttttgacaagaatccatacttttcatgaaaaaattaacaacttaacagaaatttttactattccataataaacatttagcagcatttctcctgaaaaaaactcattcaacattgtatttgaggcacccttgttttgaacgttaatttactcgttaattgaataaagcattcaactgccattttccaagatgacaaaccctaaagtttggcttaatgtgtttgattaaattctaattttagatcttttaatggcacgaaaaatggaaaaattgtgatagaactttttgcagatagagttccacgaacggcggaaaatttcagaatgttatgcacaggagaaaaaggcgttggaagatccggagcaaaactacactataaaggatgtaaattccataaaatcatacctaattttataattcaatctggtgacttcatatcaaatgatggaagtcaaaatgaaagtatatatggtccacggtttgaagacgaaaactttgcaatcaagcacgaccaaccaggaattgtttcaatggcaaacaatggaagaaatactaatggaagtcaattcttcattactttggtgaaagcgcaatggcttgacaatcactatgttgcatttggtaaggttgtagagggaatggacgttgttgaagcaatacaggctgctggatcaagcaatggtgttcccaaacaaaacattgtaatttctgattgtggtgaagtttgaaataaacaaaatattcacaatgttgttcattgttgtaatggaaataacttatcacttgcttcattaaatccaatttttttttaattaaaatatttttctgcaaatattttcgtataatcatgtttacggaaacacaatgcaacatgctctttagtgtgatttttattataatttttttttttttttgaatttgatttaaatcaagaatttattttgtaatctcataataagaaaaattgatatagaagtagattttctattagtatcaaagcgataacaagaaaaattaattacattacaaaattagaattaattctaataaatacaatttcaaaaaaaaaaaaaaaccttgtttgatatatatataattattcagtaattatgatttactgagcagccttagctttcttttctctcattctgcgacttctggcacgacgagcagcgatttgttgttgaaggttcttttctctttcattttctactttaagtgtgtgaatatgttccattaaaacgcgtttgttacggaattcattacctttagctttgagatataatttgcgatataagtgggaatcgatttcctttttctgtttgaagtccctgagtgtgcgacggagaacgcggatacgacggatccattgccactttgaattaagacgggcattacgtgtaccacggcgcttaccatagcccctatgacgaccaaggcgcttagcaagaacgcgcttggtatggcgagcgctagaatgcatggcaactgggcgacgaacaatgattccatcaccaacaagctttctgatctgttgacgtgagtttgccattgcgatagtggaaatttctgtctcatccatccaaacacggccaacgccacagttgaggactgatgctgctaatctcttctgaagtttgaggcttgacatctttccaaaagggggacttggtcgttcaaaaccgtagtaaccgattgttgacaagtgttgacaaaagcattattgaaacatttttgatctgaaagtacacaattccgactttttgttgaatgtatgtatcgttcataataatgtgttaattttgatcgtttctcaagtatttgataactttatgaaaatttgtttttttctttcgtcacattaccttgcaattatctcgcttttatgtcattgcaaaatgaagaagaaaaaattcattttattttgcaaaaagttttaatgatatcacttaattatattgacaaattccaatttatgtgttctgcgttacataacatttatattccagacaataatccgactcgtggagtagatttttataaatttcagaacaacttccttggagaaaatatagaaatatgtttttatgacacaagtggccaagaattatatgggaaattccgtaaaataatatcagaagacgcaaaggcaataatgcttttatacaactcatcttcacggtatagttttatgcatatttgtgaaacaataaaaaatactccatggtccgatgcaccaaatgttcaaggaagttttttcataattgcaataaattcaacaaatgataaggttgaagttccatcttcagaagggaaaaacttagcaagttcaaacaatatgatttttttagaagcaactccatcatttccgcaaacatgtcgatatgttattgataagattggcgaccaccttgcatcaaagcttctcaaggatgatatatccaatgattttgtaataagtaatgtacaaaatctagaagacaatgataatacatatcaaagaaattcttattgttcaatagaataaaaaatcaaaaaaaaattatgtataaaatgttataagtatcagtaaatatatgtttctttagaaaagaatttttgatatttataagacttgctcaactgaaagaaaaatagaaagttgtttagaaataaaatatctgttttgatgataaggtgtaacattaagtttgtaattaattacttttccatttttcaaaagaatacaacataaagcatttttaaaaagaaatgaattaaatataataaaatttaatatgatactaaacaatccaaattaaatgtttatttgattataatgcttaacatttaaagatttaataaatacaatcttgtaaagaatatcttcattcattccaacgacataaaggaaaaattggtaataactcaaaaaacattatgcatttcagctgaaatcaaagagtgaacgataaaaagcatttataattattaaaactggttgatcgagaaaatttgcattaagtggaatatttcatatttagcatacaatataattcagattgataaataaactcattttgtacaagttagcaataggtattttacgagtagcaaaaaattaatgaaatgtcataagcaaaatcttcactttgcacaactgctgtgatgtattgaaaaaatttgaattgaaaatttccctcaaaatttcgttgaaaatacgttagtccgttgaaacctaccagcaatgaaaggtgttgtgcaatggattgccgatgtggctttacggccagctcgggcgtcctatgatgtcaacaatactgttacagttgttcaatccgcagaaaatcatgtttatagaagaattccagtaacatttaaaaattccaaatcgcttactttatatgggagtctttggcatgacatagacaatgaaaccccaactgtgtgtatgatttttcttcattctcttggtaataatcaatttgaagctttaaatttgattccatttctttgcacgcctgaccttgcaatgttttgttttgatttcactggaagcggcaattcggagggagacttcataccaatcctttgtcatggatttgaagatgtccttgcagcttcaaattttattcgctcagaattccatattactaaaattggtttatggggccgatctttaggggcagccataggtcttaacacagtatctgcatccaataattttttttgttttatatcagattcagctttttcatcaatctatgacattgtatatgaccatgctcgaaagtatgggattccctccttctttatgaagtttattgagccacttcttatccgcgaggctcgaaatgtcattggagatgaagtcgatattaattatccacttcgagatataccatgcgccagagttccactacttatgggccatggcaaatccgatacttttgttcctctagctgagggaaaagcaatttttgacaaatacggatgtcaagaaaaacagttttacattttttgtgggaaacataattctcctcgtccaaggcaatggtacgaaacagctgcacgctttatttatcggcatgccggaattcgatttcccgtaagaaattatgattcggaactaagaaattcttttcttcacgtgggcgatcccgaaagaattatacaggcaataactttaatataattattttgttagtaaataaattagaatataaatttataatttttttgatgtttattgttttcattccttttttaatgtgaattataaatatttttttttatgcaaagtatttaatctttattgatttaatgcatatacaacattgcaatgtctttctttcttatgtactgatttgaaattttattaatttcattaggatgaaattatttatataagttaaataccattaaatgcatcagttccaaattttgcttgaataccaattggtaaagatgaattgcattagtttacaacatttatgaagtcatttagtgcagaataaacaaataaattctaatacatattttttttttaatattacattgaatttattgggaaaaaacttatgcataaacatcttataaaacattttaaataaatatataaatatatatcataaaatcaattttatcaaattttttaaaacaacatataaaatttgtgttccaaaatgtttttactatgctctcgaaaatatttataaggaacatgttacttgatgaacagagcaataattaatgcaatagccaaaaccatatagtaaatctttatgtttgatttgtttccatttggtggtcgtggttgttctggatctatatgttgtggttgttctggatctatatgttgtggttgttctggatctatatattgtggttgttctggatctatatgttgtggttgttctggatctatatattgtggttgttctggatctatctgttgtgtcgtttgatcaaataaagcaaactttgcagcagctccataagatacaacctcttcaaatttcacatcatcaagtacaggcagctctttttcaaaaaagtcttttagcttattccttatttctgctatatttgatgaaccaccagcaaggagaatttcattaacgttctcctttgaaattttggtggtttctaagaatttactaacggtctctataatgccgttgaacatcttttcgcaaacatttttgaattgctcatatttaacagttatatgactaccaaatgactttccttggaaagttgcacgaaagcttgaatcccgctcattactaagagtaattttaacattttcggaattcttctttatgatgtcaatgtctccatcagataaattctgcttctgccttccaaaattatttttgatcaaatctacaattaatgaatctatgacatcgctattgatggttggaaattcttcgctagctaagattttgcagttttcagcattctcatcaacatatacaagggataaattaagtgttattccaaagtcaaaaatcaggacagttttcttatcttggatttttttttgatataagtaagcaagagctacagcaattggactttgtacaacatcaataaacgtaaattcagcttgttctgccatttgttttataagttcaattttatcatctttatatgaagctggaactgctataataacagcattttcataatgactatccttaatcattgactctaagcatttgatgtaaatgtcttttggagtgaatgtttttttttcatcatctatctcaatttcaaaaatctcttcgctaccaatttttcgaacgaaatcagatatcacactatttgagccatattcgtttggaatgccaaaaacatatttataattgtcacctttcttcttcttcttgatcacaacattggtaggctttgtttttttgttaaaatcaacgcttaatacggtgactttgttctcttccttagcataaacactgatacaacttgttgagttacctatatcaattccaagacaatctgagatcattgcaaaaaaaaaaaatgccgttttgaatgtaaaaaataaagatcacaaaacgtttacaattttcagagatttatttaaaatcgattattctttttggcaattataaaaaataatttacttgaattcaagaaaaatctcctcaatcaacttctgcttagttttttatagagcactaaattcaatattttcgtgtaagtatgatctatcaacaattcccaacaaaatttatgtaatcactaacgagcataaattaaatgcacataaaaaacgttttaatagtattataaaattataaaatgtttaataatatatttgatatatttaaaagttaaaaaaagtaattaaaacatattaaaaaaaaatagaaaatttgaaatgtttaatggagtttgtatccaaatttacggagatttgagcattctttgttgcaagatctactaactcagggtcatttccttctgtgcggatgagacatggaccacttgcttcgcaaaatgcaagaccaaactttattccaggagctgattgaataagtgtttcataaatatcttcaacagtcttaataaagtgtgattgcccaaaaataaggttgagttcttctgggttttcaacttgaactagctcaaatgagacagccatatccaaagtgaaatacggttaaaagtgccatcaaaaccgtttaatatttaatacattttatcacatacagaaaatcctaatttgaaatgaaattagaaaatgatatcatttccgaagataaaatcaaatgacaagtattttcagaatatttatgtcatagattttttttacaattaaaattcgatcaaaatttcaaccttgaatataatttgatttttcttagcttaagcatttatctaatagcaaatatataaagaataatactttaatcagaaaaacatctttatatatattctaagcaatttatttataaaaaaaactaaaattccgcttaatataaaaagtggaaattcaaatctgaaaaagtttccaacgtattacgatacgtatcgtaaaatcgatttttaacgctttacacaaatgtgacacttcattcaggggaataatacttccaaatacacacagttccttcgccgctacaagatgcaaagcatcttagactaggatgatgtgcaataccgaaaattgtgtcttgatgaactttaattccacataattgttcaccagttttttgttcccaaattctaattgtttgatcttttgatcccgaaaataccaaattttcaaaaggtgaaaacgtaacaactaaagggaagtttttgtgtccctccaaagtatgccttaacgttgcaattccatgaagagaccaaattttaattgtattatcttttgaagatgttgcaatatcattattgcacggcgatacagcgatagttagtaatgtttgttggtgggcaggataactcatcatcggttgttcaaatttgttatcatatatcccaatccttccattagcaaacccaacagcataaaatgaaaactttgtagatgttactacacgtgatattattccatttggtgcattatcaccatgttcaagatgtttcactaattcatatgaattgaggtcccaaacgtttatataaccgtcaaaaccggcggttattaacgtattctcctttgaaccgaagatgatggagtttacatccttccgatggccatgaaacgtgtgtaaaaggcctttggttccaatgtcatacaataaaatggtgtagttagggccactaactgcaatatatttatcgttgggtgaaaattgtataacacgtgcataataaggattgattccatcagatggaggaagagatatgctttttatgaggaagccatcttcgggttcgacaataaaaatatttttactatcactaaaagcaagaatagagccatcatttgaaaattgtatggaacagattgtggtttgagtcgtacgaagagtatgcttaagggagactttattgccgaaaaagccattagataatgaataaatttgaggagttatcacaatgctgctaagtttttgttcgctttgagatgatgatggtggtgatgtaggagaatgagatggtgtaggagaaggagatggtacgtgttctttctcatcaaccacttctgtctcttttatctgttttttgcccaaatagttttcaagatcttttctttcatcaacacttaatatgtattttatacgaattttgttgtaaacttcatgaagtctttcgtattcttcatcacactgctgtaatcgaatttcataatttgtgcgtattttttcaagtcgaaaataatcttcttttaaagcattaatattttgttttgcaattgcaatctttctagcaatggaatcaattttttcaaggtcctcatttttgggaaattttactggtattgtttcatttttgtttgggtttgattccatccccaaaaatggtttggagaatattgacactttttgcgaaacctgccaaaatgtttctgatcatgtaaacggctgctatgctcatattgtgctttcaatgcgaacaccaatgtaatttaatgtttaactaacaaaagctttagcgtttgctaaaaaataaaatctagaatatatatttgccgttttaatatttttatagtttcttttgtgtgtgattttagaagaatttgatttttgtacgttaaagtgaaaaatgtttggaaaaggttcttcaatttctttgtgtggcaacagcaacaacaaagttctaaggcttgcacaaaaagcaaatgctgaaacaattttgaacaccaaagcattacttaaaataattcagaataatcaatcatttcctccaaagcacagagttattgtttggagatatattctccaaataccgatgaatgaaaatgcatatatgacattagctcaacaaccaattcattcttcaatttgttcttttccacaacaattaccaataagatttggctcaatttcaaagcgcttcatgcgtactctttcatgtcttgcatattggcatcctccacttgcagaatgtgattggcttccatctcttgttttcccatttctcatgttatttgggcgagattcaatcattgtttttgaagttatagccactgtcatatacaattggtgtcaagaatggatatcatttgtaccaaatcctccagttaaaattctttctcggatttctcgaatttgtcatgattttggtgagactgtatcaccaacacttatatggccagttcttcgcagtttttttggtgaagtttccaccactgattcagcgctaatattactcgataatattctttcatcacgtccatcttttattgagtaccttatttcatcatattttattttacacgttgatcttgttactgaaacaaatgtatattctatcattaaaaaggcaaaacaaatttataaaaaagatattataaataatcctgatacatctgaatttaagccattaccaaaagatttttatccagttttaatagttgtaaagaaatcaaaacgatggaaagaaaaagagttggaaagaattcgtttagaagcagaaactagaaaaagacaaacagaaatcaaaaaagaagttaaaaaagaaacagaacaaattgaaaagcaaagaagaaattggttaaatcaaagattatttttatctgatattgaaacagaacaaatcgaagagtttataagaaaagaaacagaagaaaacaagaaattgaattttggagaaagaaaagatattaatgaaagaaaaaaacaaatagaaaaaagaaaaatcgatcagatatctgaaattgataattggagaaaagaatataaaaaaattaatgaagatgttgataaattagttaaatcacatcaagaaacttggaatgaatggctaaacttaaaagaagaagaagcagaaatagcaaatcaggaaattgataatgaaattaatttaattgatgagatacaaaaaacatccgaaaaagaaaaatcaaattataatgaaaatgttagaaatataaatgaaatagaaaatgatttattggatagaattacacacagaactcaagaacttgaaaatgcaataattgatcatcgtcaatttcttgaagagaaaagaagagaaaatcaactgtttagttgagtaacatataaaaatttaataaatgtttttttttttttttttttcgtataaaaagctttttgtaatcaaagtggccgataagaccgtttatttacatgtatcgttcaaaagtggatttcagatgctatcatcgaaatcctttcgtaattatacacaacaaagaggaaatatatatctgccagttgatttattgattgtgagaaatggagcatcagaaggatcagttatgttgcaaaaaagaaaagctcaaaaagatccagactttgatcaaaaatatcatgaaacattaggaaaagttcacaattcaaaatggcgcttaacaaagttaggaacaatacaatctcgtgctgctggtcgatggatttctgaaaatttcccacattttgatgcttatcttacaagtgaatttgtaagatcacttgaaacagcgtgctgcctcaaccttgatggtgctcactggcttccatcattgtatttacggccacgagattttggtaatttttcaagactcgatcagaatattagtcaagagcaatttaaacgttatatgcttgaacgagctcgtgattcattttattgggctccgccgaatggagaatcaattgcacatctcacgcttcgaacagaaagagttgtttattggcttcgtagacacgtaccagcgcatggttcagccattattgttactcataaggatgttatggagtcttttcgcattcgtatcgaaaagatttccgaaatggattacaaatcaatgatcatggaaccctcacaaaatcacgttcttcattatagctcgatactacattacacaagaaggaatcctaaaacaggagaagttgttccatattatcaatggatgagaatcgttactccatggttaggaaaacattatacgccaaatgaatttgagccaattgtttcaaagcactatggaaatgcagagctccttgcagaggtatcgaacgtcccacgaattttttcagatgagtaagcatttcatcgttcatcaaatttgatgctcttttaggtttttcgaacacgctccaaatcaaagcaaaaactcgcaaaatatacatttttatgtcggaattcccaagaaacttaaaaatattttttacttttaatttttattcatttttttttaataattaatataaaatcatttaatttctggactaaatgcaatattttatatatataaattcttgaattaaattatttttattcgatttgaattcttataaagaatttttgtaaagaaatatctaaaaatatttaataatattaagagatttttaaattaaacaataagctaacacgagttttatgggttttcttgcttttgttttagtttgattttaaagacagaattttctttctcccgatggaagatttgataaaatttcatgattgaaattattgattagactttccaaaacccccaaaaacgttctcttgtgaaaattgatggattattttgtaaacctgttaatttggttaattaggatggacaaggaagtggatgtaatactgaaacctctgaatggaaacgatgtcccagtacattcgaagagatcagatactgttaggtcacttctagaaacggcaggaattgcaataccacccaattcaaaattaatttgcatatcaaaaggtaatcaattgcaacttgatctcactcttggtattcaggggatagaatcaaatgatacaatattcatactatggccaaaaatgaaccaaagaaaacttaaaaggcataaaatcaacgtaaaccttgaattgtatcaaaagatgaaagagttcgaaaggcagcaaaaagaacttttcgaggaagccctacgtgtctttgatctatctttcttacttttcgattactatcgatcttccataagtgcctaccaatcaatgcttaatcaacaagaactatctatctctcaatacgaatgcaattctaatgaacaagatgaaactgttctagaaactacaaattcagtatcatcagaacctttgccaacttgttggcagcaagaagaagactctagctctggtgacgagcagagtatttgggaagaatgtctttttgcaaaacctaattttgaacttgattcatcaaattgatgcaaaccacatttcaagcaagtgaaaattgttgttcttcgttaagaagttaatttgcgccttcacattcttctcaatttcaatattattctctatcaaataaatcaaaatttaatgttcataagctcaacacaataaacatttatcatgcggcaacttattttttccttttttcttctatttcatttaacatcacttcttttatcgaatagaaaatattataattttttttctaaatgaataattttttgtttctttaacataatacaaagttaaaacttgtggctaaccaaaacaataactcgaaaataacttgctgagcaaaacacattttatgtttcttcggcggtttcctcaacataaccgcaataaccgttgtggccggccttttcgaatgtcacaagaggttgtcattcgcgttcgtgtttggggaggagaatcgggtgtcaccgcaaagcttgccccacgtttgggtcctctcggtgttaactctggtcaagttggtcaacaagttgctaaagctacagaagaatataaaggatatcgttgcacagttcaaattactattgttgatcgtcaagcaacaatctcagttgttccatcaacatctacacttatcattcacgctctccaagaacctcatcgtgatcgtaagaagacaaagaatgttaaacacacaggaagccttacacttgataatgttattgatatcgcccgtcaaatgaggcacaagtcaatgtcaaagacacttgcaggaactgttaaagaagttcttggtacatgccaagctatgggagctcaatgtgaaggtcagaatgctaaggctatccaaaagaagatcacatccggcgaaatctcaattccaaacgagtaaaccgatcactaatttaccatcaattttacacattttgtaaatttgcacaatgagtaaaaggttgtttggttaagattgtttcataacattttaggaatcatacattaaattttactatggttatttctaacatgcaatttctttttttttttgactaggcaaatttcatggtcatgaaagccttgaaacacatgaataatattattttgagaaagagataaaaattattgcattatcatgaacttttcaataaaatatcttttgcctgttttgagttcaaagaaaaagaaaaataaaaatttgataaatttctaaaattacacgaaattttatttggttttatggtataataaacaccatggtgcattatatatttaaatctgatagaattttatttggacattttggggaaaaaacataaaaattgagaaaggattgaacggagagagcaaaattttgatttaatattgcttgatttgctacaaaaaatttacaaataaatttgttcatatttaactctaaaaacatgttttcattaagggtcgattgagaagaagttaacggtcatttagaagggtcgttattttcggaactcgttttcaaacataaaggttctagaaaattaaaatcacacaagaccgattttttatttcggctttataatgtcaagcatgagctgtcacagaatatcgaactcttcacatcttttgctcacgatcatccgcatgaaagacgttaatttttttcagttttttatatgggcacttttgtaagttctgcttggttgctatgcaaactaaaaacattttttttctctgaaaaaaatatcacagatactttaaagccacattattccatcatttttcttttttttatattcacatttttaaaattttcgtttgatgcaccaaatttaaatatcaactataaaaacccattttataatttagcaataccacaagtaggctctgacgttgcagatgaaggcttcaaatattcttcaatattaactacagatatcaatgtatgtattaatcgatctgaagttaattcagaaatcaccagagtttttaacaaacgacaagtaattgagaacaaaaatgctccacatgttttaattattggttcaactactgttcttggttctactcttaaaagtattttccaaaaacgaaatcaacgagttctaaccacgaaaggcataaacgaatttgatttttcatccgaagacactccattactatttgaagggattaatataatttcagcttatatcacatatcaaccaccatatgttcgtcacgcacattctgatggatccgaatacaccaacaccatcatccacacgtatattacaggtttatgtgaatttttaagatcccgagaaattccgtttatctttgcaacatcgcaaccattaaacaacgatactattattacagttttattaaatgggggcacagttgttaagcttccaatgctagttgattcattagcatttaaggatttagagaaccccacaatgagagctgttcgcgagtgtcgaaaagttggatattcgaacattgaatatttcagtttcaccaaatatcatagtattgattctatcacagcggcgaaatatgtaattcgagcattatataaaaagccacataaattcataattgttaaaggtcattcagttgccacaataaaagaatcagttaacgctgcacttaaatcattagcattaaccaaatgcgccgtaacctttaaaaaattcccacacaaacttaagccattaggtataactccacaaataattgagacgttaggtaaaaagaaagataatgtcattaaaatgatatcgaaaacttatcgaactttcaacagaaaagaaaaggataaaaattatatgacaatattaactacaggtcgacatgatagttattcgaaaaactttgaagttcgtgctcaaaactttttaaactcgataagttacggactcaaaaatgtaccgttagcgcaagtcgaagtcatatatgtcgattatggtacgccaagaggaaccacattattatttgagttatgtaacatcagcaaatatttaaatgggcatttgcgatttatcgttgttccacctgaagtacataagaatttatcaataaagtttaatcgaaaaggcggattcttcgaattcgttgcgaaaaacattggactacgtcgagctaaaagtaaatttgtgttaacaacaaactccgataatatgttttcgacacatttctttgagctaattgcatcgcatgagtttaactcgatgatgttatatagggcgaatcgatggaatgaacgcgaaaacactttagaagtctataatataacgaaaaaagatttcatcaaaattttgcccgaagtttggaaattggagaaaatggatttggaagaatggacgggattaccgccgaaacaatttagtctgcttaatacgcactttagattcatgtggaaacacttctctgtgaatagcgcttcgggcgattttttgcttctttcttggtacatgtgggaaagaattagagggtttaacgaggtgccgttcaatatgcacaccgactctttgttcgttgcaaaggcaatgaaaatgatacagggaataatggtaatgttcgtaagatccccttttgtccatcagttccacgtaagctttaatttggggacagaggctgtttatgatcacgaaaatgtgataaaggaatactcgtgtataggaacttggagaaattgtacattatattgcgaaaatacaaattggggatttgcagaccataaattcgttgaaattgttgtgtaaataataaatattatgaattataataatgtgatgacaagtgaaactgaaaataaatattatgtttgtatataattgtcttatgctccagaaattgatttaatttcagtgtaattatgatacaaaatgggaataatccagcaacaaattatcttctcaatttatctgtggatcaaaatggattgaattttggttttcgaataagcctaaaactacaacagaatactttaaactctttcattgctacctgaaattctataaatatggcaacacaaatgacatttttttataaggtgactacaaaaaaccctatcggagttgttgttatattaaccgcaaaaagttgttttgaaataaaagtgactttttttagcatcctttactcaaaacatggtggagattgttcaataaaccttaaaaataaatgcatcatattcaatacaacaattatttgaatgatagaacttgatatcggttccgatgatttagtgtttatctcatttttcgcgaaactgagtaaaacccatgtataaaaagttgaatacaatagaccgttaaatccaacagaaaatatcctgagacggttttgacttcaatcgaactcacacaaaaagttgtttgttttttgtcgttaccttgaaatccattcaaatgtcaggtttacacttgtgagcaagtaaatgacatctcctcatgtcacttaatgctacatgtgcttgtcttgttatgcaaaaaaatttcgatgaaaactcacgacgaatcacattgaacaacagtcgttacacgcatttctaatgaaaaattcgtagttatttgttaaagccaaatccatgattaatattgattcacattggcactttcatccttttcctaaattccaacaaacatttttttattcgaaataaatattattttaatttacttactgaaaataaaacagtgaacaactatgtgtatgacaaaagcatccatgtatgttcgcattaatatttttcgtttttactttcttttttaaaatttattttaatcagaaaagcatacatcaaaaaaacgaagttattccgattttattgattatattttttgttaatacaaagcaatcatatgacgaagagacaaaaacactcacaatatctgatttcaatgattattcaaaagattatatgaatgttacagaacgtgttataattattaatgttggcgagattgaaagtaatgcattcagagaatggcctttattaacaacagtaataattggagaaacagttggaaatatcggtaatagagcatttacatcatgtacaaaattagaatatcttcaatttccagataaattaatgagtggaattggaggtggtgcatttgcagaatgtatttcattaaataatattacaattcattgtaataacattggtgataatgcattttatgaatgtacaggacttgaaacgataacattagctgaaggcgtccgaaatattggatcagatgcattcagaggatgtacaaaccttgtgaatatttatataccaagttcagtttattcgattgggaatgcatttttagaatgtacgaaacttcaatttattaatgtttcagaagaaaatattggttattcgaattatgaaaacgatggcgttttatatgataaagaaattacacaaattattagttatccgaatatgaaaagtaaaacatttacaattcctaattcagtcacttctattatgaattatgcttttgcaagttgtaataatttagaaaagaatttttttattgatgaaaatgttcaatatattaattcatgtgcattttttaattgtacatcacttcaatgtattcattttaatggagaaatttcaccagaaatacaaaatgatgcatttgtcaacatcaacgcgacaacagttatgacaatagtaacatatcaaaatgaaacatttggaaatatgagtattactaagggaacaacacttgacgaatgtctccagccaacacgcacattcacattgacacaatatgatacaatcactaattcatatacatttactgaatcggattcactaactgcatcagttatttattcatcggatgtaactttatttttaacgcattcgttcactttaacacactcattatctattacactttcgattacaatttatagtaaatacataaatacaatttcattgttaacattcgaatcaacttatagttatatatcgacaaatgtcatttattacgattacactgttatatattattcgtcttattatagttattattctgacttttatacattagttgtaactgatgttgcaccaaaagataattcgatatcaaatgaattgttaattggtattatatgcggcgctgttgtgatagttttgataattgtcggaatcgtattttcgatgaattttacttttgttaatactattactttaacttattctttatcgtttataaaaactttatcaaattattatacgtacttaaaatcttattcagttactttcattgaatctgaaactaaatatatttatgtcgatttcatatattataattatacaattatatataatccagaatattttacgtattaatctaatttcttttatatttcttatatcgaagatgtaataataaacactgatgataataatacattaattatcattataattgttgttgttattgtaataattattgtatttataatgataattataatatttatgattaaatatcaaaacaagaagcgaaaacaaaatgaagaagaaatgaatatttcagatgaaaataataataaaattaatgaaatcgatagtacattttcagttggtattaataattcaaatattgaagaagatccatttgcagacgatttaaaagaagaaaaatttgtcagtcagatataaataaacatattttaagaacaaaatattttaatttgtttattaatttaataaatacaaagatttttgttatttagcaaattttatgtttcttttattatatgattattagtataaatccaatttatccaaatcataaacactaaaagtaaatgataaattatatcaaagaaaaaattggaaatttagagatattatggtaaaaatgcattatttttttaaaaatcaaaagaaagatatttcaatttcaaataagtgtttgtcttgagtagttctgcttttatctgtgttaaattaagtttgaacagaaagtaagttattgtgaaaataacaaataatatgtttttatataatttattggtaagtgaaaattattaaatgttttctgttctaaaaaaaaatcatttaattaggaaaataaaataaaaaattagtgttaacgttctcacaggtgaatgaaaattttcaaatataattaaaatttattaaatgtatattattaaatatgttctctatgaatgatataatattataaactaaatttcatcatgctcaatcaatattcaaaaatggaaatccgaattaaaatgtatttaaatggaaaacagacatctatgaagctacctgaattgttaggaagcaggttcctgatctgaaagaggaggatcaataattccactgatgcataaagttgcagaaattgttttttggtctggcgaatacaatggaatcctaaaggcattaggtccgtttagtgggagtttacaaattctaacttttgattttccaaataataacatctcatcgtctgaatctccaaaacaacataattgtatgtacaaataagctgaacttatgtctgcaacagagaaggttattggcattctaaaattaaatattgatcttttctgcattttagtatctgttgtagacagaggaacatctgctccatcataagaaacaacaagccacattctgttgtttggttgaattcgatttggatcaatatctgcatcatgaaaataaagttccattttgtatttcattgagaatgagaaattttgggagaacgttaatattttatcaacaaaaaaaccgatgtaaaagtattatatcaaaaaaaattggcttaaaatgacattttatgtattcttgaattagtcaaaaaaaaatcttaaagtttttatattcattgttgaaaattatgaattgcgaaaataactactttatttaaaattctgtaatgttgcacttatcttagaaagttcttcagatagatcattaatgcctgattgtgtgaaacaaatattaaatgagtcatttgttccattaaagtggcactgaacaattggtgtgattttgcttaatccaaattttgaatcagaaggaagaacagatacccatttgaggtcagtaaggcggttgtcgaatggacacagttgagcgtattgttgttggaggcttgcttgtgtctttttccaatattgatgaagagcttttgaaattaatttttcatttgaaaacattttttcaatttcttgatcaaaagaatttaagtcaagacagtacgccattccttttctgaaaattgttatgagatttgaaacaagtcttgttctgacatgttcgtcaatatcaagaagtgtcaagttaagtgattcttctgttttcttcccaagaactatgtcagctgttgtctgaagaataagaatcaggcgttcttcgtctattgcttccattcctaattggcaaatgtttgatgaaacgatagaacgatacgaagaacgatctaatttcattcaattttcttttctttttacaaatttattatttcttgttttgatttactatatttattatattttatgaaaaatacactatgttagttgttttgaaagaaatgataattatcgcaagctctttattgaatcgtgtctctttttgtaaattaaacacaaaagcaaaactgaaataaaaccattcgtataagtgatttgtgaaaatcatgaattaaaaacaagtatggacgaatttggaataataattgtgtcaacaatgtcttttttaagtattataattgttattttattcttttgggtttatggattatttaagttcccatggtatgcttcaacattcatgattttatcagggtcaattccaatgataatgctaattggtattttaccctatgatatttccaattcctcatttggaaagaaacctaaggaaattagatacttgaatttattattaaatgttctttattggatttcatttatcctttcatggatcattaatcctttcgttatttcatacattagttatagtaatagtatttcattaaagcatagaatttgtttagctatttgggataatcttattttttatggtgttatctttgcaataattatggttggaatattgattttaatagaaacacaccgtttaacatgggcatctattttgcctcttggtatagcattatctaatggatatggtcttatactcctatgtctttgccttggatatgcctttgtttcacttcctagagaaatatggagaaatgccaatccttcatataagtacattcattcattattctatatatccaaagaatttaaagaactttcaaaatatatgactgattgtgaagctattcttgaatgtgttgaaaaagcacgtttggaacttggtgaaggtattggcattatatttcgggaaaaaggtcaaccacgcatcaataaactcaacaaatttaaaagtttggttcccattccggaagatttttatatccaaactcgttttaaaaataaaatgataataagattcaaaaaatttaattggaagaattgttctatttataatcttgaagatttttttgcaataattgataaaacattgttttcattaaaacaatcaacatgctttcttagacattctgctaataatgcattaaaagctttagtaagatatcaaaagcaaaaacacagcatttgtttcatgttacgccttttatctgttatcatagcaattctcaatgttatttgtttatggagtgaaatatgccttatgatcaatccaaaattttctattttttatcaaatatctcatgtagacatgccagaaatagttggcatatttatatcaacgccaatcatattgtatttaattatattaggatgttggagccttatgcatcttaaaatgggttcatactttaagtttattaaaggatcaacaaatttaaatacattaaactgctttgtaaacatattatgcagattaggtcccacaattggttttcattatatgcaacagataggagcaaatgaaagtcagttccagaaggtaatgggagttatggatgttgtagttttcattggggataaatggaacattttttctccaatttttcttattttggtgattttatttttcgtcttgaaaatagacgaaaaggcagtgcttttatgtgggtgtgatgatttatatttcgaatctttatatactgatttaaattcgttggaaataggtgaaaaaatccttgtagaactggaacctgaagctagacatctgatcaacaacgagctaacctataaaaaaattattactaggaagcttccaagtgataattcactattcagcaattaaatgttgaagaagtgattcttaaatatttttcaaataaaatatcagaaaacatgagatatattatttatttttgcaaattaaatacaaagataccttttgtgggatgcgtcattaatgacttcttcacttttctattgcattagttcatttatatataaattactatattccatatattccataataatatttaataaacagattggggctttagcgcatctgggagagcaaacgtcatctgaagatcgtgaggtaccatttttttcaaaatatttttatgaaaatttgccacaatgatgtgaaatcgtcttattgacaatattgaatactttattttcgtttcaccacacaaacattttgcgcactcaatcgacaacgataatttaacgtatccaacaagctaaaactaaaagcttgtccaataatattaactaaaggttatgcgtataataaaatttcactgggctatgctttgcgctttattaatagtattttttataagtgcagtttttaattatcataaaacactaaatgatttcaatctagatatatatcttaacaatgatgataatttcagaccatataaaaaatctacacttacatttataaagccaacagttgtgatgggccagtttccatcttacttagtcaatacttcagatttttcatggaaagtggatgttccaactcctcaaatcgaaattattggacctgaagcagttaatcaatttaatccagtttatgttgatcctagcttttttgatggagctaaatttcatgtaatgcaaaatacttatttcttacctgattgtgtatttcttcaaaacaactcatatgtgcttctttcgcatgcatgtcatccaaggtattgggatggtttatatcaacagccagataaaatcacatataatcttacatattataaaaaagtaatttgtataggccaccagcacacgtcagattatggccattggttcttagaagtgtttccagtttatgttgcattaccacaaaatcttttacatgaaagtataattattgttccagaagaacgcgaatatatctaccaatgtttagaaacgctcggtattaaacgcgagcaagttattgctggccacaatgatgcctttttcgccgatacattttatactgtatcatataaattttgtggcgatttagtaccatactttatagacaacttccgaaagtttttcgtcaagacatttgatttagaccatgttaagccacatcgttttgtaatgtataatcgtaaaaacacaagtcgtagtatcggcaatttcaaggaagtaatggatatggtccacacgaaattcccaaatattccatgggaagaaggcgaaattccaaaaaatattgaagatcaagcaaaatatttcaatgaaattaagttcttcttcggtatccatggatcagctttggccggagcaatttatatgcagccgggaacagctgttgttgaaatgcagatggaacaatggctattgtcatttttgtatttgtcaagatacacaagcaaaattatggtatccggaagagatccaaagatttcgtggagtggactcgagccttgtacattggacctgaattataccgaaacactcattagaagagctttagaaaaactgggggcaatttgaatcaaaacttatgaattgcgatcaataaaaaattgtttgtcaaaagtgtttctatgttgtctattctttaataaagaaaagaatctgattgatcaacattggtgcaccaatatattgaatggtctatgcaaaagtgtctttcctgctattgaatttgttatcgttttgtaatccatttgatgttgatccacattataaaagaacatattaaaataattttaaatgtaatatatagaagttgatttacataaatacacaaaagaaagtattagaaaagattttgattttcgagttcagaaatacttagctcatcagcaggttcattttcgttttcatgatgaccacatggaccaaaccatatatcaccaacaaaagaaacgccgaatttgtctgggaaaatttctgaaattccaatgacaaagcatacaaatgatggaacaccaataacgcaaccaataataaaaaatatgcctctgatagtgatgtcgaacttacctccaagcgacccaacgaaaaacgatatcgcaagcattaatggtactaaactccaatatccaagaataaacccttgattcttgagatcagctttttcggatgtgagggaaataagctctacggtgcttttatttgtgattccacattcgcgaagtgttccattttggaaaagacgattattatatttcacaacaaaatcataaccgatatactctgggttagtcctttgaaacataacaacaagtttcctaatgcttatgttttgttcaacaacaagcttggaaaatgtttgaatccttttgcctgtatgaagtcgatcaggaactgatgctttaatattgagagtcagcgaggtagaaataataggttcgccaccaaaattttctatattttgttgaattaagctttcatatatagtcatcttgataattttttttaatttagatttctctcaaaaagtcgtttttttgaatcatggcacttttccccatctcaagttctaattgacttatatcatacttttggaaataatggttatgaaaatttatgactatgtagagtcgaacttgtggttccggtttttcgtaaaattatgctaaaattgctataatcttgaaagaattctttcaacaacatccaatagaattttaactttttattagaacttatgataaaagtgtcaatgtgaaacaattgaatagaaatcaattcttttctggaaaatatttcttcaaggccccagctagctcataattatacatttcaaatgttccgattttccaatcatgttaagcttatattaagtatttagctgatcacgtatattatcttcatataaacctgattgaattaaaagcgttttatggtacgaagaccctttcttgtctgcaagctgatttaaaaaaaaaaacgataaatcataaaatgaaaaaattagagattcaaaaattgttcttcaaagatttgaatctgtaactcatacatcctctttgaatatctgtgctcagctacattgtaaaaatttcgaaatttaaccaagaaaacaatttcttttttattacacatttatttattcttttttcattaaatagcattagaacctaagttttggtagagggtgctgtttttttttatagtaaaagatgatatttgttagttccaaaattactttcttacttacagagcaaaattgatcccagcgtacataaccgccaacgataattgaatccaattcaaaatattgaaaaaactttttgaaaacaaaattctcaaaaagtgatcactttttgatgtccaaccaagccgcagatccgccacaacaactcgaaccaactaacccaattgtatacagaggggagttagatcctcattataattacattcctgcgcaattatccggaaagacaaagagaaaaacaaaacgcacagagcctaaagtcaaaacacttccagcaattcttgacggagattttccagaatcaaacgaaaactataccaaaatgctccaagatgaaactttattactttctccaagtgaactcggtttcgttccttccggattttgggtatcttcaacagtcacattttgcgacaccgtacacaatttcttccaaaagaaaaacaattccaattgtcgtttcccgcacaaactatataacgcattacaactcgttgaaaaaaaaccagaaatgtatccatacgtaggagtcaaatggcttagcgacgttgtgttcaaggtagacaaatatatctttggaaggcttttagggattacgtcatttgatggcggattattccatagccaaggaaattttccatctcatggctttcacgaaattgtgggtgatgccatccaaaacttctattccaacttaaatttggagggagtagattttgatcgagttcgaattataacacattcaaatggatttgcaaaagacgttgacgaaaacttaattaatcaattaaagtggaacagcaatgaaacgaaagttgtgtaactttcatttttatgaataaatatgatcaatagcattaaattttttttttcaagaattatggtaaaccactatgtaaatgtacgtaagctaatgttaatgacttatttcatgagtgagcaataagcatgagtatgtaatgataaaccttaaacttataaattgaatgtgtaaaatttattgaaatagagcagtgttctagattcaatactgaatgtttgttattaatcattgctgaatgttattttaacaatattatccccactctgaaaaggcaaaatatattttgggaacaaaatgccgtggacaaaatttgtcaaaacatatcaaaagatgataaaaattcatttatttccttgtacgcaaactttttgtagaaaacaataatactcatcttttgctgcctttatgcatgtaggctatatatttggtgaaaaaagaagaataggcattggaaattaggcgatcaaagatattttgccattcaatctgtcaaataatccaatttttgaaagcaagtgatcacacaatattttggcagattcaagatgggaaaaaagtctcaagggaatcgaaagaattctttttccccatctagtggaaacaacattgattatcaaacttttgacaggtcttttcaaagaatccttgaagcttgtataaggaataaccaatcagaagtaaacattggattaccaggaaactctttatgcggcattgtttgtgatacagattatggggaagtaccatttccaaatgtagattttttggagagagatgtcttaaacatcaatcgttcttcatcagaagatgatttaccagggtcagaaacggacaatcgacgtgataaaccaagttaacttcatttttacttcttgtgactgatatggtagattttttttatcaatggaattctttttaaaaacaattttgtggtgtaagcatcctccgcgcaagggcaccaaacactttaatataaatcgatctgaaagaagaacatttgttttgatttttagtgaagaaaaaaataaatgaacgtttagattttcagatgatctcacaagaaccaaatccagcgaatgcttattttcatactgattactttgattggaatattgtaaatgaattaaatccagatgttattgaagcaaaagaagattcaaatcaaatgtccaaaattatctcctcttttttactttgtaagttttcaagctacgatttcaatatcattaaagtccctattgtttttcgtcttctcaaacatctacacgtttgtatttcatatcttttaaagtgtcaaagcattctggatgaaaataacaacgaattaaagaagtccaacaaaaaaatacgatcaaaatatgtcatccttcaaaagcaatttatgcgaatcaaatcagaactcaaacgtgagagaacatctgaaaaatgtccaatctgtaaatgtatattttattctacaaatgaacaagaaaaacatattcaaagatttcacacccaattttttgatgcatggcaacatatatgcaataatgagccattagaagattttcatgatgaagttgaacaacttcagcaacaacttaaaaagcaatttgaattatttacgcaaaaagaaaaagaatttcattcactcaaaaacataattttaactatttctaagcctcaatcgaaagaaatcaaacacaaaacgccaaatttaatacttcaaaaaaatcttttttcatatacaactaaaccacaaatagaaaatgaattcgatcaaatcccaaatcacatacaaaacaaagcgcgtgatttcctacttaaaaggaacagatataaattcgatcaaccagaaacaacagaacaaattgaagaaaggatcaaaaaattcatggataaaagttataataaatacaacaaaaagcaaacaaagaaaacgcaaaacgaaacatcaattaaaataccaaaacgtacttcatctactaagtcaattgcatatgaaatttcttatgctattcctcaaagagatatattttctgaagcggaatattcatatccaaatgaatcaaatgattctgaattaaataatgaatcaatgaaatcagtcgatgataatgtacaatatgaacaaaattcgataaatgaaaattctcagaaaacaaaatcatctgaaaaaactgaagttacagaaaatgataaaaagtcaagcgaagtctccgaaatacctaaaaagaattcgcaaacagtttcggatttgagcgaaagtgtaaaagttaatgaatcgaataaagaaaaagaagacggaagatttgatggattcgcttcgagttcatcaagtgatgatgaacaagaaaaacctaaaacaaacgggaaaatgaattttgatggatttgcgtcaagttcagatgatgaagaaaataacaaatccatcaaatagtttcttgtttatgaataaatattgtttttaagtataaatatatcaataacagtttattcatttacaatgtgtttaattgaatattttggttatatcattaaaaatcagaaaatttcatttctttatcgacagtgcgattaaatattttagaagaagtactcattttttacttacaaacaaaaaatattttcgaattttggtatattttgaaatgatgttatagccattgatcatcttctttaagtgctaattgttgaatatcgttattaattgcgtttgatttctcagattttatgtttttgcttgattcattagtgctgctcatttgtaatttggatttattatgtcggaataaaaatatgaacagtgaaataacaataagaacaattgccacggaaacacaaatgattgcaatcattgagcctttggatattgttttcgaattattactttcgctttgatcattatatatatataaattcgaataataactaatgtatgaatgaaggtaataaattgtataatcgaaaaatataaattctgtttgaatgtatatgacacttgagccaattttagatataacaaatgtgtttaaaatcgatttctgaactaaacttaatgacgcagaaaatgtcaatgaaaatgttatagaacgagtaatgtttgaattaaaaatttgtgactcagtaaatgaattcgatttggtgaatgaattactctgtgtaaatgcatttgatttggtatatgtgttactttgtgtaaatgtatttgattcagaatatgtgttactttgtgtgaatgtttgcgttggtatttctttgatagaatagtgtgttgttaagctcattctccctaatttatcaattgcaactgcatgaatatatgattcttcatttgtaatattactaatggttcctgttgttgtatttttggtttgatttaatgtattggatgtaatatttgttgattcataattatcaataatataaagatattcacttattgttgaatactcaagtgaaacattattagaataatatgttgcattattattttcaaatctaatcactcgatacataatttcatttggatttggggttattaatattgttctattacgataattgttttcatcagtcatcgtaatatttggtgcgtttggttcatttatgtattggagagagttatcatataaaaaattattcgttgttctttggtatacataacaaatcgaattgactatgagttttcgctcttcctctgttatattaaatggattgtgtcctgtttgaatcatagctgtgttattgtatgtagttaaataatagtgcggatttccatatcttgtttcagaatatcccgtaagattccatgcgtaactttctgctgctgtgaaatttccttcgtattgatcttttggaatatcttcagttcgattacttagctccatccaaacatcgccaaacgcagcattttcggctgtgtgtgtaattggtatcgaataatttgattgattgatttcatatggatattgtgtaggtaatccgactttcttaacaaagatttcacctgaccaatgacgccatttgtcatttatagttccatttgaacattttatggtttgtgaacaatttgcagttccgagtttaattccaaatttatcagcaatgcggccaagtccgacttcgttaccatattcagcacccacaacatcgtgaccaagcacgacgccatatccaagatcaatgtactgtgaaacaagttcaaccgcttcatcatttattacgtctttgccattggaatcatgtatgccaaagaatataacatcataatcgaacatgctttttaattccatattttgaaaatcagaaatattaattaatgttacgttaatgaatttgttgttggtatcaggaattttatttaatggattataagaataatttacattgtcataaatgtaccacccaccttccagccaaactttcaaacaggctgatagttgtgttgtaaaatttgtttgatcttcagagaaaaagaattttacatttggaacacctatacttagattggcaggataaacattaagtagactaatattttttgttgtgctagaatcaaacgaacttacaggaagccagttttttccattatctacagatgaataaacaatgaaagttgtattttgagttgagttaaaatcactccaatttaattcagcacgagtaccatcaaagccaacactgagattgattgcaaaattatttgaagtttcagccagagcagaacaaaaaaggaagaaaaacaacagaccaggaaagtgaccacagcacattttgtgaggaacagttgcaacttttgaatataacctgcaaaattcacacaaaattaagattggcattttttgtgcgtgctgtttcccaaactgcgttccagatcattcaaaaaactgtttttcatatatcgcttttactaaatgatatgtgagataaccatcagaaaccatcactgccttttatatactatgggataatttgcaactcaatttccaggtttcaatgagtgagttctttcctatagggatagctatattatattttatttatttatttatattttatatttattttaaaacttacacatttttagttaaattcataaatttaaagtggagtgacaaacttatgctcttcaaaatcgacagcaaatggatcttcatcgatatcatccattttcacaatacttttacaactatcaatttctccatctttataattatgttcctcaacgatttcttcaatactattgtttctatgacgattaatgtaaatgattaccgaaataataacaataattataacaactacagctgctgcaattccaataatgatataaatgttaaattgattttgtttttgatcatttgtttcaaattgattatcataaacatataaataatttgaataaaatttttgaaatgttgtaaattgtataattgtataatcataataaataaatattgtgtttgtatatgtaatttctgaattcataattatatatgtaaatgatgctgaaagaaaactattaacaacacttaaagattgagttataagtattgattctgttactgatcttagaatagaaattgaaaccaatgaatcatatacagtttgcattgtggtttcttcagtttgtattaatgtttgttgatatgttaattgatacgaatttgttaatgtatatgaatttataaatgttaattgaggcgataatgttaatatatttgaaattgtatccgaatttgataatgttaatatcggtgataatgttattgattctgtatttgtatatgtatttgttaatgaaaataagttactgtatgataaaactggtgattgtgtaatagtttgacttagtgtttctaacgctgacaatgtaagatcatttatatatgtatgagtgaatgataatgttggaataactgtttgtacatttgttgtagatggtattaatgataaagaatattttggtgattgtgaagacgttagtgacatttcttggacttccatatatgaattagtgaaagaatctattttaacattagtattagataatgattttgtattagattttgttattgcagatgagaatacatttatatctacttgcgttgttattgatgttggaacatttgttattgacattgtgttcgtttttgtttgagtatttgttagaacttttgtatttgttgtcattaatgttctgataattgaaaagacataagtccctgttaatgttgatgaacttgttggatatgatgcttttgtttctgactgagtgattgacgaaaccattgtttcagaagaagttaatgattttgaatatgttgctgatcttgttagtgttgattcaataagatatacagtgactgatgtaatgagaggaattacaatataattaggctttgctccagaaataattaattgtccaattgtaggacttgtttttgtttcagaatttttttctaacataactttattggaagaaatattttcattaattccaatttttttgtaatatgttggtggaataatagtttgtaaattcaactgatttggtactgatgttgtttgagtttgtgttactgtaagtgatggaattcttgttataattgatgcaacagtagtatatgataatattaatgcatatgaatctgtaggagaagcgactaatgttgttgaccctgtatatgatgtataataaatgacagaaattgtcggtgaaagtgtgctagatagcgatttcgtatttgatgttgtgtatcctacagtgagtgtactagtatatgtatttgtactctttaatgatgaagagtatgtatttgaactacttaaagaactaataaatgatgtcatgatcgattttgataaagtaattgatgacgaatatgtctctgaatttgtatatgtttgagtaattgaggaaacatatgttattaccaaagtttgagaaagtgttgatacatatgatgaactttctaaatttgtatatgaaataacagatacataagattgagttacagatggagattgtgtaaatatatcaatttttgtttgtgtaagtgatgatactaaagtgttactactcacgtatgtatttgaaaatgtgttagagtatgtgtttgacattgtatataaagaaacttgtgtttgaacaaatgtttctgaaggtgaattcattaaagaatatgattccgtgaaatatactgattcagtaagtgtttgagacattacatatgtattagacattgtgtttgtataagatgaaattgtcgtatttgtattaatattcgttttttcatatgtaggaacgatttgataagaataagtaaaacctagtactccaggcttattaagcgatatttgatatgaaaactttaaggaaaataaaagagccaacagtattggggagttgagcttcattgtcacaatgataagttttgaatgagcatattgaaaggtatttttggaagaaattaaatttgagaaaaatcgtaaaaaaattgaatatatatgaccaaaaattgagaagtccctgtagataatttaaatcgaaaaaagtgataattatcggttcaattgaatcattaatatgaaaattatcgcacatcaaaagtgtaataaataaatgacaattcacacatccaccttctttaaaagttaaaaaaatttatttataaaatttactattatcattaaacatagatctatcaacctgttttgagtatatttaaatatttaaattttatcacgcatgcgtgatttttttttatggagaattcatgagctgttgtacataattcccacagggaaaccgaatctggtcatcaaacattttgataacacaaagaatgaagcacaaaataatttcatgagtgcgtagtgaaagtatcataagtcaataagattttcacacgactaatatttttattcatatatattccattataaccattgatcttcttcttttttaactaaattttgaacatcagtatccacatgcgaaatctcttcgggaataatcgccttttcaaacgattctttcgtgttatttgatgatgaaccgggtttacgatgacgaagcaaaaatataacaacaaaaacaattaaaacaaataatacaactgcgcaacaaattatcgcaattaatacttttttggaaatggtgttcgtattaatttgattgtgttgagaaattgtgaagaaaaatgagtaaaaacttatcgatgatgaatagtaaacaatttttgtttccttaaaaatcgtatttaaatgagaatgtgaacttacaactgtatttagaacagaaatactaaaaacacttaatgactgtgtaacagtaagagaatatactaaagacattgtcatgttaaacataagcgaattcgtaaatgtattcgaatgtgagaacgtatttgatttagaatatgtatttgacttagtgaatgtatttgacttagaatatgtattagatttcgaaaatgtatttgatttagaatatgtatttgacttagtgaatgtactcgttggtgttatctccatatataaatgcgatgtttcactcatttcacctacatcgtttacctttgccacatgaatatacacgttatcatttataatattagttatgatttcatcttttgtaaaattacaattagtattattagtaataactgtatacggattcgaatcaataatatatcgatatcccaaagtttttattggcactttaagttcaacaatatgtgatttatgtatattattattattatcaattccttctacataatacttaagtgctgtaatatctgaataattattcctaatcagaactgttctttcggtattatttcgtatgatatatggcttgttaagatttatatatttgatagaattatcatatagaaattgatttgtggttcgctgacataaataataaattgtattcgcaatgagttttctttcttcttctgttggatgttctgttttacttcatcaaagaaataatgatcttgtattgatgactgagaaaaggaataaaaacaacttttgaaaaggatttgacttaagtaattacttgattgaatttttgaatatataaccgtcggctttgatccacccacatttcgaaatgaataaaatataaggaatcacaatttttctcagtgttacactaaattatcgacaagccacatcttggccagttgcatacgattgtattttcaattacccagtaacattaacaattggtgcatcaggaaaaaaagtatcatattcaaatacagatcaatgacatcagtttatgcacatgaatcatcacgcgtgttgattgtaattaatcttgtagacaaatcatccattgagaaagttcttgcttgtcttgaaatgctagattctcctgtcttaaaagaagccgcgtttgtatacagtaaatctgatcacaatgttacttttgaagaagttcatgatttctattaatctctaacaaacatactatggagatggtattggttgagcttttcaatcagttgtagttagtgataatctctaccaaagtgaacccattcatgaaccgacattaattgatgttgaaatcacagataaaacgcataaaaaagggttaactatgcatatatgttacttttcagctctgttttcttaactaataaacttcattttgactttattataaaattataatgtcttcatttaaagatacatgggtctagtttaaagtttattgataattggtgcatttatctttttatcttgtttacaaagtaattgaactattatttctttgttatgttttttatgtgcaatcataagagttgtcatatatattttaagtaatttttatgtattattttgaattttcataatattaatataaattttaggttaaacatcaaaatatttttggaattaatatcaataccttcttgcataagaagtaattcaactatactaacattacctgttgatgatgcaatcataagagttgaataaaatactttaaataacttccaaataatatttatgaacttcaatttctttaaacaaatactaaattaccaggataaatatctttaacatttatatcacatttttaaaacacgaatttctcactattaatatttttgattcaaatgtaaaataagtatttcatcataacaactgaacttcttctttttttaaaatttagaatatcagaatcaacttgcgatcctttttctggaataatttccttttcataaataacaatgttttagtagtgcgttaatttattcaaaacataaaaattatcaaaataatcaattatgataattttcttcttcgatgcattcttcgattgacaaaggctcactatttagcaaacgattttccagtcgtttcaacacgcgctttcctttcactgagtcgaaatcgaaatccaaaaaattttcttgtatcgaatcaatgaaagtcagcaaatcattttccaattccacttgtcttaatgttaaatatggatggtccaacaaatctttaattttcggccttttcttagggtctctaattaaacagcttttcatgacatctaacaatggtactatgtcaggtctatcaacaaaaggaaattcgattttatatttcggatcacatatcgcagatattttttggaacaattcctgctgaggaaatggtggcctattgtacactaattggtataaaatacatccaagtgaccatacatcagctggtcggccttgtctgatacgaccacctttatgtgcatcaattggtcgtttctgtaaggactctggtgacatgtaattaattgtccctacttgatgtgcgcgttcaattgatgtggtatcgtcgtatggtgagatagatttggcaataccaaaatcaataagtttaagtgtaccacctgcaaatagaaaatttgctggttttagatctccgtgaacaacattagctgagtgaacagctgaaacggcttcaagcatttcttgccatatgattcgaaggaagttgggatcaacatcttcgttttcgagacgattctttgctataagtgaagcaagatctatatctccaagctcaagaattatgaagattttaccttcatttatgttgacttcactgtctataagcttaataatacgattggaagtttgaaggatttgaagaagttggatttcattgataaaagaatcaactatgtatttatctgataatgaaatgttgacttctttgactgcataaatctctgagtctagtgaaagaactttgtaaacagtggaactgccacccttacctatttgttttagttttaaatatggtcgattattgatcattagaatattattcggatttaaaagagaattcatctctggatcattatcaactgattgtgcaagatcatgtcctttatcaatggaaaggacacgagtgggtttctgttgaaaaagacctttttcggatccaattggcttgataaaactttgaatagaagaggaaaaagaaacatcagtttcttccatttgttcatatgatgaaaaagaagggttatatgaatattgttttgagtctgtacgtgatttctgtttacttttcatctgattttttaaacgtgcgagaaaaatcgaacaaagtttctgaaattaagcaaaacagtttttataaaaacctcatgaagaccgttaatcaaaagtgacgtttggatcgttttctattcaattatttgcctttggtgaaatcttcctgtataataaactattcaaactccaaaaagtacgatatgaggccgtttgttttatttacggttttgacagtgacggtgtggaagagagaacacaaataaaaaatcaaaacaatagtgccaatgacatgatccaagaatgggaatcaattctttgtcaggattccaaatttacagatttttccgatcttcttaaatatctccatgataatacccatttttgcaaatgccaagcaaactgggggcaaagtcaactacacattttatgcgaagattgcacattaataaaaggcggatgtgtttgtctccaatgttttttaaatggaaaccatgaaggtcattccatttatatttctacaactggcagtggaaattgtgattgtggtgatcaattccaatggaagtcatctggtaattgcattcttcataatcaccaaaatgaatccgagattccctcatcaatatcaaatcttcttcaacaaatttttgattctgctgctttacatcttcccatttttctcaagggggattcaaatgatgccattacgttaattgaatggcttttacgaatctgtgaaattggcgattcatatgtaagtttaattgttacttcattaagcaaagggaacatatacacagatattattgattcctgttttgatgctgatcctaaatctatctattcacttgcagaattatttggctgttgtgttaatgatagtaaatttaagttcacgtttggccatgtatattttaacaatctctataaaatcataaaatatatatatgaaaagatcaaaaacggaaattatgaacataaaaaattggttccattaatgaatttaggttttcatttttcagctgattatttgtttcaatattattctgagcattataaatttgatttttgtaaatgttttttagatacattgaaactatatcaacaaaaacaattatcacttgcacatgataaaaatttatttaaagaatgcatatttaacaaaggtgattttccattttttgattcatttgaaataattttatcaaatgaaacttttaaaaatgaacgccaacgaattttggatggtttaactgatatagttttagatgaaaatgcaattttatatacaaatattaaagaaggttcagaagatttacgttttattttatttaacatttataactttagatttgtgaatgtatttaaaggatttgagaaatgtgaaaatttagaaattaaattttctattataaaattcgaaagttatttcaaatcaatttatattgatgataaaattaatgattcattatttaatggatgttctatttctttatattttcctccgtttttcttattaaagtctttattattacaaccaaaggaaaacattaaaacaattttaaatgataatattaatgatgttgataactttttattactttcttctttaaatgtacaacgtgtattactttcattagatctttatcgccatcaagaagcaacttgttgttacgggttatcaacattcttaaaatatacatttattatgaatacttattccgatttatttgtcttaatgcagatttgtcttggattaactcaaaacaaagaaaaaatgattaatacaattgcacatactattggaatatttgatgaaacagtacaaaaggataaaataatttattttatttttattcattttatttcgactttaatatttgatcgattagagattaatgataataaaactgaaaaattaaatcaaaaattaattacaaaattattattccgacaaaagttatttaattcttttaaagaaatatttcaattcgaaggaataacttatctcaaaaaaattaaaaatcatttggatacaatctcaacttcttctccttcaccaaatggtgtaacatttaaattaaagtcgagaactttatgggatccattagcacctatttatgaatcaaatcaaatattatcgatttattcgaaatatatttcgaaatatccaaatgaattaatgccttttaaaccttttactgaagaaccatttggaatggatttacattcatgtttaaatgcgccaacgcttttagctatcgaatattatattttgttaaataaatattcgcaagaaacaaatcaacttataataaatcttttattaacaacatcgaaattttattcgaaaaaatcaaataaaaatttagaaaatataattatcgtaaaaaatattgaagaattaattacgaaaattccaaatgatttcgaatctttaatgtatcaaaaatatcaactccaaaattattcaccaaaatcatttgtcgatttaataagtgaattaggtccaattggacaaaatgcacttatgcaaatgaatatttcatatgaaataccaaaaacaaatgaaactaaaacaacaaataataaattaaaagatttaaagtcatcaattcttcaatcatttaataacaaaatggaacaatttgaaaaagataataatttcgattttgatgaaagtgattcagcagaagataatgaacaatgttctgcatgtagaactaatgataatgaaattctttgttatccactttatatgtataattcgacaatacctttggaatatgataattatggaacaattgaacaaataaaatgttttactttatgtacacatttagtacataaaaaatgtttacatgatatatgtcccgtcgatagatatttacgtaatatatgtttaccgaaacttgataatcgaaatgatttgaaaaatgaaaatgtatttaaagctgttaatgatttcgaaaaatatttcgttaatacaaatcaaatttttatttcattttgtagtatatttataatttatgagttaagattaagatcgaatttatattgtttagaatcgaagaaatatttaatattaacgcgaaatttctttttaaatttaaaagttattttgttgaaaagttctgagtttaatgtgaaagcaaattcgattttccagaattttgttttggatataataaaatgtgattttcctgagaataaatttaatgaaataatgaataaatatataaatgaacttaatggagaagaattatatttattattaagacgaataagattatttgaatattttgctttaagtaaaaatgaggaaaatattgattggcgaatagaattattaaatgaaaatttatgtaaaagatataatataaaatataatggaaatgaatataacttaaagccttttagtttaacaaaacttccgaaaaactttttgcatttaggtaaagagccatataacttttgtcgtgaaattgagacaagtgaaaaagaatatgtcataagtcttcatgatggaactttaattgatagaccgcaacattatgaaggttcaaaagatgatatgcatcttgtaatgatgttaaattctgcgcattcaagaacaattttggtgtttagacaaagatttcatccagaagttcatttgcttttggtaccatctgtgtacctgaacttattaggtaatgaggatataggtttccaaaatggaactgaattgtttctgtcggaggaaagattaaacacgttaactgatgactttttatcaggggaaataataagacatatacactatgtatcttcatcagcatccattgttaaaccaactaaataaaaatgtcttcagtttgatgtttatgaaataaatcgttatttaaattgttacgtctatgaagatattttaataaaattttaatgattgattttaataacatgtaaaactattttaatcgaaaaggatcattaaattcacaaaataattaaaccatatttatacaaaagaactctatgaattagcatccaacctaaatttagtactaacaccttatcaccttgttgagcatgcaaaaaatagggattgagctctttgaaactaatgatttgttatatgatttatttgaaataaaatgacagaaataattacattgaaacaaaacggttttaaaacgaaaaagtgacagttatatacaaaaaattgtataggttgtttgaattcagcggtttgtagcagctctaaaaggaaaaaatgtttcttgataatgattccttgatccaattaggtgttttatttttaattctagcattttatcacataactgaatttgttttaaactatcttcatcatccaaaagaaacaaatctttcttctttttgcatttcaaaggaatcaatattagcatatactgttggatttattgaatacgcaatagagaaatatttttggggcgagtcaaaatcaaatcttaaatctcctttcttttggattggaatagtacttgtaattattggtttgactatccgttttactgccattataacagcaggaaaatcattcacacacttaattgcatatgaaaaagttgaaggtcatgtattaataacaggtggaatctacaaatatttccgtcatccttcatattttggctttttgatctttgcaccagcaacacaaatgatacttcttaatcctattacaacaattatatttatcattgttacatggtactttttctatgatcgaattccaaatgaggaaaaagctcttctcgaaattttcggtgacagttacaagaaatatcgccacaacactccaacaaggattccattcattaagtaaaagttaaacgagtaaaaaaaattattggtaaatttcatattataagtttatttatatgatatacatttatttaaaacatcatatttttttatgataagtggaaattaatttttgaagaatttcaccgcaaatttttgaaattaatacattttgattattattcgaataattttaataaaatcctaagttttttaattgcataaatgcattattcaattcgctcaatatcaaaacaattcacctttgaataataagttttcattaataataatatatattcaataacgaccaggcctttggtaacaataatggtcatctctgcgtggtgggcttctttctggttctcttcttggaggtcttctatcttgctctgggtatcgataattttctctatggtcataatcataatcaaaattccttggatttgggtaacgatcatcatagtggccatcgcagtaatcgtcgtagtacctatcatctggtggtccttgtctataatattcatctcttggtggataatactctggtggtcttcttggatacatattatttcttggacctctttggaattcttcgtatgaatattcctcataacgtattgattcatacattggaaatctgtcgttccattcggggtttctattttgttgaggatagcgaccgttaacactcctatcacttttttgtctgaatgaattttcctgaaatctttttggcatattttgggcgctttcaaattgattctctttttctaagctatcggaatatagtaaattattcaatgtttcctcgcttcgagttctttgtttcttcgggaatgtaacattagctttcctcacttccatttccattaagtcagcaggaggtgggggaacttttggtttatgctccgaccattgattattaaatgtatcgaatggaccagcaaaagattttacaagttctaatggaggtggtggacacatgttttcagggatatcaacatcttccaaaggcacgtaatgaaatttaagaagacatgacggatctattggtgtatccattttgactttatcgcgcattacattcatcgatttaaaatagccatatatcttcttgttcgcttcttcaacttcattgatgtcgcggaaaggaagaagtggttcgtaccatttcattttatgagggtttattagtggtgcgcccaacttttcgaatgtgagataaactgatgcttcagctacgatgtcgggtggatactgataaaagagtggactaccttgaagatcattaagaaatctaaatgacttttcgcagatttcttttttgaattccaaaaataattgatcactcctggaaatatgccaatgtgttaaattgtctgtaaggtattgaacatttggataaggtaaagggatgtcaaaatgaaaatctagtcgatatataatatcattttctgcttggattaaattttttgttaaaacttgccggaaatctggatccttaatcgaaagcaatttaagactgggaaccaagctaataatgttgctttgcttttgagcagtttctaaatcaataatcattttttgaagagatcgtggtttatcaaatactttagaggcaagatgcaaagaggcaacttgaaagtaaatcaggcttatatcatcttgtcgctggccttgatatgtttttttaaaataaaacattgctgatgctcgagcaggaggacatgaaagctctggtggctgttgtgcaagaaacatttgaagggctattgtgcttttagctatatcttcgggaagttcgtagattttgtgccttcgcttgctggtttctcccattgcactttttaccggtggaaagcacttttttgctaaaaaaataacaacagaaatctcgatttatatgcaaattaaactttgaatatataatgaaccacaaggcataacaatggaataaaataatttaaattgtttaaaatgttttggatttgaaatttaataattcatatttggttacttaaattcaatcttactaagagtttttcaaacaggttttaaactgatttttatttgataataaaagttgtttaaattttaaaatatatttcatttcaagatttgaaaattcaaaaattcgaaaaattaaaaaattaaaaactaaaattacactgcaaaaaataagagaattaaaccacagatttatttttgtggaaacaatgtttgtcgaattccagcttgaattgcttttgaaaattcttctatcttgtaaggtccatttccttctccaatgatatctggtataaggtcaatatcaactccgaaattccttaaagcaccttcaaattgagctcgcgtaattgtccctttgttgaatggatcaagaactgtaaacattgtttttatattatcaggagaaaaacaaatgaatatggcttcatttgaatcacgtgcttttttaatatctgataataactgttcaagaaatgaaactgggtcttcaggctgtgaatatgcaattgctgttgttagtgcttgtactagttgtaaaatccttttttcttttatatattcttttgcactttcttcgttatggatttgattcatcaaaaaaacgtataaaaagtgacacatgaaaaaataaataaaaactcaatttcattaggattttttccttcttaaatttacttcctatgaaatccagatccaccatttaaggcccttatgttctaaaacttcactaaaattttcccctttaatttaacttatttcaattatttatttggattaactctttttaaaacatatttttttatacatcctctaagaatttttaaaataatttacaaaaaacttttgatttgagataatttaacttttaaattatgttaacggccaccaaatattttgccatactttcattttttgaatcaaatatgatcgaatttaaaagtgcattaaccacctcgcatataaaagtgccattttaacgccagaaaaaagaatttcggaggtttacataatagtaacaatttaattttttatgagtacaatcggtgattacaaagtaattaaaattcttggcgaaggttcattctcaaaagtcaagcaagtcgtacatattccgactgggaagcaatatgctttaaagataattgaccaaaatttaatcagagaaaatcaaatggaaacacaattacaacgtgaaattgatgtcatgtcaaagatgagtcatcctggtctcattaaattacatgcagttatgcattcttcaaagtacatatattttgttcttgatctagcacaaggcggtgaacttttcaacaagcttgctcaagatgggccattaccagaagatgctgctcgttcttattttcaacaacttattgatgctcttgattatatgcacaaacataatgctattcatcgtgatctaaagcctgaaaatcttttacttgacaacgaaggtaatttaaagatcgcagattttggtctttccatattttccaataatgaagaccaaatgcttcaaacccgatgcggtacccccaattatgtagctccagaaattctctgtgccgatggctatgatggccggccagttgatatttggagtgcaggtgtcatattgtatgtcatgcttgctgccgccttaccatttgatgctccgacattaccagagcttgcacaagaaatcattaatgtcaaaatcacgtatccatccagctttccgccaggtgctgttgatctgatgaaacacataattgttgccgatcccaaagttcgatacaccattaaacaaatacgaaagcatccatggttcagtgttaattacaatcgtatcaaaggaaaaatcaagaagaactcgaaaattcagtcttcgaatgttactgaaatcaagaaagacaaagagcaacaaaacgaaggcgaaggaattaatgcgtttgagctctttgctaagatgtcatctgttaaaatggatcgattagttaatagcgcagtgcccgtaaatgcttcgacgacattttcttcatcattacctatcgatgagatcaagaacataatcaaagaaacactaatgagcataaatgcacaaataatgccaacgaaggaaaacaaaaacgtactaaaggcttacgtacaaatcgctaaaggttatgtacacattagaatcgaaattacagaggtgcatggaacgaatttaatagagttcaaccgattaaagggaagcaacttcgacttcttaagaatttatagaatgttaaagcagcgattgacttaaaattaaaaattgatttgaataaaatgattttttcgtgaaatatttgcaataaattattaagttatcgaataattattgtggcaaactgataaataatatgatacattttttggaatttcaatcgtatggagaaatgtaaacgcaaagaagaagaaaaaacaaaaaattaaaattaaggtactttacttagtatcccttgtgatatcttaagttctcagaatttcttatttgacatgcctctaaataatctccaaatgtagcctttcctcttttcatgtcttcataaacgcggtgttcataatcaattgctttgttatatcttatataagaattatccgttcgttcaaaacctggatcaggatttcttgttcttgaaaaattcattccatacaaattttcattttcataagtagagttttgtccaaatggttttctatccaatccaaatgttgaatcaacaccaaatggagaatcgttgttgaaataagagtcaaatgaacttgaagcacccatcaaaaaatgaagcttgtatcagctggaaaattttttatatttaaaatcaactttttctgggacaccggacaaaatcactacgtgcaaatggaaaattttaattataaaatttgccaaagatctttgtgcattcaatttctttattaaaaagtgcttttctcaattttacaaccatcgaccgttaatttggtgaaagctgcaattgtctatgcttgtttgaccatctttggcagacgtctttgtggcgtctctgcgatgtgatgaaaactttcgactgaagtcatgatgcaacgtcatagttactctgatcgcaaccttttttgttgtttgctgttttataaatgatattgaataatattcattattgtataattttgaataatatttttattgcatacttggtaaaaataaaataaagtacttctgggaatgaatttcttattatggttatatcttaagtgaactagttttagaaaaatataataacaaattcattaattttaattatgtagtatagcaaattaagagtgccctaataactagcagataatgtttaatattaagagtaaaatatgcaacatgttttactaaaagttttgattcattgtttcgtttttgaaattgaattgcactaaactaaaatttcggcggtcattgtcacttttcccggtatttaatgagaggaaaaatagtaaatccatgggactgtcctccagctcccgatggtgttcataggcttatccacctctcaaatcttcctcctctctgtaacgtttccgatttatctccaattttccaaaattatcaaattgaatattaccatctatttgaaaatcaagctttggttcaatttgctgatccatatctagctcaaaactttttggcaatatatcgcgataaactaacaattcaagattatccaatcaaagtttcaatgtcgccaataactcatttaattttttcggcgggtaccaaaatggccccgtcacctgttatttgtattcaagtaatcaatctccgagtttatttaggcatccaagacatttatgatgaatgttcacattttggcaaagtccttaagatcatttgctttgagaaagctgctgccaattcctttatgcaacccattggacctgagcaaccggttaaatatgctcttgttcagatggcaacaattgaacaagcctcattagtccttgccaacttatccaattccccacgccatcttccatgtttccaattccgtatacaatattccaagaatcatgacattgttatcaaatttaataattctaaaagttatgattttactgatccatatgccaaagcccaatttacacaactccgagaagccactgcaggcgagcgccccttttttgtttttgaacccaatagtgaaatcgattccgtatttgatttttggcgacctgtaattttcgatccaagttttgttcgaactctcacagttagtaactataatgaaaacaccataacctttgataagttgcgaaatctattttgccaatacggcccagttcaacgagttcgattcttttacaaaactcgaaagacttccatcataacattccggaacagcttctatccgcgacttgcaatgacatttttgcaggggtgccccgtagattctacgcatcgattggtcattgaatgtactccgcagcatccgaactttcaggttagggaatataatgaccacagcgggcaggactacggatattatgaggaagacttggatttggatgactacaaagctttgtctttcccatcacagtatgtgatagtgaaaagagtcgacattaaacagatacaattaccacagggagctgaactgttggaggaattgaatttgattaagttccaaaatgtttatgaggcggcaaactttattatgacttgtaatagaatggtaatcggtaaagaaatggtgcaaatggcattcgcacagaaaccaaatggaattaaataaaaattatttgatttgtaattgatcgcaactttgaacaacgcggacaactgttacaatgatatttatcatttaaatgaacaatttttattgttgaaaatatataaaaaaaactcgctgaccgggaatcgaacccggatcacaggaacgacaatcctacatgataaccattacactatcagcgatctgtttttaaatttttttatataatgaaattgataaataatggaattttgcgcttttggaatgaagacgtttattttcaaaccaaagaattgaatcccgccttttatgtaccaatttcgatttagagaaccaataaagctcaacacatcaaatcctgaacctgtatactttagtttagatgggcgttttattggttcaatttttggaaatacaacaatagaagttcgtgattgtctttcattacaaattgtatcaagaatcgaatgtcctgatgttatatctaccttcctttggtctcctgactctaaattaattgctattcttatggataaccagaagtcaatacaagtttactttgttgaaaatttacgtactgacgaagataaccttacaatcccatatatgggattatcaagtggtattattaacatcgaaaaaatgctatggtcacctgattccaaatccattttactttgtggggtatatgcatcacaactttttatcttcgatattggatccaaatcagttcatcgtcttccttctcccaaaaactctgaaacagctttttcattttcaccgattggtaatatgcttgcaattttagttcgtagttcaaatggccatgatgaagcagttgtttttgaccttaacacttatcgccgcaagacaaccattaacttaaacacgcttgatgccaaaaccgtttattggacatctgatggtttgacacttattgtcattgatgagatttcacatcatttactacagatcattaacatgaagactcaacgtgttgtcgactattccgcttatgatgggtatcttggcattacgaatgcgattccatgtcaaaactcaaaaattattgctgtcggcggttatgacggttatgtacgtttacttgtttcaagtgattggaaagttttggccgaattccttcatgaaacgaacatttccggacattctataagtgtttatgtagaggatgattcagaaatgcgttttgttgaacctcctgtacaacttgaaaaaaatgaatttttgagcggaatcacaaatttagaatggtcaaactcgaataagtttttagcaactacaaatgcagaaacgccaaaagctgtgtttatttgggatattgaaacgatttctcttgtgtatgtgcttgtgtttaagaaagatgtagaaatgataaaatggtcaacaaaagaagacattttagccatttcaacaggaagcaactttttagcgctgtggagtcaacaaggaaaagtttggctggtaagggataacaaagtcaatgaagtaaatgcaatacaatggaagcaagatggaagcgaactattggtcattgacaattcatcaaaaaattttgttgttatgtgtaaataaatgttttctttaaaaataggataaaaaggaccattttttgatctgcttaaaaacggaaatactgtggatattaattcatacaattgtcaatcattcatggttatgattatttggctcgaaaccagttctaacttgggtcaatatttgaaaaaggtcatacagaaattgttaaattacttcttgaaaaagaaggaattgatattaatgctaaagatatttatttgttttatttaaaatttatttaaataatttgatatttcaaaataatatttggaaattatttaaattatttaatacagcacttatgtttgcatctcataatggtcatatagaaatcgttaaattacttcttgaacaagaaggaattgatattaatgctaaaaacaaaatttattttaataatttgatatttcaaaataatatttggaaattatttaaattatttgctacagcacttatgggagcatctgaagatggttatacagaaatagttatattacttcttgaacaagaaggaattgatattaatgctaaagatatttatttgttttatttaaaatttatttaaataatttgatatttcaaaataatatttggaaataatttaaattatttcaaacagcacttatgtttgcatctgataatggttatacagaaatatttaaattacttcttgaacaagaaggaattgatattaatgctaaaaatatttatttgttttatttgatgtttattttaataattttttatatcaaaataatatttagaaattatttaaattatttacaactgcacttatgtatgcgtctttaaatggttatacagaaatagttaaattatttcttgaacaagaaggaattgatattaatgctaaaaatatttatttgttttatttgatgtttattttaataattttttatttcaaaataatatttggaaattatttaaattatttcaaacagcacttattagagcatctgaaaaaggtcatacagaaatagttaaattacttcttgaacaaaaaggaattgatattaatgctaaagattttatttgttttaataatttgatatttcaaaataatatttggaaattatttaaattatttgatacagcacttatttgggcatctgtaaaaggatatacagaaatagttgaattacttcttgaacaagaaggaattgatattaatgctaaagatatttatttgttttatttgatatttattttaataatttgatatttcaaaataatatttggaaattatttaaattatttaaaacagcacttatgtatgcatcttaaaaaggtcatacagaaatagttaaattacttcttgaacaagaaggaattgatattaatgctaaagatatttatttgttttgtttaaaatttattttaataattttatatttcaaaattatattagcagaaagaatcttttcagaaattgtttttttaaggatagtattattcacgatatcaataattggaattaatcattaaacagttctgaaagaggactcaacaaatctttcggcttgaataggaacactggagtaaatattctacacatttttcgattgttctttaatgaattactgaaaattctgttgtaaacattcaaaattgaaatgcattgaaaattgccatcttcgaaaaattgttttgttcgccatttgaaattaatggaaatgttctaatctcaaaatttatttttggatgatttatcagtgtgcagtactacgttctctttatgtcttaaatcattatttcaatttggaaattacttcaaatttaaaaaaaaattattacacataatcttaaatttcattttagtttaattcagcccactgttgtgggaatacagatgggaattcagtatcatcgaattcaccaatttcgtcaatttctgtctgtgttggcaagaacaatcccggatcaacagtgcagtacactgcagcagccgccaattctttcacctgtgcgcccacggttaatgttccacttgcaatattctgacttggttctgtatgctttaaaatttcatctgctatttcctctctttcttgttttgtctttaacatttcctttaagtcttgatccatagtaatttcgatatcatcaccttctttttcatatatctgagccttttgtttctctatcatatcatgccaaccggtaaatggttcaacatgaatattatttattatttcatttaattttttcagagaaggggaacttatatactttaaatctgttaaataaattggcgggaactttgacggtttgtcaaatggttcatccgacggtttccagtcaaatacattgaattcttgatcgagaacaactttttgaaagaccggcttggcgccaatttttgaatcctttataaaaccgtaggaatgcttcattaaagattggaaaagtaatgtaatcgattcttgtaaatcaacttctttcttctggttagcttcactagctattatatttaacgcagaataagaaggttcaacttttttgctttcaaggaagaatgaaacaaatgtaaatacaacttttaacattttcacatctccaatttttgtaattgaagcataaaaatctaaaatccgatccatttgtatatcattaccacaagatttataaaatctttggaaaccattttcatcatttttagctaacataattaaagactgttcaacgcctacatcgctcgagaatgttctatctagttcatgagttgaaccagtcgaataaatataaggcgctattgcatacaaagcggtgttgtaaattttatttgaatcgccaaaaacgtttttcactttttctttgagcaaataaataattatttcaaaagtttctttgattgatttatttgtataagttgtattcaaaagtaatgagattaaacatggcaaatttgagacgtttttatattccgaaatgaattgtttacacaaatttatattgtgaattgccgctgaaactaaagaagcatgaacctggaaattacattgtaatatactacaagacgcttgataaattaactctgaaggttctgcatgacttaataacatatataattgttcaagatgattataagcatcttcaaaattatttaactttgtattatttctttcaaacaagtttgcaatgtttctagggtcagacaaagttttaccggaagtgatttcatttaatattgtcgaaattataataattgatttaattattgattttgtcaattcttgagatattggataatttaacgagtaatacatttttaatgccattgaagctatccaagagtcaccacaattcaaaccccattggatcaagaataatgagatatcagataatccggtgaaacagttaattatcgcctcatataaccatggcccgacagtatcgaaacttcttgtgattaattcggttttaggctttgccaagttaattgatgcatttgtagtgagttttgttaacttagtaataatttgtgcacattctgattcgaaatatggataatgtataacacaataagccaaaatataatgtacatttaattgtatagaagaaactccttcatcgataaaactaattattaagtttaatatgaattgcataaacgtactgtattgtattttcgaagttaaaccattattttctttttcatcatcataatcatcgtcaactaaatcgccacaaacttgagctaagaatgcatggaaatcaaataatgtatctaattgttcgatttgtatttgtcgataaaaccaatgtttaacgtttaagtaattaatgaaatgatttattactatttctgtcttttgtgtataagcgtataataacaaatctttacatttatcacttaatgaaggattttcgaagttaatattaatcacatttaataagaattgttcgatagcattttcgaatatcgtcttaagaataatagtaattggatctgataatggtaataaacaatcaagttttaataataattcgataaatgaatgtaatgaaaatcgttgataatattggaaacatccttgataaataccgatttgatcacctttattaatgaatcgttcattccatggtaccattatttcgacaaagaatcgttggattacatgtggattatttaatgccgaatttaatgcttggcgatcattttccaaataattaattttatcttttgttactttatttgatgataatgattttaatcgtattgacttaaatgaacctttaggtaatattgcttgtaatgtcttttgatcttgtctttgtttattagttgttatataatcaatgttttgttgtgttgatttctctaagataaaacattcattaatgaattgttcacttaagaatttaaattcttttgataagatttcattaatttcatatatatcaatatgtacaaatttggataaattcgattgtattatttcacgatgtttcattaacttattcatgaaattaattgtattatctaatccaaatgttattaaaaatgttgtacaactaattatgaatacaaaatcaaatgctacaatacgttgttcaacgatagtactaatcatatatttataagctatagctaataatgaacctaagttttgatatataattgtagtaaaattaatatcatcatcattttctggtaacataattgttgtagatatataatttaagatattatttgttgttatatctatgaattgtgatgcaattccataaaagaaattatattctggtactgacttttcaataaatatttttgttaatacgatgaaataacgtgaatataatgtagatgcaaattcttgatttttagatgctattattattaatccttcattctttaaatattgatcaggtattggagctattttacaccaataaacaaatgctgattgaaatgctttcgaataatttgatttagtcgatgataaattataataaaaaatataattagtttcattagatacactatgattagttaataatttagataattctttacgtggtaatatacctccacaatgatatttttgtttttctgataattctttaaatatttctttaatagctattgcaaaatcatataaagaatttgaataatttgtatcaattttagtttcatctactttaaaattgggacttttttcaatagttttaactttaaagttataatccataaatgaatcataacaacgttgtaagttttgtgaaaatgtatcacctgaagtttgcattactataaatgaattatctaaagaacatttataaaagaaatatgtaaatggtcgaattttcccaattaaaaagtttaatatatattccgataatttaacattagcgcaagataataatgcacaatctgcgatatctttattttcgattttaatatttaataaacaatctaaataaggtgaaggatcatcagattgacttgaagttgctaatattaatgatacaatattaaaatagaaataaggtgaagaagataaatccttattaaacttaattacttgtgataaagcatcgaatacttgatatttataattagcatccattgtagaaccaaatgctgataaataaaatatatataataataattgattactacctccaacatcagataactttaatgattcaactaattctttcttataatcaggtaatattgcatgtatagcattatctcgtgctaaattagatgcaattaagttatcatcagaaaagaaattatagattgatgaattaggtattaatgaagaagttaaaaatgataattctcgtatttgataatatggtgcacagataccaattgatataatttttatataaattgttgtcatttcattattaattggaatcttttcgaaattaattgtttctaaaatacatttaaatgcattaattgttacatataatgattcaaatgttaaattattaatagataacttatataatgatgttaatatttctaagacatattcatgctttaaatgtattgatgcttgtaatatccttaaagctgtataactattttctgttgaaccattcgctacaactttacaaacatgttctaataaatcaaatgaatctaataaatatggtacaagttgtaatacattaattgcaaagtttcgtgaactaactttaacaaatgttggtgtgaaattaggtaaattagttgcattataaggccaattttcttgttcaatatttaatcctttcttccatcgatttaatatggttgaaacaaatgttttaggtcctgttaaattagttttataagatgcgggttttcgacttaataatttatgaatatctaaatctgttttatcatttgatgaacaaatgttttctaattgttttgttaatgataatggaatataaggtgaacaatcttctttaggtatattagaaatttcacttgtacatttctcagtaactatcattgtgaatttcttaatggattctggtgttacataacttgaatattccaaaaattttgattcttttgataatattcgagaaaacactaaaaataatgcggatttgatttcagaatatatttctttatctaataacttctctaataatgtattacaaaacatagtaaaatcattcgaagcaatttgtaatattaaatcaataaataaatcaaatgttttcttggaatataaattacttatgttatttataatgacttgtaacatattatttaatgtttgtgtatctgatttacatacccatttaaagttttcatgtgttttttgtaaaatgggttttggtatataattctgtaaatacattacacgaataaaagcagataatatttgcgtttgattatgtggcccatcaattcgtttcggtattttctttgtgatgaaatctttaaaattaaatttgtccgaatatgtcgacatgaatgaatataactcaaaggaattcttgtcgtcatataatttgctcttttctaatatttggcggaataattcatggctgtgaaagtttggaatttgtttaagcgcttgtccacaaacatttaataagaaacttgctgattctgttcgacatgtacctgaactaaaatatccataaactggattggtgatgttggtaacttcattgatgttcttaaatttatagacaatgtgtgataagagtgcaagaaacaatgatggtttggaattattttgggatgcaaaaatggaaaaggcttcttgtacggagttgaaggactcttctggaatgacattggataagaatgataatgcttttgaccaatgtttggcaagaattaaatatatttcatactcaatatcggaattatgcttgataagtgagtctttgatgatttgattataaagcttggtggcactggctttatcaaagttatcaatattgttgagttcttcacataatgatgctattgtatttgaaatgaaaagattaacaacatacattattgatgcacgtgcatattggttactccaatcaacactagataagtgttgaacaagtttggattcacatgttggcttattattttgatttatatcaatttgtggaagagctgtacgaagactttgatatgattccattattgaattggcgccaattttaccacacgtatatactaattcttgaaatgcattatcattaacatgacttaaaccagatataaattttatgaaatctttgtcattttttgatgttgatccttccatggccgtttgacatagtccaacaagtgcttgtaatgagttatcaattgttgataaaataattgtttttggtgtcgccatgatttaaccaaataaaaccgttagaattgtcaaatgaattgctgttgtttctttactttacagtggcactgactttttttggtaaattcaattatctttgtttgaataaagtttgtgaaattgttgaatctcaaaaaaatcaatttttatatgttgctacaagttctttagtataataaactgtggagaaaacagtaaaattaaaatatatgtaattttaggtaagtaattaatttaactgaaaaaattctctcaatgattcacaatttaaaggattatattaataaaaaaatcaagctcattgttgaccatagtaataagatgatctgttaatcaacatatttaacttaaatcgttgtttttaaatcaacattttcagcatatcgcttattttactcaaaatattttctcatataatattttgtgaactttacttgtggaagccgtttgttaaaaaattaaacgtgcgagaattagggatgtttgatttcgatgattctttttcatttggaaaattaaagtattcagatgaagaaaaatcaaacagtcatggattaaattcaaaagaaaatttttcatattttccagttaaatcaatatcttcacctcaatttcagccatttaccaacctattcatatgtgttacaaaagcatttcacctggttggatgttctatgacttcactgtttttgaaaattcggattatgccaacaattccaatcatcgaaactcaaactgtttggtgtataaacagtgacgtaaattttcgttgtggatattcacttgattttacccaacaaggatctttttcactaagtgaatacactccagtcattgaattttatcgtagatacaatacagaatctgaactttatgccttttcacttcttccactttcttctaaagaatctgttgagtgtgaaggtaaacctcttacatttttatacagaaatcaatcaattgatcttaaaagtattcataatggtcaaaatgttggtataataacagtaacagttgctcttggttttcctgagaaccaaaagtacatagatcctgattttggccgtcctatattagatgagtcaaaatcaaatgaaaaaccagccacagataaacaaattaaaaaaagcacgcgcaaacaccacaaacattctaagtcacaacacaagcatcgaagtcggcataaaaaacattcttcttggtctctcaaagcaattgccaatggatggaacccgccaagctatgtttcatccgattggaaagaaaaagcagtatccaaaggatggaagccacctacttctaacattcattctagtattggtgttgagtgtattgtgaacgaacagaaaaacgtttccatcaaatgcattcaaacagagtttcacaaaattttcgatgtagaagaaaatcaacaaaacaaaacaaatatagatgatttagaaaatgaaattgacgaagaagatgaaataatgcaactaattcaccttatgaatccgaacaaaaataaaaataaaataaagaaacaagatgatagcatctcatcatcagaatctttaccaaaacaactttcattgtcatctcctaaatgtttgttttcgaattatgaggaagacattaaacttactaagacgccaattataacacttttcgatgtacaagcaattgaaataagtgatacaacagatttaagcgaaatttcatcaagtatcgaaaacattgatgatttggtaaatcaatcctttccatcaaaggctagtagtgattcaaatgtatctgaaattgatgatttgtctgaaccaaatattcatattcttgaaaatttcaaactgagtgaaacagaagaagaaagtgaaaagacaaaatctattgaatctgttttagagtcttcaaagaagctaatttcagatacaaagattagtgatagtataacaattgaagatgaagagtccgaagaaagttcaagttttgatgccgatgaaattgtgaaaagatttggaaactttgacgatcctgagctgaaacatttgttttctgtttttatgggtaaggaataaatttgtatttagtatgcttttgaatcatgtgaacctgcgtcatattgtgaccgatattagcagactttcgactgtttaaattgttactttcacacagtgttttcatcggttgttagattctctccaaaacactttagttcttggaatacaaaataatgaaaaaaggaatattcatggcagaaattattgtggtacagcaattatggtttaagccatctaattctctcttggaccaaagtgttatgattatatacgaaaaatattcacattactgaatcgtagaaatattcaaagacactttaaaccagcaatcaacaattggaaattatcccttgttaaccttatatattttactggtaaataacacaaacgacaagccccaaaaaggtcttcttatagaaatactttatcaaaacctaccatacaatgatttgaagcaaataccataaattttttctgttccattgtgcattcacagcatttgatatcaagaaataaagccattcaaaatattatgtaaagttttgaaaataacaaaccccaactttttgtatgttttccttcatgttcaagaagaatttaactgtttctgatgcaaacataagtgctgtgcaaaataatttaaataattttcaaatattattttgaaatataaaataataaaataaatatcaaataaaacaaataaatatttttagcattatcaccataatttgatattttttgttttatattattttttcggattgtttttacatcatgtcactagttattgtataaggggccccattcaaaattcaatacatttgtctgttaattgtgttggaacaaactttttgaacgttaatcattcaaaaatctaagatgacgatatcatcttcttactttcatttttttgactgcttcaaggtaattttctgtcacttttcaaaaaaaaaaaaaacgttgtgttgtagccttgtgaacatcctccgattgcaaaaacaataaaacgcatacctgtaaaagttgaataaactaacaacgaaaaggcgaagcggttgaagctatctgtatcgtttttgactgatttattagcaagtttccgaagttttctcacaaatgtgttttttcttcttggctttccccatgtatttcttttgcttattacaaacctctccacaaaattcaggttcaaagattattcgtgatcaattatctattttccaaacactcaaacactcgccttaccttactttagaacccaaaagggataattactttatattctcaagtcataacaaagagaacgtatccagtaaagtcacaagctttgttatgttaaaaatcgattcattatcttttaacatcagcacaagaaaaaataagtgtcatttccctttattagaattaccgatttcatatgttaaacattatttcaggctcttttctttagtattaaatcatttttcattaaaagcaaatttagcaatttcaatgaataattgcttcatgaagaaaatgttcaaattctgtgaaactgttcaagttctaatgtataacttttttattttgggatttttcttattttatgaacttaaagttttaattaacaaaatgaaaacaagcgaaaagaaaaaacataaaaatgttttaatttttgttatatttttcgtgaattcttttcaaatattttatgatggtaattcaacattaacaataataaattcaaatgattttaatgatattgaacaatataaagatatcacgaaatttataattattagtgaaggaatttatacaattccaagtaattcattttcaggatggacaacagttatttcagttaattttggtaaatcagtctcagatattgggggttctgtatttttcgttatgtttaagtttagaaaatattatttttggagaaaaatgtttcaacaattggcggttcagcatttttcaatctgttcatcaatcaaaaacgttacgattccaaattcagttacaatgattggcggttatgcattttcgtcatgttctaatttaagaatattaacacttggctatggaatcagagaaattgggaattcagcatttggtaattgttattcacttgaatgcatttattattatggtgagacggaaccagatattggaataaatgcatttcttaatgttacaacaacagttataacatatccaacatataaagacaatacatttgcaggattacctgttgtttctggttctatcgaagggaactgcaatccaattccaacgaattcattttcatcatcacatacattcagtcgcagtgatacattcactaagtcaaatacatttactgaatcatttcaaagcgatttaacattttcatattcatatacattaacatatacattaacgattacttatttatttacatattatgagacgcaaacaagatcactttcattatctatagttaattcaacattttcttatatcgaaacgaagtttatttattatgattacacagttattatttattcaacgcattttaattattattcaaatttcattacaatgtttcacacgaacattttacagacaaatggacttacgactaatgttttaattggaattgtttgcggatcaattgcatttatattaataattgtcggaattgttacgttcttaataaaaagtaataataaaaaagaaaaatcgatttcaaagttacaatttaaggacacaacgacatcaagcacaaaacaaattgaggaagtaaatagtttagttgaagatattgttaaagaagatgaagacaattggctatgatttgactgtaaaataaaatttatttttatttgacatattttaacatatttaaaaaagtatgaaatgattcgcaatgagaaatggaaattgatttacaatttgttattattaccaatgataaaaacaaagataaaagataaagaatattgatttgatgaaaaatttgttagatcaaattgaagaaaaaagttttcaataacaaaaagttttatagtatataaataagtattacctttctaagttattaaatagtaaacattcagttacatttatttagataatcattatatcaaaaatatatcctttaaatgaaaaacactatattatatatcattatatttaaagttaattaaacttactttataaattcaagctattttgaaacatcattgatagaatagaatatcatatgaaatatatttatattcaaggaaatgtttaattcatttaatttatatcaaacaaagtaaattaacatttaaaattcaatatctcttgaaaattatgaaatttcattttttaaaaaatgtttaccagtcacaaagacatatcattttaatcaccaaaatcaactctaacacattcattcattatcttatttaaaagtgaccttataatcatttaattcagcatcttttgtgggtgtttttaaatattgaaacaaggaaatttaggttaaattgaaaaacttcaagaaaacaacgaattttttattgattaaccgtgcgatttttaacttttgtattggccgatgtgtatttagtaaaggccttcaactatcagatcgtgaagcatgaaaatcctttttttactgttcatttcgaacattacaaagcattctagagccgatacagcaccaggaaatccattttttaccactataaaaatatcaaatatgaaaaagaaccaaaacaaagaaaggccaactcataaacacaatgttggaggtccaatatctgatgtaaagaacaaaaattttgatatatttaacaataattatattctctttaaaacatgtttattttcaaatttcttgactaacagtaagcgtacatcaataatacctcaagtttttaacgacaaaataaaattcccagtttcatttttttcaattaatcaaaataaatcttttatagccagaatgcttattgaaaacagcatatcaaaacaaactttgaatagatgttatgggtgtatctctttgatccagtgtaaatttcttggtttttcattgatgcgaaacgacaaaggagaccgaccatttaaattcaatgtcattgttcatttaaccgctgttttttcaatgacattagtggtttatatcaatttttttcagaaaaggcatgtaaccgcacagaaattgtttttgaccaaatatgtattgaaaacaagcgaaaagaaaaaacataaaaatgttttaatttttgttatatttttcgtgaattcttttcaaatattttatgatggcaactcaacattaacaataataaattcaaatgattttaatgatattgaacaatataaagatatcacgaaatttataattattagtgaaggaatttatacaattccaagtaattcattttcaggatggacaacagttatttcagttaattttggtaaatcagtctcagatattgggggttctgtattttcgttatgtttaagtttagaaaatattatttttggagaaaatgtttcaacaattggcggttcagcattttcaatctgttcatcaatcaaaaacgttacgattccaaattcagttacaatgattggcggttatgcattttcgtcatgttctaatttaagaatattaacacttggctatggaatcagagaaattgggaattcagcatttggtaattgttattcacttgaatgcatttattattatggtgagacggaaccagatattggaataaatgcatttcttaatgttacaacaacagttataacatatccaacatataaagacaatacatttgcaggattacctgttgtttctggttctatcgaagggaactgcaatccaattccaacgaattcattttcatcatcacatacattcagtcgcagtgatgcatattcttgctctaatacatttggtcaaagtaatacatattcagtatcaaatacatttagccaaagtaatacattttcaaggtcaattgcatttatcgaatcaattcaaagctatttaacgaaatctttttcatatttaataacttttacattatcaattacgcattcatttacttattttgaaatacaaacgcaaacaatttcgctaattacaattaatttgtcgtatatttatatagaaacagaacttatttattatgattacactgttattatttattcgacattttacaattattattcgaatttctttacatttatttatagaaatgaaatccagacagatgataataagacgaaaattatcattataatcgtttgcgttattgttgttgttataataataatttcattacttattatattattgattcgaattaaaaacaaaaaagaagaaattgctgaaaacgaaatatcagaacaacaaagtgataataaccaaaattcaaatacattcataacaggaatatctatatcaaatattgaagaagatccttttgcagatgattttaaagaagataaattcattgaacaaatataattttaaataaaacattgtctgtaataaatgaaaatcattttttcgattttgagaaactcctaaacaatttataatgttgtttaaatttgttcaagtaattgttagtgattctcaaagaaaaatttaagcatcggtaaacatatcttaacatcataaaatatttttgtttttgttttcgtagttgattgaatttgactcatatcgtcttgtacacagaatcaagacctttgccagaagaacatttgacaggttaaattgttctttcgtgttgttttgattgattgaatcgacattcccacaaaaagtatcactttttaatagttcaaaatatgggtatttgggtgtgtaattgcgttacgaagtatttcagatatgttatgatcagaattatttctggtagattaaaaattttatttaaaagaaattttataagaaggctcgttggttaaccaagtctgttaacagcctctaacaaatgtgagtacaaaatatggattaaaatcaaaagcttaaccagaaacaaaattaaaaagtttcgtttacctatgattattcaaccattagtttttttctaacgaaaatatgtaaacaggatgtcaacaatgcttcttgaagaacaaaaattcgatgaaaagtcagcggcttattcacttttttcattgatttaactgcaataatttaaaatacaaattctgggttaattacttaataaattcagataaaaccagataacataaatctccataaataataaatatattttttgagtcgtaaattaagattgcttcaaaagaacgcgaaatccagaagaaaagaaatttcatttcacttaacatgacatttgaggtgaaataaaatgattcggttttggaagcctagcacccccaaggaaaaggaactctctgaccttatgggcaagatacaaaaagagagcgacaaggcccttgtttctttgcttccccggctcatcgaatttattcctgaatatacaaaattaattttatcaaagctctcatccaaattcgtagatagtttaaagggtaagacgccagaacttactgatgctcaatgcgcaattcttgatcttctttgtgtatttatgcaaaattatgatccacaaaacccagatacaaatccttataatcttttgtttagtgagtcccatttccttgataatctattttctcatgtttcaattcttgatctccgtcttataatggtcataacaaattgctttgaatttgatccaatgcgctttgttggatggataaaaaagaactacaaagctgtgtgccctttgattaaaatggcctcagaaacccaaaacattgagtcctcaaaattagttcaaagattaacagtttccaatatgaaagaagtttatccactgcttgcgccattcatcaaaccaatcctcccaacgtttccggtctctgttgttattgattttatgatcgcaagtaatgaaatgaaggaaattatcccagaatcaaagtttgaagattggcttcttggtcacccaaggtttactatctcggacatagagtgtgttaccaagttttacaacttcatctggcttagtgaaacaacaattaaattaatacttcgctcaacgccacctgaaaaggtcaaagaaatagtatggttccacagccgaccagctcaaagcattaagctatctgaagaagtcttagctgaatgtgaaaaaagattaattgataatgaatttataaatgaagaatcacgcgatgatgattcaaggcgtacaacttatcactttgttcatctttttgctctttcatttgctgatccaaaccaagtttctgaggaagttatgaaatttgttgtatcattaattgaagatgaaaatgagtacattgcttctgctgccatccaatgcttcataatgtgggttaacaactaccaatataaggtcagtcctcacattgcatttacaatcgcatcaataattgccgatagagagaagggaccgtttattaacctctgtcaagccgctttaaccgtttttgcaacgacacttcctgtttcggccgcaattttgactgaagatccttctttaaggttctctaatagctctgtgatacaattaaagagatccgcatggacatttccacactttgtgaaaatattgaaatcaattgctacaatgaaggtcatcgactataaccaagcatacaacgcattgggatatgtttctgagtttctatttgatggaaactaatgtttcaagaatattttaaacattataatgcttaaatcagttttactgtttataatgtcaaaatgttacaaagtatgtctgaattttatatattggtagaaagcaaggtaactaataggaaaatttccaagccaagttatttataggtaaattcatgatatgcgcaaagatcaaaatctcaaataatgaattcatcctcctcataaatttcagcaaacatgtttttatttcaaataaatattatttttattctctcactgaaaataaaacattcaggaaatatatttatgccattagccaactatttccaaatattaggccacagaattaagtaagttggagaaaagatatttttaattataccctcaaaaaggcggacctcttcctccaagaaatgaatatgatttttttttctggaagaaaatgaatcattttattctttgttaatattacttgtaagtgaacatgaacacataaattcataataaattcgaaatcaagctttcaacttgttattctcagaaagattttttttaaattattttgagttatcaaaatatattactctctattaatatatgagtttaaatttttttgtgaaattaatgtattttctgaaataaaaaggaaaaatatatttttacaaaacgaccgtttattaccagatgaaaaaaaaataaaatgcagaatctccaattgttattacattttcaccaatgacagctgcttataaatggatctaaattttgttatttttcttatattaaatttgttttcatatctttatgcaattaattttttaaacatactttaattctacctaaatcatcgtatatcgcactcccgatgaattcatcccctcctgattaaagtttgtgcccccttgtgtcaaattactttcaactttatgaaattctaagatattaaatttatttcaatgccattttgtaccaaaacaatttctctattcaactatttgaagacaggcattcaaatacaacttctacaaaatgatattaaaattggaatgtatttgttttaaaaaagtaaattaattgttgttgccttgtttctgtggataatgcaaaggcatgaaacactgataaaacttaaattaacattatgaaaaacttggaatagcttaagaataccaaggatgataagcgtttgttaaaataatcaaatagcttataaatctaaatgaaaaaatcatttttttgttgttcatttatcgagaaaatatatttgttttttctttttgaataaatcgactagtttggacatataattcgcttccaagatactgctggatacaagaaaggagctgtcatcaaaaaacaataaggaattttaaaaaaaaaatgttcattgtttatgaagataatttctgtgaaaatatttttgaatgaattagattttaatttgactgtaaaaggcgaaaatgaaaagagaacattatcatctcacttatcattgtttatgactcatatcgatcaaatttttgatgacaatttcaatttcagatggaaaacaaccaatttcatacatttttgatgaaaatttgaaggttttttgtttgagttaaaatcaagaatatatcttccaattccaatcatcaaattgatgaaaaaatatgaaatatatctattaatgactttcagcattcgttttattgactatatttccaacatatttcatgatgaaaatatttttcataaaaatataaaatatataaatttcaaaaacaaaaatgaaacagcaaatcaacagatccataacgaatatcctcattatatgttcaataataacaaaaatcattcaaataacaaaattttatttttctcatatgaaaagattcataaaataagttataaatattatcatttattaagtcatttgtttacaaatttatttgctatctttaaaaaatgtttcgaattaacttcttcttctaaatttaaaaatcactttatttattctttgaagaaaattctattttattttgatatttatataataaataaagtcaaaatattttatattttattgaggaatttcttttgtttcatatttaaatcaacaattaaaaatttatatattattttatttttaattatatttaatattctttttcaatttattaaatatttttataaaagttatttaatttatgataaaaataaacaaaatttcaaaatatttttgattttaatgattatattttttgttaatacaaagcaatcatataacgaagagacaaaaacactcacaatatctgattccattgattattcaaatgattacaagaatgatacagaacgtgttataattattgatgttggcgagattgaaagtaatgcattcagagaatggcctttattaacaacagtaataattggagaaacagtcggaaatatcggtaatagagcatttgcatcatgtacaaaattagaatatgtccaatttccagataaattaatgagtggaattggaggtggtgcatttgcagaatgtatttcattaaataatattacaatccgttgtaatagcattggtgataatgcattttataaatgtacaggacttgaaacaataactttagctgtaggcgtccgaaatattggatcagatgcattcagaggatgtacaaaccttgtgaatatttatataccaagttctgttacttcaattgggaatgcatttttagaatgtacgaaacttcaatttattaatgtttcagaagaaaatattggatattcgaattatgaaaatgatggcgttttatatgataaagaaattacacaaattattagttatccgaatatgaaaagtaaaacatttacaattcctaattcagtcatttctattatgaattatgcttttgcaagttgtaataatttagaaagaatttttattgatgaaaatgttcaatatattaattcatgtgcatttgttaattgtacatcacttcaatgtattcattttaatggagaaatttcaccagaaatacaaaatgatgcatttgtcaacatcaacgcgacaacagttatgacaatagaaacatatcaaaatgaaacatttggaaatatgaatgttactaagggaacaacacttgacgaatgtctcccgccaacacgcacattcactaactcaaatacatttacaaaattgaatacattcactgaatcacttccatctgatgcaactttatctttaacacattcgttcactttaactcagtcattatctattacactttcgattacattttatagtaaatacataaatacaatttcattgttaacatttgaatccacttatagttatatatcgacaaatgtcatttattacgattacactgttatatattattcgtcttattatagttattattctgacttttatacattagttgtcactgattatgatgatgcaccaaaagataaatcgatctcaaatgaattgttaattggtattatatgcggtgctgttgtgatagttttgataattgtcggaatcgtaatatttatgattaaatatcaaaataagaagcgaaaacaaaatgaagaagaaatgaatatttcagatgaaaataataataaaattaatgaaatcgataatacattttcagttggtattaataattcaaatattgaagaagatccatttgcagacgatttcaaagaagaaaaatttataaatcagatataaataaacatattttaagaacaaaatattttaatttgtttattaatttcatcaatccaaacttttatgttatttagcaaattttatatttcttctattatatgattattatcgtaaatccaatttatccaaatcataaacactaaaagtaaatgataaattatattaaagaaaaaattggaaatttagagatattatggtaaaaatgcaatatttttttaaaaatcaaaagaaagatattcaatttcaaataagtgtgcgtcttgagtagttctgcttttatctgtgataacttaagtttgaacaaaaagtaaattattatgaaaataacaaatatatcgttaattcattgtatctaattaacgcattttttaacatatttatgaagtttaaaatcattatgcaaaagtttatcataattttcttgttgttttcctaaaatgatgagcgttcatcaatcaaacaaagtataaaataaaaagttttttttagtatagaccatggtcagcttgatgtatgaaagcttacaattttacttgaaaaatgaaaaaaattgtatgcatccacctccacttcataggactttttgaatccatatttcttcattgataaaaagttaattttttcgtttgctattagtattcattaatggtcttaattattttcaattttcttgatagttaacaagagtttgtcaacaggaaaattcatgatcaaaaaaatatctataaaaatttatatactaaaacatgatgtttattttgcaaaacaaaataaaatattataatattactatagtaaaaatatgtgattagatgatcaacctccttcttttcatctctgtgttatagttttattttttaggaggtaacgatagatgtcccttcagaaaatttgtaattactttttcaagcatatacacttaaaatataaataaaatttgatagtgaaaattatttggctagattcgggttatttgagtatataacttttatttgtataaattgaatatttcgaaatttgatggaaaaattaattcataattttttgattatttatacatattaatatgcacaataacattgctaagtatactatcaggtttatttcaaaatattgatttcgagagaaagtacatttattatgaaaatttacatgacaaaagatcatcaagactcacccttctttttctcttaaaaattttatataagcatttatatatactaaatttaattaatttgagatatttaaagatttctttcgctgaatttcgagaaaaagtagtattttgcacgacggtttaaaacccgcgatttatcattcaaatattgtacggttataaactttctggatggtcattaatcgtcggtgaaagaaaatttgtaatgcatgcatattctaacaactttttctcaaaactcagcagaagaatctcaataaaactttgatatcatttcaaccaaatcatcatcataatcatatttgaaaataaagaagaaaaaaagggtcaattttttttatacttgatttaaatattgcgtttttcaataaaattgcagcttttggtgtactaagaataaaagaaagaaatcatgttctatatgtaaatttatcaatgatactaaaagggttaactttgttaggttactcaaaaccgaattcataaaatctgatgaaaaaatagcactttttaggaaatgattcacttttacattttcataaccattaaactgcctgtccaatcccttcaatttatgatgtaattatgtgtaatatgatgcgcgttttcataactatcgtcatcgaccacaattttgatgaacgtttaggccttaacgtgtttcgcgaacaaattcaaatttgaaaacattttcacctggcgaaaacaattcaaataaaaatctattttataagtacaaacttgcagcgaaaattatgtcgcgcttaatcaacttgattgcctgcattatcatcagctccaaatccgagtcacccatttggtttgcagcccttgctgtttgcctcaatatttcctctgttcttttcattgaccgaatcactgctccttcgaagaactgcgggttatcctccatcagctgtgcgaactcagcgccgcctgcccaattgtacgtcagcagcataaacgttgggtctatatttttcatgtaatcatcgaaattcgtattaataccactttctctacttatttcgacaattctctttacgatttcttttgtttgttcccattgttcgcttaaatcttctggtatttccgcctcttctttagatccactatcacatgcgaatatacaaagcaatgaagcgatttgttgtggtgtcaaatgctttaatattccatcgaataacatttctgttatcactaattcatcaccagctgatattattgaggcaactctacctttattagtgatcaatttttcattatcaacaaatccaagtttttctaatacgttttgcatcgattttaagtcttcttgcataacagcggcgtttaatatttggattctttgtcttaaatctttaatcttttgttgaatttctcgtttctctttatatttatttatatcgaaaattgtaatatcaacaaattgttcggaaagttttcttaaatttccaattttttcgatgtatgaatcatatgtatctttattcttggtgataagatctctttcgtttaatattttaattccttttgatataatcttatctaaactattaaacattcgattaattgttgttcctgaaagttgatcattattaaaatcaattgattcttcactaataccaatgatatcattaaaatcaacagaaaagatataagctgaagcaccttcattagtttggattggtattaatgtctttgttatagtctcttgaccttttaatgctatcaatgcttcattagttttcttgtttgttgttgctactactataccccaaccccaaccattagctacttgtacaattcgacctttagttataaatgttccaatgttttcaggattatatattaagttatgtaattcattattaaaatgttcaagttgttcatctatttcaactctcattctaattttagcttcatttggtatctcaaattctgttattatattattatatttctctaattcattgtttaaaattggtatttgtcgttccatttgaaattgatgaaatgatttccgcattaaatcttcaggctttatttgacttgaacataataatgataataacatatgatatgttatatgatattcactatttaatggttgtgatggtgattctaataattgtaatgtttctgtttcatcatttgtatcattaataactattacgactgatccaaatgtatcattatttcgtcgtcctgctctaccactcatttggataaattctcctccggataatattcgtcgttgttgtccatcgaatttatataatgaatgaaagataactgtacgcgcaggcatatttaatcccattgcaaatgtttctgtagcaaataatatacgaataagtccatgttgaaataataattcaacaaattctttcataagtggaattagtccgccatgatgaataccaatccctcgaacaactaatgatttaagtttgtcgatttgcggtaattttttgtctgattcagataacttttcgatggctacttcagctaattgttcgactttttgtgagtcttcttcagaaatatatgacgtgttttctaatgagtatggtaattcatcacattctttgcgtgaaaatgcaaaaacaagaatcggatctaagtttttgttaactaatgaatctgctacttcgcacgttaaacgatagttggcattcttgtcacttttttgcttggatttcatcgccgataccatcatctgaacagaaatgccatgaaagagacgcttaggctgagaaatttgaactgtaggaaccattgcaaaggcagcttgaagagatcctttatcaacaggaccatcgccttctcgaactttataaagatcaccaccacgtggggctaaataataatttaatggaacagggcgatactcagtataaacaacatgacatggttgatgatgtattttagcaatccattcactaaattctcgagaattaggtattgtcgctgataaaaatacaaatctgacctcatcaggaagtaaaacaatggactcctcccaaacaacaccacgttcaacatctttcatgtaatgaatttcatcatatattacccaatataactcatgaattaatgaatcacctctgtaaagcatcatacgaagaatttctgtggtcattacaagacatgatgcacttggattgattgttatatcacctgtaataagtccaacgtcatcaaattcatcttttaattcacggtatttttgatttgaaagtgctttgattggtgatgtataaacaacgcgcgcgccttttgtaagagcagctttaactgcataaaaagcaattgccgtttttcctgcagatgtgtgtgctgatactaaaactgattcgctgttgtgaatacatgcaattgagattttttggaattgatctaactcgaattcatattgaagaagtggttcctcgggaaaaggaacattttcgattgatgcttgaccgtttggaagagcaacataatgtaaaacattgtcaccttctgtttcaaatttaattgatgttggtccttcgtcttcctttaattcatcaggaagaggaacaaacatttttctttgaccaaggaaatgtgatgtgaaattctttttttagaattttttttttcgttgttacacacacactttgttgatttaaaaattgaaccaaacaacaaggaatattcatcacgattatatatatggccgatttaaaaaaaatcgattttgaaatatattcagggtaatcaaatgaatattgcaaaaatagtcaaaataagcatgctctctcttcgccagctcaatggaaagaactgtgctaaatattttatttttttctcaatagttttgttttaatttcttcttttttttttctaatttgttccaaataacgtaagaactcttaaatttttctactaaaaacaaaggtaatcattttaatattggaacaaaatttctgaaaatgaacaattaaaaaaacatacttctttcttctttttaatataattgagttatagatggcttgctttcccaaaaggttactaagtatttgttttcatttgatatcaaataaattttttcatgaaaaaatttattttatatatcaacattttaagacatcctttaatagaagacattaccaaggaatagtttagtagaggaatatgctggaaaaattcattttttatctctgataattcctattgtaaggtaatcatccattccaaaaaagacgtttatctcaaaagttgtgctttgaattctgcggtaccgctgaagaaatttgaatggaaggaccagaaatagctttttcaatccattcaattgtggaacgtaaacccttgaattttgttaaccttccatccgctcagatccgccttcttaagctgaagaattgccaaagccttttgctatatgaagcagtttgtttgaacaaattttttgagttagcagaagtttttataaaaacgagtaacaaatttatcaaatctctttgtaaataaaatctcttccgctcttgcacaaagagcccagcaagattttgcctagaaaatataaaatattgaaattatacggttttcaagggtgtttcaacacaaatttttttatatcataattcaattttgagtggattatatgacatttgaatataaaatgcaaataccccgtctcatctaaacaatagcatgttttattgctaaaattgtgatatcttttcattattattattttatatgcaataagaacatcgtattattatttaaactcacaaaatttttgttttcatatttgaatgcattcaaaacaagaactgtcggttgtaaacattttatggaagttttagcgcccagagaaattcaacttcttttgggcatatgaaaaagatgcatcgaaatctcttttggatgagaggcttggcacaatgtatccgccgtaaacaaagtttaatattcggcagaatgggagatacatccttgcgagttgttttgtgaagctttgatgatgaaacatgcaatgattagcaatgaagaccatggcttcgtttaagctatcaaatcgtccgttgttgcacatccgaggatcaaatggaacaggtatgactttcattgatttgtattgttgcttcggaagaccaatcgataattcggccatgggtatggtctttttgacctgtggcattgttatgggtggtgcaatagcaaactggttgaggggaatctgctgtggctggaaaaagaaagtcatgattcgaagtgattttctatgcattcaattctttcctttttcagaaagtcatttaacaaaattgaatgggtatatttcgtctcaacggttgtgtttattatgctcatcgtggttcacttttgactttttaaatagtttacttgcatttttcaattccttacaaaacttttattggatttcaaacaaaaaaatcttcatgaataattcttatgatgagaacctcgacatatttttgaagaaaatgatattaaatgcattttatatttaagaattaaatttctatgtagagactataattagaaattttaattttgatattaaatgaaagaagttttgaaaaatcaaatttaattcaaaaaaacacaacttttcaattcaaaaaaaattgagggcaatgtggttcatcatcggttttatgagataaaagttgatgttttatccagaaaattttttgatttcatattcatagagtggtatttgatgccaaatgaatacgtttcccgttaaaatgtttaaattccagtttttaaggatgttttttgaagaattaactatcattatttaagtaaaacgatgtttctttgcaatttattttaatcttttttattatttatctaaaataagtattttattcttccattttgacataaatttatgtgcttaacgaaaaaatatttaaaattttattcattttaatattaaagttttggtttatttatgttgaaagattaaaggttcttatcatatttagaaaatgattttaagaacctttgaactttattaaaatttgtttccatttttacgatagatatacttctgtataagtaatataaaatcaaaagacatcggtccaatagctcctgtaatatatggtgcttgtctccatatataatctaactcagtgcttttaataagtaaagaactaaagtatgttaaatttcccattatgcttaacatcacataaaagatatttaaatcacttcctgatttttctttaacattttttacaacctgtggaatacgagatcctatgtaaatacttgagcctatccaactaaatattgagccaatcagtaaatttccttgataaggttttgcccaatttattgaagatgattgcttggataacaatgcaagtcctcctgtgagtgatgaacttgcagaagagctataaaataaaccactaccatcacttgtgttacttgttaaatcactaatagatgtagtgaaatcgcttgagagattttcagaaaagttttcttctgttgtttcaattttatgtaaaggttcattttcctgttctttagcaaaactattatcatctaaactaataccacttgaatcttctttttcttctttaccacaaaatttaacaaggaaatgattataataaagatattgtaaaaatagaattccatcaagaatcgtgtatataatgtttgtcaacacttgagttattaaaggtgctgtatatattgaccctattaaactcgtaatatctccagttaagattaatgagaaaaaccaaggagaaatacctttaacacgtttaattttgaaattttgtattatttgaggagaagaacaaataacccaaatcattgaggataccaatccaatataaaaactccatttctctcgaacagttactacgcattctctaaatacaatatatatccattcaacataacctggcgaacaaaccataaaaatgttgaaaatcaacaacggttaagataatcaaattttttagttttcgtcacactgaaaaaatgtgaagaaatagttaagattgttaagaacatcaagttttgagaagaaaaattgatttctctgaaaattcttagtactttgctttataacaaggtttatttcatgttgaagataataatataataatgttttcgttttgtatcgcattcaatttttgcaacttttattcagcagcaatctctacggtttaagttaaaagattgcgttttatagaaaacttttggaaagagtttttataaatcaccaaaaattatcaaattttattttaggatttataaaacatgaacaaaaaacttattcattccaaaatcatatttgttatagaaatgaatttgaataacaattacaaaaaagtgacaacatcttcaactacaaaatgtccaaaaaaatcagcaatgaaaatgctcttctaaaggaaatggttgaaagacaattacaacgccttctttgtcaactcaaagatttagatgaacttaaggatgaacttacagaagaagaaattcgtgaaacacgaacagagacaatggaagaacttaatgagtttcgcatcaaccttgataaaatgatttcaggtgatatgacattagttgatcaactaggtgcacttagacttgcaacaattgctgcaatcaatgaagcattcaaaactcctgatattatcagaatgttcagtgctcgccaaacagaggaacttcgagcaagccttgcaaagcttaaagagaagatgcacctcaaatcaataacagtagctcaatacgaagaaaaagcaatggaaatattaacggctcttaagtcattaaatgaaccattgtctgatgaagaagcagcatttttgtccaaacagatgcaaaacagattcagcggatttcaagaatcaagcaatagtgtcaatcaagcacaaggaaaaacacttatatccaaattcggagatcaaacaaagattacagatcaataaaaataggtatttatcaacgaaaaatatattattgtggattcgaatataaagtgtattgaacttggacaggaatatttggcccaattgtatgtaaaatacataaatctgaaggtgataagataatatcacatgattgatcataatcttttccaatgatgaatgaagaaacagctatatcaacattaacgtctctgccatctactgctttacttgtagtgtttgccatgacaaccaatcttttaccaatttcagattccatatcttcaagtaatgaaaatctttcaattcttacatgtccattggatgatggcaatgtgaagttctctcctgattttattactgcaaaatgttgttgctgtggtaattcatttccatcgtccatggtataatgtaatttgccaaataatttgaaaagaaataaaaatggcgaataaaattggctagcattaaatatttcgaactgtctcttctccccaagcttttactttaatatatgtttaaaatctaagcccatcaatagcaacattgaaatgtttgataaagtgaaaattatttccaaattataataatttttttttttttacttcaaaaaacaattttaaacaattaaaaaaaaatcaatccatgattaatttacaaagaattaaaatatgatgatcttggtcttttgacttttctcctatttgatgaaattggagtcctctcatttactctatgtgacattggaatcctcagcactggtctccttggcgtgctaaccattgttgccttgttatcctgctcgatcatagatgatattgaatcgaccaaatgaattggcctctgtgagaactcgagctctttagcgtgtattactttcttttttgttggctttggacttaacaaaattttttgcaattcagcgtttttgttttgtcttgattcgttttctaatatgtaattatcaattgactttttgacgtatgccaaatcaaaatcttttgtaattttgaactcttccatttcgtcttcttcattatttctttcaattttttcatcatcaaaattatcatctttaacttcatctttttgatttccagttatagccgggatttcctccacaacctcagtaaagtgtttagggtcttttttaaaaggtgattttccaacatatgttgaaggattatccaaatcccaattgctttcatcatgaaaaaatccgacgtaatcaaatgtatccactttccatattcttatacacatatcaacaccacatgtagcaataaattttccatttccaataataataattgaagttatttcatcattactacatcttatcataaacttttctttcagctttatttcataatcaccctcaattatttcccaacatttaacatatccaagtgtatcagcggtataaaccaaaccgttattatcgtcaacggtaatcactgacattgagtgctttacacgtatcgaatgcgcatcaaatttttccaaaatttccaacttcggaagcaacaaaatgtacataaaccctaatgaatcaccaaccaaaatgaatgacttaaagcaagccaaacattctatcgaattttccaattttaaattagcttgttggaaattagtttctaatgaccatacgaaaatttccccatttatatcaccggaaactataccattattataattcgttaaagatattatatcatgtttatgacctttaaattgtctaaaaagatcaaattgacctttttcagattccaagtaagcgcaaattaacttatctctatctattctaattaagaaagagttcaaacctatagctataaacatcaaaatattaacaattgcgttatttaaaggggacaatttcacttctgatattatatttccactattataattccacaaataaattttattctttaaagaacaagtaattactcttcttccagttatatctattgttgctgcagtaataacattattattatcatttaagaacgtggttatattattacctttaaacatattccaaattttaaatgtacaaattttatcaattgaaacgatttcttggaattctttcgtataatataacccaatgatttgataactatgtgaaacatgttctaaactttcatttaatgcattgatatcttccgcccatttaataggatatgaacaacatgtaattaaacaatgattacgttcatcgaatccaattgaactataataatcttctggacgaagtattgtttcatcattccattctcgaatcatccgataattaatgatgtcccataagcggaactctttcttaatggacattgtaatgatataatgttcgccaattgtcgtaataaaatttgttatgttttggatttgattaaaatggccgccaagtttaaagatctttttgagtggggataacgtccatacatatgcattacgtgagacaccgtaagtgattaagttgttctgtgtgatggagaattgaaatcccaaaattggagatttattattgattacttgaaatgtagtaaagttgttggtttgtgggtaatacatccagatcttgatggctcgatcatatgatgacgaaatataacaattaatcgtagaaatataactgatttgtgtgatgcgtgatgtatgtatcgtttctcgggttaagcgttggatttgataatctgtgccactacgtcggcgtggtgctattaagctatatacttctaataaaccatgctcatcaccaacaaagaaaatcgaccgtttaagtgtcgtatcgttttcatacaaacagagtgaagtagggatgttgaaaagtggcatttggggggacttaatggactttaagtagatttgcgcatcatcacaactcattttccggattttattggaagatggtgatgcactaatacttattggtaatttagaaagtgtgtcataatcataaaataaaagacgtcgatttgaggttgtgacagtaagaacattaaatgagggaatcatgattaaatgagaaaagaaaccaggcttagtgatacatcgtttaaacgaaagatctgtactactccaaaaacgaatagaatcactactaagtgtgatgtattgatcaatttgattatgaatataaatttgttgaatcatttcatggtgacattgggatttaagaatcggcgcagtaggtactttcttgatgaacttagctgcattacttttggagattttattagtggtgaattctcgcataagataatcaacaagttcatcccaactaatatagccattacaattggcatcaattttatcaaaatatttttcaaattcatcttgtgataattgtccattacagattatattaataaaatttgagtttttccattgatcaaatgtaatttcacctgctttaaaaacatctacagcttcaaattctttttttaattcatctaaaaattgatttttctgatgactttgtctcatgattgattttggatttgttggaaaaattctactagaacctaatgaccgaggtgattggcctctattttggtcattttcatattgtttattaacattaaattttggaaaatcagatttaatcacgtttttagaaaaaagatggcactttttcgcttaacgttcaaaaaagtgcgttttagaaattttggcggaaagtgaatcaaaagaaagatcatttactctatctttctgataaaattcttaatacttttatacacaaataacatttatttattaataactctacttagaaatatttggtaatatcaactatgcatagttaccaaaattcatttttcaaattattgaaattatccaaaaatttaaaggagtggtttaggttgaaccggtgttaatatatcattctaatttattcttcaacataaggttaattaaccttttaaactatatttcaattcattcatacttatgaagtaatttaactatttctgtataaccacatttagatgcaaacataagtgctgtccaaaatattggacaatatataaatttcctgttatgatcgaagcaatgataatattttcatttactttcatccctttttcaaaaaaatgaaagaatatcaaaattacaatacaaaatacatttttctccgaattcttctaaattattaatttcagcaatttctttctcataaagatatttaaagatatcatttcgatgaaattcaattgttgttccatatgcacattcaaatgttgaatgattttgttcacataaatgaataatttcttcatttccacctgcaattgcatatttatatgttttttctatttttgcactattcataagtaaatacccaaaacatttaactgaagaaaaaaatgctgcataatcaattaatgagacatttttatgattaataaatgaacatctttcataaagtgatggctcaattgtttgattaaaatcaaaatttgtttgtgatgatatttcttgaagtttttctatttcatcatttcgaattattttcgcaatatttaatggattaactccttctttttttaactgctcatgaagttcccatttattctttgatagttcttcaaattttttctgaaattgttttataaatataggatcaaaatctgatataacatcgaaattaacaattctgatttgcactaaacaaatgtaattgttaatggtatttgctggaatatattctgcaaaatataaagatgccttattttgaataatattctgatcaatcattgagttttgaatcattttttcaagaagatattttgattcttgtgcattaatcggtaacaaaaatttagtaaatatatctattgtattttcttttgatttatcactaattttctgtaaaaactcaaaacatgtttttctttttgatttgaaacataatatgaatacagaattctacatattgtcataatatatgaatatggaaaatttttagaaaaataatttaataaagattcaactgattcatctatattgtaatcatttaagttaaaaataattgtttcaagatttaataatatttgggtgttttctttgtatttgatagtctgactatgagataatcccatcaaaaatatttggaaacgagttatctcaaaaatatttctgcttgaaggaattcgtttattaacttgttttgaaatgaggtgatgtaacgtctttttcaaagatgatgatgaatgtcatctccgactctagagtcagataaaatcattcataaaaacaaaaatatctttctaaaaattagaagacaaaaatttttagaatatctgaaaaaagattattctagatagctttttttaatttaaagtaaaatttttttgtaaaattattatgaatagagaaaatgattccttttttgactaattcaactattgataaacattttgttgaatgtacaattgattaatatctaaatatgattcaaccaatattttgaatatctttaattttatacaatgaaaaacttatttatttctgaattcatattaaatctcaaattttattataggtttatttcataatatatattaatcagaaaaatatttctttattacctatttaacttcaaaatgaatttgatttccattgcatgcaatttatccaactaattattaatttttttactttttactaaccaaagtgcttaaattgtttcaagtatttcatgattttcacttagagcatgcatatacttttccacaaaatcttctttgatttctttagtagcaaatttgaacatgacacattcatttttaagcatcccagttgcataattttttgaattgattacgacattccctttttttaaaaaggattcttgaacttccataccagggaggataaaatgattaagatacacattatcaaagttttctttacttctcattaaaattcgatatctacccgtttcattatgtttaagaattcttactataccttgaccatcaaagtcatacctattgaatttatattcaagttgattatataaaacgcaaaaagatgtatgaatttctgtttctcctttatcaggatcaccattaataaagaactgattcattgtattttgtatcgtttcaagtatttttgcacttattgttggacgcgcattttgttctaaaggcagttctttgttttcttcattcattagttgaatataattgaatgatatctttatgctgagtttttttatactcataaaaatgataaccaattggttattatatatttttatttatgcaatcttgtttaaatatataaatttaaagagttcctttatttaataactactatttaatggtttcccacattattaattttatttatatatttttttggtttaagtatataaaacctcgaaatgaattttctcagatagtaaaaaaaaaaatttagaactcatataatttttaatatggaagtgtgcctctttccatgaacatttttgcaatttcttggaaatcacctttaattgccatacgaagcggagaccactcaaatcaaaatgaattccatttatatcccttacatttggatcagcacctttttctagtagtacttccacagcatcataattacctttttcagctgcgacatgaagagcagtacgaaattatatttatcaattcccaaagcattttttgcattaatatttattccattttcacatagtaccttaatacaatctatagaattattcgaagcggcataatgaattgaagaattacgatctttatcacatgcatttacattagctcctttacttaacagaagaattgccatttttggcttttcattcttaatagcataatgaagagctgtcattccacaattatcaacaagatcaatattcccataaagtgataacaaaattaaaatagaatataaagaaccagaaacagctgcaagatgaatcggtgtttcaccatgaactgctggtatagatgcattaaaatctgcatctaataacgcatgaacaagatcagcgacatcaggttttttggtgtcgtcttgatcttcatcatttgtacttcgaatttccccacttccatcatcatttagtgcatttggtacaccatatgtttctaaaagtgtaatgaaattatcaaaagatgagtatacagcattgtggataggtgtgttccaattaatgataaataaactttatgattttttaataaacccatttgtctgtattctgttcaagccttttaaaaaagtatttgattatcaataagggttgattatattctgcagcataatgtaggaatgttcggaaattaaaaaagaaaccccaaaataacattataatttctggaattttgaaataaaccatgtctcgaactgttaaatctgcatttccatcaataagtagatcagctgcgaacttatttttacgttgaatggcaagaaaaatgggagcattatgtaacaaaaataaaaaccaaatggatgaaaattaagaaaacatcaaatgaaaattaagaaactttcggtaaatttacaaaaaacgacatttaaatcacctccttcctctttgtatttttttagacttgcattatcttcgtttatgatgaatttagtaaaatccatcgaaagttagaaaaaacgttacaaattttaacgtattcaacatcacttttcatttgaaaacaaggcttaagggctgactagatataaattcatcttttagtaagttaatggattggccagacatcaaaaactgtaaaaaaaaagattgtatagacatatattctattctcaagaatcataacaaatggttgtatctttaataggagaaataaaaggattactataaataaatagagatgggaggaattaaatgtgttaaatcaccatatgttaggtgtaaatatttatcattttcggtctcaacatgtgaatcttcagtatgtggatttttttttttcttgaaaatatatttcttggaggtgaacaaagccaactgcatgtgaaatctgaatatatattaatttgcaaagagacacatttcacaggcatttacattttccatttttaattcatgcaaacaaacttaaacttaagcccatttttattttctatagtgtatagtttaatcacaataaccgctatgttttacgcacgagtttatcattttcattattgtatcaatttttttttattcctctaagagaagctacacgtttctttatcaaagaatttcttttctttgttaatttttcatggaaaattacaaattgcaattttatgttttcatcaaacaatttttagtagttataacatattgaaatgttctcatataaaattatagttgttacataaagcagtttcaatcagttcttttgttattccatttgttcaaaagttgtagttttttatttttaaattttgaggttaagtgttcaatacgtgagcgtaagaatttgtttcaatcttggcagaaaaacttgatcgtacggctcaatttctcatttataaactattcatttatttataaactattgaattccatgtatacttaaaaacaagaaaaaaagtcaatttaatatcacatattttatatagatggatggacaaaaccctcaagggcagtattataccccaactcaaccagtatacacgcaaccttatggatacgaacaaccagtagttgatgctggtaatccgtatgctcaagtaaatcccgatccaaatcaagcgaattaccaataccaacaaaattaccaataccaacaaaattaccaatatcaacctaatccatatcactatcaaccacaaacgggaaattatcaatatgattccgaaaacattaattatcaagatcttcaagttgaacaattctcttccattccatgtgatcaaacttcatattcttgttattgggaaaacccacaagcatttgaacctcaaacatattcacaaaataccaaaaaagaaaccaaatgcaatgatattttatatcttatagtcttcttaatcaacttagttattaccatagttgtctttatttggcttgtatcgaagaaagctccaactgaatcagaacctacaaatgaagaaccaagtgacgttgacaacttcaagagcctactttggaaatccattggcattagctttgttatcggccttgtacttaatattattcatgttatttatattgcagccattccagttatttatatcaaatttgggtttttcataggcgttgtgattagcatcatatacattatctatccaatgattcattacacattatattggttcttatgttttcccggaatattattacttatatcacttcttatgttttgtatctatcgcgaatatataccattttctgccgcatgtcttcgacaatccatcaaaatcatacttcgaaatccatctattttagtcatcataatcattgaaactatattagatttagtcatctgtggaatcttttcattaatgatatattatatccaatatcataacattagtgatgctctttacatatacttagtattttcatattattggatctcatatacatttggttatgtaatgtatttaacaggcgcaggtttagcaggaacttggtacttcttaaatgacactgaatattatccgaagtcacctgtttgggaatcatttaaacgcgcagctacgacatcatttggtagtgcgtcaggcgcagctttatggcttgccatcattgaagcatgtcgtgcgattatcagattggatatatctgattcaaactcaacagcgcaagtgattctgatcattcttaaagtgattgcacattgtatcatatgtataatccaatgttgtttcgcgtggattaatagatacgctttgatttattgcgctttgttcggcgttccatttaaagaaggatgcagaagatttatggagttatcatgcaacagatacgtagaagtgattatggaatcttcaatgattagacatgcgctgacatttaatatgttcgtgttcgtaataggtggcgcttgtctcggatatctgttcggacttttgttggatgataataatgttggagctgtgttttcgacatttttctccttgttgttcacttggtcaatttacttggtctgcgatttcccaattgaaactgtaagtgatactttggtcatttgcttcgctgaggctccagaaagattgaagacaacagcatcagagctatatgattcaatgaaggatcagttctcgaagaaattaaggaagaagatcgaaaagagagcaaataaacactgaaatatgatttgaataaaaatgaaattaataatatgttaaaaaaatttaaaaataaatttcgaataatgttcaacatttattaagttcgaaagtctttgctgcaactttgaaacgaaattacagaaatcacaaaaattgttctataaattagtcaacagcattccgacattactcaataatagataaattttcgaagaaattaaggaaaaaattgaaaaaatagcaaataaattaaaattttgatatgaataaaaacgaaattaataatatgttaaataaatttcaataataaagtttgattgccgttcaacatttataaagttcgaaagtcttttctgccactttgaaaccgaattacagatgaaataaaaaactgtcagaaaaattctatgctctacacaacagtgttcgataaaaagcgttaatattttctttgcgaacgaaaccaaataaggatacaaaaaaaccgccaaccaccaatttttgaccgtttgagatgggcttttcaattaagccgtcattcattttcgggatgtgcaaagaagtcgacatggaagaagaatcagaatcagaaatatcacaaaagaaagctaagaaaagcccaaagattggtgatccaccttctataagtgaaagttccatagatttcgcaaatgaagatttcgaaatagaaagaactgaatattcaagttatacggaagaatttgattctgatttgtcttcgtcttaaaaccttggtactcagatctaataaattttatattgttgataaacaagtttatatttgattaaatttttattcaaataaacaaaatacctctgtcacaacaatttttttaatgtatttccaaatgaaatttttaattcgtcctaatctttttggcaatagattttttcttctaattttcattaatcttgcttatcttaattaaaaaagcaggtataatgttgttgattaaaaagcttatatgaaagtttaatggaaagacaaaaaaatcacattcattgaatatgatcaataacattattaacaaagttttataattctatttctatgtttactatcgcacagatatttaattgctaatttcgttatacttcttgtgtattacttcagttccaattagatcttgttgagttttgccatttgttctactcaaaaagtttgattttaaacatcagaaaaagttatttcgtttttaatttgtgagatttactctgtgagttttactcaaatgtttctgaattcttttcagagaatataaaactatatgaaattgttccaccattcaccagagaatcttgtctttggttgatcgtcttcttcgcagctgagcctatatcgatttcatttgtttctgcaataataaaatcagttgtattgtagatttggaacttcaacttagtcttatagctgcttccaaatgagaagtcagaattccaagatggactgggaccagagattggtgatgtttgctttgagttatctccatttgtcactttgcaagtgtacgtaacacctgctacacctccaaagccactagcactagcgattctaaccttgaggtagtaaaccttcctgaatttccaataaagtgaaaagcctaataatgcaagtaaaatgacaacaatagcccaagaaaggaacttgttgaatatagctctgaggaacattgccttagcacggctttctccaaccttaccttcaacttcaatttcgtcaagattactgttgatgtgttcaatatgttgtctatcttggagtaaagtatcttgagtggcagctgctgtgtttaatgtatcattaccaattgcaattgcgttatctaagttatcaatgatagcattacccttgtcaacatttgattgaagttgcctgttttgtctataagctggatcatttgttaaagcttgacgtttttgacgaagttcagtaaacatctttgaatgttgtgtatggaattctctaatttcttggtcataataagaacgttctgattgtggcattgattttgtttcgtttgtcatcttattcagcattgaatccagttgtaccaaatcttgttcaattttatgatcaagtccttggcgttgattatatgggagtgaatcaagcctttgtaagtcagattgaatctgctcgataaggctttcggttgatgtaatttcgtcgtctaatttctgggttatgctcatctttttagagcaggattggtattataatacggttaggtgtcaattttatcggtttgaatcaatttttataactttttgataaaacatgaaaacaatacgcaggtggtccaattgacaaaactttgagaactttatatgaaaaagataactgatgaaaattttcataatgattccaattatttgacgtttttagattaaaaataagaatcaagtttaaccaaacgcctcaaaaactcctttattaattttatgttccatattgaatctctgtcttaatcagataaacatatggctatgatgaagaaggtacttcattgagtagctctctcagagattgcttcttctttgtgaccgacctaattgaatctctcttctcttttctttcttgtttctgcttcataagtagttcttgcttttctctattttgtcgttcaatcaacgcagtaaactctggtgattgcatgaccaattctggtgttacatttgaattcgaattctgaataacagatcccatatctcgcatagatcttgcaccattagcgttcatgttctcagagatcagaacatgttcccgaagttgggaaagtgttggtctatgatcaactggtaataaacatgttgtaataaaatctgctattatagggtctgagacatcagatatagcctgtggcatgattccctctaaaatggcattgcgttttgtcattggtgaagagtattcattatatggttcaactcctgttgatatctcaagaactgaaagtccgatctgccaaatatcgctcttgggatcagtgattatggacttgacttcaggggcagatgtttctggaggagttccaaataataacatttctagatttggtggtcctaatttaacaattccatctgaactatcaatgtaaatgttattacaacaaatatcaccatgaataagaggtggatttcttgaatgataatgttcaagaccatcaataatttgactacaccaatttccaattgcagaacgtgatgggctatgaacaacttcagcaacatagcttcgaattgtttgcaaagaaaataattccgttatatagataaaaacttttcttgttttatcgatccaggctcgatacaaagcaataagattagggtgagaatttgatccaatgaagttcacaatctgtattaggttgttaaaaccattttctgttgaaccttcaatataaatttcattccataaacagagaattccctcgttttgatcaattgcacgatatgagacttggatcccagagcgtacaattacctcttctcttttgaatcgccctgagggatccacattataatcttccattgtctgacactttccaaaaagtgtcatattattttcattttcattctataaatgctcattaaatttctttattattaattatttagctttaaaattcaaataaccaatgaaagaagaaattgttttttttttaaattaatctaaaatgtatttttcagaataatgtaatttgataagaataattttgaattaccaaagtatttcatttataataatgcattgcatacatttgacgtaataaactatagtattctattttgtgaaaaaataatatttattaatttggaaaaagagattttttattcaaaccccacatttaaagaccgtttatcaacggtcactcatagcattgaaaataaatccgataattcagatcaaatgtattcaataggtttatgtcataaattttacaactgaaacgtttcaatgatctgcacgatattatcagtaaaaacttattataaacatgatttttcaccaagggtttttataagaacaacaattttatgattatccttcagcatcgaattcggaaaagatgttataaaaggcgttcagaacatgtgacaaaccaacggttcatgacaaaaccacaccaattttgagtgtcatagtcgataaaccgaccggattttactatgaaaaagttttgtcgtcataaggttaaaccattccaaaattgacaaaaaatgtctggaaatcctccagcttctgatccaatgtatcaagcaacgataccacttgaacagcaaaatgcttattcgcaaccttatccaccacaacaaggatacccacaacagggttatccaccacaaggctatactgatccaaacatgcaaccagccccacaatatgctccaccacctccttcatatcagccacaaacatacacacaaggatacgttgatccaaatgcacaatatcaacaaggatattatcaacctaacccatacaattatcaaccacaaacagcaaactatcattatgatcctaaccatatccaatatcacgaaatgcaagttgagcaatgggccacaattccatgtgatcaaacagcttattcatgttattgggaaaaccaacaagcctttgaaccacaaaattactcccaaaacgttaagaaagaaaccaaatgcaacgaccttttctttgtaatattattcctcatcaatcttattgccactattgctgtctttgtttatcttcttattgccaaagacatatataaagaaactcaaagcacataccgtccattggaagtattctttaaagaaaatcttgtcaaaactttaggcataggacttgcgattggtgttgtcattaacattgtccatcttctttacatgaccttccttccaggcgtttacattcgtctcggtttctttatctgtgtaattattgcagttattataattatcgttccatcatttatatatggtctttatgttctctttatatatccagcaatctttttgttatttgcattgatttgtttatgttgcacacgtggccgtattgaattttcaattgccgtattaaagcaagcatgtctaattttgcttcgtaacccatccatcttcttatacatcttcattgaagccatttttgacattattctcaattgcgtattttcattaatgatcttctacatccaatacaagggcattaacaatgcgttatatgtctacttagtcttatcctactattggatttcatatacctttgcatatgtcatctacacaaccgcatctggcttaacgggcacctggtacttccttaatgacacggagtacatgcccaagtaccccgtctgggcctctttcaagcgctccatgaccacctccttcggaagcgaagcgtgcgccgccttttggcttgcagttgtccaagcatgtcgtgccattatccatctcaatggcaacaacagccaagttattattatccttaaggtcattgcgctctgtatcttgtgcattattgagtgctgtcttaagtggatcaatcgttatgcattaatctattgctcattgtttggcgttccattcagagaaggctgcagacgatttatggaattatcatgcaacaaattcgctgatgtattattcgaaggatcgatcatctcgttaagtacaacgttccatttgttcgcattcacattggccggattcttcgcaggtttcggcattggttatgcgatggataaggaatacagttacgtgttcatattcacctgcgtattcgcattgttctttacattggcaatatttttggtaatcgacttcccattcgaaggtatgacagacacattgttcatttgcttcgctgaggcacccgaaaaattaaagacatcggcgtcggagctatacgaaagaatgaagaactctttctctgactcaatgaataagaaactcgataaggaaattaagaaaggagaaaggagaaaccagtgaatgaaaaagtttatattcagtttaagtaaaccaatttgaaaaagaaaattttcaattgttaaatgaacaaaaaatattcgaatatggcaacagacttagtgaaatatcaatgtccgccgaatgaatttattttcattacaaatgatattaactcatgcggcggcagaaagagcttcataaatcaaacgaaacattaattatattatgttttaaaaagtcacttttacatgataaatactttttgtgattacgataataaccgctccgataggtttttttgtagtcacttttcaaaaaatgtgttgccatttttttgcatacatgcttgccatatttttagaacttcaggtggcaatgaaagagtctaaattcaacagaacgatttctgcataaccacttgaatatgctttcataagtgctgttttgggtaacttaatgaatttccaaatatatttttatgaattatcaaattattataatatatctcaaataaaacaaatgaatatcttcagcattaatattaatttttttttgttaaagaagtatttgaaccatttctgtatagacatttttttgaagcatttattagtgccaaaaatatttaaaaaaattgtaaaaatttttataaagcgataaaatattcgggtagactgaactacacccccggaaaaaatacgttatttacgatagaggactatagacattttatggtgaaaatgatcgttcgataaaatttcaaataatgattttcggcgttgcaaattaaattatgtatttaatataacggttatattgaatatgggtatagttcagcataagagtttttgctcattttattttgatgatccgtttcatgttgccacccaaatattttaataaaaatttaataaaataaacaaacaaactttttttaattttccaatttttgaataaaacaaggactgaaaaagacgtttattttaacaaaatcaggtatataatgaggtcgtgacgatccagaggaccctaggggcctcactcctcagggggtaggtcaccaaagcatgatttgatatataaacggtcggaaattgtactttaccattttctgatcaatccatcttaatagggtaatccaatataaaaattctgaatatttttgcggtaaaaattaaaaaaatagcattccatttgaaatggatatatatataatttttttaaataaaatgaatattattttttgtgtgcttaagccttaaggagaatctataattccttttgagaaacataaagagcatacatagtatatttattcatggagataatatttttattatatttaataacataaattcatttgtgaattgagtgttttgaaacaatctgtggttttgcaacaattgttctcttgataattttgttcggacttccctgtgctgtgagatgccgcattgttcctgttgctgtggaaagtctctttgaagcatttgttgctcgaattgaagattgattagatgttctgatcggagccgggatatttttcttcctaagcgaagcagttcttgtcagcttaggtgttggcttaggcctagcactaatttccacattactttgatctgatttacttttcgagatatgaggcaaatttgttccattcttcaacaagcgaactgtctttgatatgttaaatgatgggaaagaattatctttttctatgaaactatttggtaacttgaagctatcttcagatatttcttttccaaaatatcggtctatcattctgaggcttatcgaaaaagtgggacacatcggttgaaactgtactggggtgccccgaagccatttgtgattgaatgcctcctgtatcgtcatccgttttgtgcagtcaaccgtcattaacccccggatgaagcttttgcaatcatccgacaagaaacttggaatgacatattcgcctcgtttgatttgtgcaaaaagttcggcttgttttcgctttgtccatgggagttgacctgtaagcatagcatacaaaatgacaccaacactccaaacatctgtggtaactccgttataaggtttcccagaaatacactctggtgatgcataacaaggagatccacacggtgtgtcaacaagcccattcggtgggataaaacgtgaaagtccaaaatctgagaatttcacttggcctgaattacttaagaggagattttctggtttaatgtctctatgagaaacagacatgttatgaatgtattcgagtgtttcgagaatttgtcgaacaaatggttttgcttcttcttcttttaggtgattatggtcaactatgtattgaaataactctccgtttggacaaaactccataattaaataaaaattgttttgatcttgaagaagttcatatagttgaacgattcctggatgatgcatttgctggttaattctaatttctgtttcaaatctttcatgaagggattcactatttaagcgtgattttgggacaattttacatgcgtagtattgatgtgtttcttcatgatgaacaagcttaacaacagaaaaagcgccatcaccaacagtaccctttagagaataaggtccgatttttcttggttcaactactttcaaggcaccattcatttgttattgtaaaccacagaaagcatgtccaaaaagtgcctcgccgatagcgttgtaaaaaagaaagaacgaaaatatttttggaattgcaacgaaattttatatattttatgaatatttaaacccaaaaatcaaaataacagtttctaaaaccaaagatattaactcatttccaatagaatcatcaaaacttataacatggtactgaatgccgatcaaaatccatttaattcgtttttttttacattttgatacaccattaaatgttttaagttttaacaaatgaataatcaaaaaatatttcattttacaccacatctaaatcggcaaatctaaaactcaaagatgacatcaaaattttcatttttataaagtgaaaacttttcattgaaaaaaatcatggccctgttcaaaagtcctattgaaaaagtcgcattttcacaaccaatttttggctatttaaacgtatttcatgtataaaattttccacttcaaatttcaataactttcttcatcgatttcgtcacaaactttgaatatcttttgacttaagttcattgcttcgtaacgtacttcttcaacatcagagttctttagtagatccaaagcatcgttcaatttttcaactaattcagctgagtaaattttagaaattattttgccattcattccaacgcataacaaatatttgaaacatttgacaatttgtaaattcatttgttcatcacatgaattaattaaatcgaaacatgtgtcaatgaattcaacagatattatctcttctatttgttcagtgtcgaattgttctaatgcaattaacaatggttcgattgcgagtttctttagtttgaagtacgtgtcgcatgtaatgatgttgagaagacaatggaatacatttgcggtatacattggtattattaacatccaattggagttaatgatgagtttagtataaagacaaaataattctttgatttcgtgcgattcggattgtgatagtattgaccattgttcaaagtttataggtatggaacacttaatttcattatcgcatttggttaagattatggtaatgaatttcatgacttcaattgtgacttctggatttggatttaataggttttcaaggatgaaatagatttgttgtgttcgaattaaatgatgaattgtatatggctggatttcaagacatttacaatatccttgtaacgaataaatgtttatctcattgttaatcgataaatagctgtgaaaaaattcactgattctgtcaattaatgggaagataatggaattgtcaacataaagaagaacttttaaataacacataaaggatgaaatggtatcactatcttcatgaaatgaaacaagtcctccaacttcttcatatagctgattggtaagtgaatgtacacgtaaatcaattgacgcataatttagattaacaatgagattaagacatgaaagaaaaagttgcgccggtatttcttcatgcatgcggctaagaatttgttgataaaaatcatctgtggcatttgaaagcatgtaaatagtttgatgtttaaaataaaataaccatgcaactaaatcaagtacttctgatgaatcagtgtgctgatcaattaggtttttaaggaatgaaaacaaatcatttttttcaataacttggaaaaattcattaagaaatatttttgaaatttcattatggtagttttcgaaaaagctaagcagtccttctaattgtgattgatttgtttcttggtataattgtttaataatctcatcgaaaaaaagacgaaaatgaacagagtccatgtttgggtcataatttccttttaacattaaagacattttgtgttttttgctgggcattgcgccttttaatttgtacgaaatcatttatcacgagtgaacttcatcaagaaaaaagtggcaagaatttggaaataattaaatcattgcttatgacgtggtttgagctgtataatatctgtaaccaagaaaacgtggtgaggctatgtaataataattgaaaaatctatttttcaaaagatattaatttaaagatcttattgataaaaaagtgaaagagagttcaatttttcgatcttaaagcattaaaaatgatgattttgtattaaaatgtatacgtttttatgatccattaagatctaaaagtattaaaacctaatttctgtaattctttgatgtttcatgcaaacaattttgcttaaattctttcatattgtagttagaattatgttttggactttacatatagaaatttttatgaaaagaaataatatttaatctacagcttcccatttttcaccgcaaatagggcaatttggattgcttgctatccattttctaatacaatgcatgtgatatgaatgtccacaagcacctatctctggtgggcatggctcgagtacatcatctgcttcacactgtgcacatggcccagctataagagatctgcaaattgaacataaatcattatcatttttattgcgtgataaatatactggattaaatcttaacattgtatatcgaggttctttaacttcagtcttttttggtggtggttttcctgttgctggtgaccttatccttgtaggccttggtgctgggcggggtgctgaattagtgttttcagacatattatttcatatcacatatcgtgaaaagtgccattaattggatttgttctttgcacaaagaaatattaaatctattttaaatacttaagtccaaagggtctcttaaggatttaatttcaaattaaaagtcatggtgtattaaagtttgcttcaaacatttgtttttttgaatacagatgatttcaattggaaatttaatatatatgatggttgtcttaattggctttattttttctcatggaactactaataaagtcaatgatgttaatcagcaatcttgcattatattgaatgatatttaaaaacatttaaatgggtttaaataattttttaatttttgatcatactcagattgttcatcatctgtttgtagttttaggcataacctcacgaaaaaaaaaattaacatagaacactttttttgtgttttatggaaagaaatactttcaaaaaccattccgatagtaaaattaaaataattatttattcaacttatgagcaacacaaaagatatagaaaataagaatgtcacagctccttctcatgcgcctgtaaaagaagaatccaaatcgaaaaaggtaaagaaagaacataaagaatccaaaaaatccaaaaagaaaagcgaaacgaataaagaggcaaaaaaggaaacgaaaaaagaatcaaaaaaagaatcaaaaaaagcgcttaaagaattaaagaaagacaaaaagaaaaagaaagcgcataaagaagcaaaaaaaggcaaaaagaacagaaattatgagagaattccaatttggatacacgatacaattgaagatacagatgacccgttttcagatgattttggagatgacattcaaactcctatcggaacacttcaaagctcttaattaaacaattttttaatatttttgtaaagtaattttataaatcttataaaggaaagtaaaaaaatcatttaattttgataataaattatgtcagtacaagcataaaatctactggttcattcatcgatgaatgcattcattattatttttaaaagtgaaatttaatataactaaaaaaatctcacttatgccttttattatttcgctaaacatatcttattggtaaatattattattataaatctatgtaatttattttttattaaataatatttgttttgatgttaatgtattatactaattggtcttaatttcaataatttctaaatattatctcaatataaaaaattatttaaataatgatatcaaattaataggatcgatattaaatattttcataatttacataaattcctgtaagtaatttaacgatttctagatggcctttatgatccaagcaatgataatattttcatttatttacgtaaatccctttttcaatcaaaaacgaaagaatatcaaaattacaatccaaaatacatttttctcctaattctttcaaattactaatttcattaatttcattctcaaataaatatttaaaaatattatttttatggaagataattgcagcctcatatacaccattcagaatcaaatttataaacatttaactgaaggaaaaaatgctgctgtgaatatcaatgagaatattatttatcaaaacaaatttctcatttttaaattcaatacctatatcaaattaacatttaaatacttcatataatttcaccataaatattaaattttatatttttacatttttttattcattacaatctttagattttgacacaacgttataagacacaagatcaccaccattattacctattgaaatcattggtaataccggatgaaacttaaacaccgaatcacatccgatacttttagattggaagaacatttgccccttcaaccccattatcgccaagttttccttctttctcgcaacagcgcataagggcaccaattcatgtatatcgaatccgactatttgctgtttaattttgacgttattaaatgtgttatcctttgtatttaacaaagaacaattaccagaagaagtagcgatataaaggaattctccaccattacgatttatacccaattttattatattttcttttaagtttttattcatgaaaatgaagttatttttctcagttgaaggtactcttatatcaatacctattaaatcaccagtggaatatccacaaaagatttggttgttattatttggatgaaatattaatgaactaatgatatcatgatcagaagctatccaattacccaaaatcttttgcgtttctaaatcccataaattaatcgaattattaccacgtgcagtagcaattttagaactatcttttaatatagttaaatattgttcaattgaatcacatatgaaattagaatcgactcgaaacattgatgaaaaatatttgttttctggtttccatatgtttaaacaacctttattagttgttgatattataaagttatcattattataattaaggatttgtaagtcactaattttcccattattaactttaattttattatcgttactaagttcattatcttcttttaagtatattattgtattatcttctaatgatattactgtgtcaacattagtttgactaaatgcaatatgtttaacattactttcgaatttatatgtaaacttttgttgtaattcaaccgaatttattaatatgtttccatattgtttcgattgtgttttattaacatttatgttattattaattggttcaattccttcgtttttaattgttcgatgttgtaatgtttcgaataattcattattattattcttaaagtattcattattaacaatattattatttgaattagttaataataatccaaatgtatttgtactatttgaccattgtaagttattaaatggtaaagttttctttataatcgaaggaggtgatgcatgaaattgtacatgtttttgtgtattattattattatttgtattagtattactttgttgttgtaataatatcttttggaaatgttgttttgcattttttgcatatgatgatacatatggatgtggatcatatatgaaataatcgagcatattaaatgcgttattaaatattaaacttaatccgtctgttttttgtgtgatgaagttatcaattaatttaataaatgtaatgaaatcattacgttgattataatcataatgaaatgataaccaattatttaataagtcattaaacgtcgaaagtttttggatgttatgtattgatacataaggtttatcttcgtaaatacataagaatttacagattaattttaataactcaaatcgtactaaatatgaaatgtcagtaaagattggaatagataccattaatattaataaatttaagtcatcgtcattaatttggataaaacaacttaaacaatttaatgctatagatcgtacgaaatgtgaattatgatatattaaagaagcgatttgaaagtgtatacttgtctcataaaaaaaactttcttcgatttcatatgaattaatttcaaatgttttacatataaacattaatgtccattgaagtcgaacatttgatatattatttgtcgaaagaatttctcgaatattattaaagaagatatcggaataatttaattgtcttaaattcttattatatattataaaacaagtaataatacacgtgattaaagttttagttttttcatttaaattcttatcaaagatataattatatattttagtaatatcaaaatcttttttaatttgatacattatatctttgttatattcgataacagataaaatgataatacataacgaattatattcatttatatctttaatcggttcaaataacttttggaaatattggttaaatggtataatcgatgaaacttttttctgattctctttcgaacttaatatgtaatcggaaattaatttaaacaaattatcattttccgtttgcttataaaatggcatttgtaataagattaataacattgaaggtttaattaacgttttgttcttgattaaattttcatatatattaacgtcagtaggaaaatatgaaagttttcgtgtgggtaatataacgaaattagatgttatccatgtgtctaatgatgcttcccaattaaaccataacggatgaattgacatattcggtatttttggatacgatataggagagatattatatgataacaataaatattgggctaaaatgaagttatggaacaaaactgagatgactttatcggttcgaaataatttgataaataaattggtcggtaaataatcggcagaaatcgactcaagaattaactgtaatgtcagttttaattcattgttccctaataatgcggtgtttaaacaatctaatggaaatcgtatcgatggaaaacttgtccgataatatttcaaaatatgacataaaatcgaagtttctatgggcgttagtaaacaagaagtcaaaaaatcacgtgggagccgtggatctgctggaagtttttcattggcatcagttgcacataggattattaaatcatcaacaagatcaactttgctggtgtcgagttcattggtctcttttatgatcgatggaattaatgttccggcattatcacaatcaaatatgaaaaatgatggactacgaatttgtgaaactaattgacttattggatatggaacagtttggaattgttgggcatcataacatgaaatactattgtttgttggtaatggatatccatatccaacataatgaaataagattcgttgaagtggaaattcttttcgttgggtggctaaagtcttgaaattgtctttggtgggtgaaaccatatggtaaaatcgtaaagtatgactaatatcttgataatgagttttataaatggaatgaagaatcgtaggaaattcgaatttggaagaggcgtcacttggtaaggaccaggctaaataaggtgaaatacattcagtagatgatgaatgagtgtgtggatattgggatatatgagcaacatcaatattaatagattctatcgagctacagattggaggtatgtaaacattattagaagttgagaattgctctagattaaaatcaaaatctgtgaaaaaagaaatatatggaactttactatcagcagaaactttaggattaattgtttgaagatgttcttctaaagttttttcataagctggttcatccattaatgataaacttttaaatgtttgtgcttttttcatagttcgtgaaaattgtgaagttacaatctctgtttcaagatcttctgatgtttcacctgaataatcataatcgtaatcgtaagacgcaaaattttccaaactcattttttataaaaaaaacgttaacttgacttaaaaaggcgctctcaaaatattgacaatgcccagtttttgagcactttacgtaccattttttctgccttttattttcatctgatagcatttggaaaaaaattcaaaaataggttcattttataatatttatagctaggctaaggtttaagaaaggcactaatttggaaaattaaaaatttttgcctaattttaaaaattaattaaaaaataaataaataattaaaaaaatttcttgaaattgtcaataaaaattgatttgatgaaagcaaaaacaagctttttttttttttttaaatgaaaacattccaaaacattaaaaccaaaaactttttaaatttaattattttgttcttcttccttttgctcttcattttgttgttcttcattattttgtggtgctgctaaagcagatgcaaattgttcgagttgaatattatgaagagcatttggatcaatttgaccattttgtataagagacgccagtgcttctgatgcctctgctgtgatttgaatattttgattatttaaagcatcaagatcttgattatgtttaagtaaaagttctgtcattgcttgatcaacaattgatgttccttggaaatcttctggaggagttcctttcttctttaaagttgaattccatcgatttttaacggaattatctgttcgaccaggaagaagtttagcaatttctgcccacttctttccaatctgttggatggatgatatgataattcgatcttcttcggctgtaaaaggttcctttttaatctctggattcaaatgattacaccatctctccctgcattgtttagcaattcttcctgggaggagctcagcaagtgaacaccatttagaaggaccattggtatttacccaatttataatagtttgatcttctgcataactccatgaaccacgaacaatatttggatttgcgactttcttccaatgagcaagaacttgtttgccagttctgtttggaaaatttgttgcaatttgtgcccaatcttcagattgttgaacaagttttgataaaagttcatcttcttctggtgtccactttgatgctcctgatcgcatcctgtttctagtgcgagtgggagcaagtgctggtggagcttcgttttgttgtgtcggagcttcttcaagcatttcttgtgaagcaaccgttaaattaattgaaatttaaggaccgttaaccgctttgctggtttttggcgcctttttttggggggtgtcaataaatcatacaatacgatttcatgttaatattaatggcgatattgaagatatttgatatgtaaagttacgtgtttatttaacaaaattcaatcgactttttattcaaatcatattcaatcaattaactctgaaattcaatcataaacttaactctgaaagtcttagtctattcaacaaaactttaactcaaaaaaaaaaatattatataaatgcaattgtagatgcaagatcaaaggcatttttaaacttaagttaatagaatttgagtatgttattcttttgaagatttttcccacattgtgtctttatatacatctaatttcacgatatataaactcataataaaaattttcataaatttataccgtgacaacaaatatgtttacaagacatttttaagattaaaaaaaatcgatttcaatttatttaacaaaaatatgaaaattctaattctttttaaagcgttgaaaaaaaatcggccaatttctatttaataacaaagctgactttcgatctgttattttctttatattcttgaagaaatttaacgacttctggtctacgatgctcagatgctttcatacgtgctgtttgaaatatctgctttcaaaacttcctttctattatgggttagaccgcaaataactacttttattgaattcttctgtgcatgaacatattgtgtttatatcaatttatccatcataagctgcattataaagtattgaaaattgagaatgatttttgtagacatgtcaaaattgacaagtttattaataaccagtctcaattgacctcatagaaaattttcaaaacaaatggcgccgatgcgctggttcagtattcaaaaaattaaatgataaacctttgaaaaaacaatgatttttttggggggtccgaatattgatgattcccttgtgtgcgttcggaggggctgctgcagaatagtcttacaaaaagttcagcactgagtaaagaatttgctaaaaatgtttattataattaaaatttcaaatagaaggaaacggctggctttcgcacatgatgtcttggagacttcccaagttatttgccaaatagacaattgcattttgttcaattgaatcatttgtatctttaatgaacttttgcttttcaacatcaatttcatgaataactcttttcgaaattgaatctcttttttgaattgtttcgttatgtcgcgtttgaaagtcgttttctagtacggaaacatttttagcaatttcatcattttctttcgaagtagaatttgttacttgttgatgctgttgagataactgcaatagaactctatgatgatctttaaccctcgaaatgatatcctgtaattccgcatttatttgtgcttcgagaccattaattgagtcgaaagtttgttgttgatatatacctaaaattgattcgattttcttaatcgacatttctttctctttgttcttatcaggttttgttatttctaatgcgttttctttttgtattattgggtttgttatgaatatttcatcttttttggatgcgtaaattcttttctgttgttttcgttcaggtaatttgggtttaattgtcgtttgttgatgttccatttttaagttttgttggaattgtgtgcaacgcttcgagaattcggtttgaattgatttgggacaattctcaacaagaaactgaaactttaatggtttctttgttgtgattttctcaaacgcaataagtttctcttttgttgtgaatcgtattgttttgttacttgttgaattttcgcatatttgtgaaaacctaaacacaaatacgtcgggtaaatcaatggatttatgtattatacatgcaactaatgtgtcttggtttatgtcaagccaaccttcgccttcaattttaactccgttacagataaaactagtaaatttgacatgaagaatattctttgacatcgggattttagctctttgattaattaacataataaatgaatgaatcgattcacgaaaatttgttgcattaatcgatgaaaaagaagattcaaattggccaaatacattttgaagatgtggtgactttgtaagacatgacttaactctccatgtaaattctgtgacaagcatttgcgttaatgaatcattagcttcttgtattaattttaaacattccgaaatatgaacttcactaaaatattgtgaaaataattgtcgattctttggactttgtgaaattaatgtaattaataattgaaataatgatgataaaactgattctggaagaactaaattaaaccctaattctcgggaaaaacgttcaatgatttctgatagtatgatattcttcatatctggattatttgaacatatcgtactaacaactttaagaaaatctgcagtttcattttcaaattgtgctttttcatcaaatagtaacacatttgtaagtaagcctatatcaggtacaagttcaatgggtaatgtatctttgacaatttttagaaaaaatgaaaatgcctttatatgttcaggttcatttggaatataaggaaatattagctttaaattcatgattcctcttcgatcaagtcttccatgttttgttgaaaacaatgaattcctgaattttttccagaattcatggctgctcggatcaattggattgctcaacagcgcttgtattgatcccgcttcattattgcctccaagtgtcgacatcaaaacgaaataaatgttttaacatcaaacatttgatgcgaattaaccgtttttacacaaaaagtgaaaaaagaaaataacaaaaaattatcaaataaaaaacattcttgaagagaaattctgaattaaatatgaaatattggatcatcttcaatgagagcgttgctccttccgaaagaatcaattgatgagttagctgataaaaattataatttgaatcacaccatatgctgtctttcccatcttctattccaatacttgaagcaaaaaaattctgtacaaaatttgaattcataattttgtttttatgagaaaattttattaatgtggtcatactcatttgtgaaaagtgattttttttaagttgtattctgaatattttaaggaaaatataaatttttaaaaatttttgatcacaataatcattattaaaaaaacatattttgataaatatatatatatatatatatacacacacacacacacacacacacacacacacacacacaaaaaaattacaaatttattgagtaatattaggtaattttggtgggaaaaaagcataattatattgcaattgatacaaatatttaatgtatgccatccaagaaaatgcccaaaatgcttcgcctatttcaggtttattgcctggtctatatcgaaatgcttttgcggcaatttttagttcttttctcatttcgagaatttggtcattcgaatattctaaaagttgttcatttaatttattacttttattttcatttatacgaattgtaaatttagaataattcaataaaacattctcaaatggaagctgtggtggataaaaaatcaaaaacaaatacaggaatacacccaaagtaaacagaatcataaaataatttgttaagatatgtcatatctttcttttgaaaaacgcaaaagtccgaattaccatagtattttagcagttttgtattggttccgaacactgctttttgtttagaatcatgagaaattgaagttccaatttgagattttccttttgaatttgtttgatttatggaaaattcatgaataaatatagtgtgtttgcgggtttgagtccaattaacttcatcaaaaggatgatcagggaaatatgaaacttgtggaataattatgttgcgatgaccataccagcctcggagagtttcgccgattttaggatttggcaacgcagcaattgcattttttgtgtagatatatttgctaatttgtaaattttctaaattgagatcaaagtttgatacaataacatgatctagaccaagtcttttattataccaaggattattagaacgaacttctttgacgtaatttaaggtatctttcatatcttggaaggattgtgttacaaatggaagaaagaataaatttgcttcttttggattttttgtaataataggtgataacattatttcactgcgaagttcatcttcaacagaatattgaaaatctttgttatcagaattattaatttgtttcaaataattagaaacattatagcaatatatttttattggagggaagtgattattgaaaagctctatattttgagaattctcagtaaggggaattgattcctcattaacttgtttaaaatcaaatggagttgatatcataataaaagcgaaaaggataaaaattataagaactgcaataattgcatgctcaagtccttctactttggcatcccgacgcaagtacatttcagttcccaaaattcagagtcttttgatcagaaccgttattatatggattcaaaatgccttccaacaacactttcctataaatatgacttcattgaaatacctgaacatgaacaaaatgaacaagtaggaggaatggaagtacctgtttatatttcacctaagaaaacacctttagataaatattacaactctattgaaggtaccatatttgctacaagtaatgccaaaccagtaatcaattgttttacccaagataagtttctaccaatatttagacctcaagatcaacctgatttatcaacagttccaaatccaaaaaattacgcttcatttcatgatttttcaatggcctttgaacagtggtatcgaaaagcaatagtgtttttttcacctgttatattaccaaatccattatcaggagaattttaccttatttcaatgccaaagatatttgaaagggatgaacgaaacaatccaggtcgtttccgtacatttaaaccagaactttggcctcttcttccacaaaattatctagatatggttgataaaatatatgattcaaatagtaaaattgatccagatgaactttttaaagagcttcttagcacaggaaactaatgatagcgtgtgtaatcaatttgattgggcaccaaaaaatattaaatatctcgatcgagcttctatgagtcttcatgaactatttgttgcagacgttgacaaatacgctatcaaacccaaaactgattcaattttatgtgtttttgatttagatggcaaacaatttgtcgatgaaatgatcaattatggaatcaaatgggactcaatagaaaagaatgaaatcattcggccaaataattttctcagaggtgtaccagaaaaagacacacacaatggtcagatgttaataagtcgccgaaaatttgatttcaatttaattattaacttacttaaattcaattacacaagacaacaattttgctctttaatggagactcaagtaccagctttgaaaacaagcgcagctattgcatcttctggaataatctcaacaaacgaatttttcggttttatcgcgtcactttctgtcacttcaccttatcacaaataccgtttgtcgaactttttgtatgcaattgtcagaaataaccccgacgatacgaagcttcttgattttctattggcagacgaccgtttaccttttttctatcatttcatttctttagtgttttataacacaccaaagaataaaaatcttatacctattatcagtgatcttaagaacgaacaaaatttgaaaattaacaaattttatcttcttgaaaattttgtcacattatttaatgaatgtcttggctataaattttataccaaatcgattgaaatatgtcataagttaggatatgaatgttctaaattacttactgatcgaagttacattgagaaaatcagatcatcacctgatgaagattcatataaagtattaatgatgataattcaaagtgaaacaccacaacttcaacgattacttttggggaataacttctatcaatgggtttccaagaatgagaaatattccaaaatactttggtcaatagcacattcttcgactattgaaacgttttgtaatatgttttctaaatatggatttaatccacaagaacttgaaacgtattcacctgaagtcacacgtaacatttgttatttcattaataatgtttgtaattatattattaatttaccaaacaatttacatgttgatttttcaggtgtttctttaaattctatttttaagtctattattatgagttctaatgagaacatttcgaagttattagttccgatttcattaataatgagtgacccgaagttaatttctgattttaattcgaataaatatcaagaattacttcttggtaattgtgcgatattatgtgctgatctgaattcgttatcattcccattatgttgtgagcgtattaaagcattaacatcattcactaaaatcgaaaattgttgtgttacgatgaccgaaattactgattttaatgaaacaattgttgcacttttacttaaagatcaagatattacgagaatgaaaagttattggaaattcattcaactattatcgcgttatccgaatgttctttcgaacatattaagtgcaccgaatgttaaaaaatcaatttcgacaatcattaaaatggataaccctttgttatcgagaaaatttttcgagttttcgaattatttgtttaataaaaataaaaaccaaaagctgaagaagttgttgttggatgcagtaatgccttcgataggaagaatcgtaactatataccaaacatttggcggaatatataaaaatgatatagcactaaaacataaattcatttccttcttgtgcgcagtgttcgcaatgaaagggcaggaaacagaggaattcattcaggcgttcattaagcattcgaaggaaaataggtcggcaatagaaaagaaactgaattcgttgaaaaagaatatgtgattacggataattaaagttagaaatagaattaaagagtagagaaaaaaggcttttattaaatcttattttatgtttatattttttatttataattcaaattgtatttttgttcctaattttatagcgaaccttaagctaacgtaagcatgctttagataaaagtacctaattttgcatttttatttgttcactgttatacgtattatgcctttatttagtttcatgaaactacataaacaatataatggatccttccacattaatctattctgtttaccattattaattatacgattgtagggtaaaacaaattttataaagacagtttaattttgattacaaaggatactcagcttatgtaatatatatatatatatatatatatatatactctggtatgattcagttatgagcccatttctgcagaaagacaatttttatataaagtatacaaataagtataaaagtgtcgcaaataaacttgtcaaattatattttgcttcaaatggaccccaaaacactggaacttcccatcattcaaaaattattaaaaaaggaagaagttacatggattaacccaaaaatggtaaacccaccagaggcatttgaaaatttcaaattaactcttcaagatgtattggatgctgagaaaagacttcacaggtttgctccacttatcaagaagatttttccagaaacagaaaacacaaatggaattatagaatcaccacttcaagaaataccaaacatgaaaaatctccttaatgatttttggaaatccaatttaacaggcaacttatacataaaaatggattctaaccttccaattgcaggttctgtcaaagcacgtggtggtatttatgaagttcttaaacatgctgaagatcttgcattttcccatggccttcttcaaccaaacgatgattacaccaaattatcagatccttctatacgacaatttttttcaacctattccattcatgttggttccactggtaatttaggtttatcaattggtattattagtgccagtcttggcttccaagtttatgtccacatgtcacgtgatgctaagcaatggaaaaaagatcttctccgctcgaagggagtccacgtcatcgaatattctggcgattacaacgaagcggttttaaacggtcgaatccaatcatcgaaggatccgaaaagttattttattgatgacgaaaattccaatgatttgtttttagggtattctgtttcatgcttacgtcttaaggaacaacttaagtctcaagggcttgaaattaacaaagaaaatcaactttttgtatacattccatgtggtgttggaggagctccaggcggaatttcttttggtttaaagcaagaatattgtgaggatgtgcatatctttttggttgagcctattgaggcatgttgtatgttattaggaattacatctgagctttatgagaatatatctgtgaatgatatcggactaagttgtaaaactgaggctgatggacttgcgtgcgcaaagccatccaaattagtgtcgaaattaatggagaaattaatgagcggtgagtttactgtggatgatcaaaagttgttcgttttcttgaaacaacttttcgattctgagaatatatttatcgagccaagttcgtgcgctgcttttattgggccaactttgatccaaaaggatgaaaactgtttgcagtatttggaaagaaaaggaattagcgacaaaatggacaaggcaactcacattgtatgggcaactggtggcgacttggtgccaagtgaaatcagagaaatgtactacaaaagaggacaggatctgtacgagaaaataaagtaatttaatgtataaagaaattgttttttatagcgaattccttgtaacaatttcattatctacattgtaactgtttgcaaataaattttttcattttattcgattggttttagagaaaactaaatatattattaattgtttttataagaattaatatacaagttgttaatatcataataaaaatatccttgaagttgttttgatttgatattgtaaaatgatacattaaatttcactaaatttatgactacactctttatataccatcaatcattaatacaaaaaaatatgttttaaactattaaatacataattaagatctgcaagaaaatctatgagaattctaatttgttataaaattaattttctgaacgttccaactttttgattgctgtcaacaacatttcgtattcttaaatggccgaacacttatacgctcaaaatccatctttgcaatggtttctaaacatctcccgctagaggagtgctatgaaataataacttctatagctggcggcacatgcggtgatgtaatgaaagggaaagacaaaaagacaggcgaaattgtggcattaaaaagaattaaaattatagatccaaaaggaggtttcccaatgaatgcaatgaaagaaattcaatcactcaaagaacttaaacatgaaaacattgttcaattaagacgggtttgtgttagtaattcacaagaaacaaatagtgtatatttaatatttgattactgtgaatacgatcttcaaggactactttcattgaagaaactaacccttctagaagtgaaatgttatatgcggcaattaatgaatgcattaaatgtttgtgcagagcataacttcattcatcgtgatctgaagcctgcaaaccttctgttgacgcctgataatgttgttaaacttgcggattttggtcttgttaaaaagattgatccaaaagcagttactaataaacctatgacacctaaagtcataacaatttggtaccgcccaccggagcttcttatgggttctaccaaatatggtcttgaagttgatatctggtcagctggttgcatattatatgaaatgataacaaacgaagtcttgtttcgttcttacatggatcaagaagcagatgaactttctgctattttccgagtatgtggttttcctaatgaggaaatttggccaggatggactaatctaccaaattcaagtcttgtccaaaatataaagccaaactttcctatgtcaacactagcggatcacctcaattctcggctgcccccagagtttgctgaggctaatgacttgatccaaaagatggttcaatttgacccgtcaaagcgcatcacagcaaaagaagcacttttgcacccgtttataggggaaaatttcgaagaatttacccctgaaaaattggagaaaatgactttcccagaagctcatcagtataatatatcacgaaagccggcaccaaaaaagactacaagaactcggcctaaaagagttgtgccaccaaaaatcaaatagaatgaaaaatattgagttttcggattttccgaaaaaaaacgcggattagcttctcttgcatgttagaatttttataatcgtgaagagaaggcaacttcgtcaacaaaatgttatatgtatttagaagaggtagattctggttgacatgaaataaacttaagtctttattaatatgttctgttctttattaaaacaaagaaaaatataaataatatgtgaatggattctacaatagaatgtacctaatggtacttccaaaatatattaacatataatcaatcgtctattcggatgatgcaaagaacaattttccgataagaatcaaagctattaaaaaataggaaattttgacaataaagtcaaatttagatgtaacttcatttgagccatttccttgttcatgcttgttgataggagtaaacttagaaggctgaattttttgagttacttgagataattgaacttcattgattctagatgatccatccttccattgaatattccttttgctactgggagtaatgggttcattaacacttggtagatatgtatagtttctctttgagcgtggaaataattcaaaattcccaccatttaaaatcacatttgcagatgctttggttatgctttcgacatcatcgcccacaagtgattcttcatttctgtcttcttcttccaatataatatccgagtattcggacatctgacctgttttgccacttttaattttaaacggattcccttcagtgtgccccatttcatatgcataagttatacaagctaattgttgatttgtgttttatagttcttaaatttaagatgatatatttatattttgggcaatagatgttctctttaattttctaaaacactagaaaaaagaaatttttgtcggatatcattcttttattaatcaaaaacaaatattgtaaacgctttattccgaaatattcattgtaatttataaaatttaataacctaaaaccatatgaattttattcaaccataaacacaaagtttcgatctactgatgtcaaaatcaaattaacaagtaaaaacacagaaaatccaataaaacttacaatgatatctcctctcaagtaatcacccaagttatctttctctttgttatctgaaatcgtgggaatcaaagcgtcgtatttgttttcttctgatgtgatcttaaacggtttccaatcagatttcagccaatttattgatttgcgcgtgaaaccaaaatgaatgtacaggagagcaaatattatcattacagtagtacatctgattactatgttaagggaacttcttccaacaggttcggtaaatttatattgcgataatcgaaaaccaaataatgaatataaaataatggtcataacaatcgctatgacgggaatccctatcggtggaataaggaagaaaaaggaaataatccaaatcccacaaaaaacactaacaaaaatttgtaatattgaggaatattcaaataggataactaagcagtaaaatacaacaaaaactgtggaagcaattcgaagagctattttgttaccaatttttaaagaccaaatcatttgacaaaaaatcataagaacaagaatttctgtgtttggtgtacgagaactgtgctctaatgctgtgtaatcccttccattccactctacacaaggtggactttgttggattgaaagatgaaataatgatgcaattgaaaatgagaagccgagtaaaaatacatatcttattatattttcgcgaagttggttgtagataccttgtaattttttctgtgaaccatatccataaagagagaaaagaagtggaaatgaaatcaacattatgaagcaaaccaaaagaataatatcaaaatttagacgtgtcccaatggataaaatgacagctgatgtgaacccagcgtcagtatgaaaacaatcatcaaatgcaaaatcagaagaactaaataacatctgacatatgatatgaaaaaatttcaaaaaaaagttttcaaagaactgattgaatatattcaatgcattaaatgacagtattgttttcgctcaatattttttgacatttctataaatcgttttgttgctgttttgtcttttcttttcatttaaagttccaatacgaaatttttttcacatgattaacagagctgctttcaatgcaagagtatttgcttataacaaaaattatttaattaaaaaaatcaaatcgatttttagtaagcagaataacatcttaaaaaatcttcctcaagaaacgccaatacaacctatgcattcaaatacgccagatgttacaccagaaccaataaatgaaattgaaactaacgaaattgaagccaatgaaactataatcaatgaaaacacaacagaaactcacatagaggaagaagttcttcctccaaaaaatttcacaaggatttcatcttgtatatcaaagataaattcatgttttggaagcgagaaagttagtgattttcttgaattcatcagaccattcttcaattctttgaaatacacaagtgttggtaagaagaatgacttctggtcaattgaaggaactccagccaatttcaaaatcaaatttccaaaaacacaaatttctggatttgaaattatcaagcaaaacaggagttgtgaaattgagctgtttgatttaagcacaaacattgatggagaaaaaattattcttttaaagaaccaatatcttgaatcatccaccaacttcacattttccaaaccggttctcacagataatcttaacctatatgcaatacagaccaaagaaaataattttacatgtctttataactataacattttgattgaacaataaaactttcaattcttaacatgtcattgttaattgataaaaaataaaaatgtcaaatttgaattatttactctttcttttcttctttatctttttccatcttctcgatttgttccttgttgatttgacgagcttcttcgaatttcttcttgaattcttgtgtgatttctgctgtcttgaaacgaacagaaagaacatcatgggattcagttccatcagcaaaatcagtagcagtccaaatcaaagcacgttcgttaccagcgtgtgacttaagttccatctgtggaaggatgtaatgatttgcacaaacgcggaatgtttggttacgcctcattaaaatacggcatcttcctgtttctttgctcttaaggattttgataaagccaacgccacgttccttccattctttgcttgttgaatcgaaacggtaaagaattgccttatcaccgaaaagcttgtcttctcctgcatctgggtcttcttgttcaactgttgaaggggcttctttatggctatcatctacagcgtttgcatcatcttgagcttgtgttgttgtagctggagttgcaataactggtattgttggtgttgttgtagctggtttctctgcttcaggtgtagctggtgttgttggtgttttgtctgcttcagacattttaatgtgaacgaccatgtataaccgccagtaaacgatcaaatcttcctgaaacaaagtgacacgaaaataaaacattgaaaaacgattattttgaatataaattttagtaatattacttccaacgctggcgaagttgtgtgagccgattcttcagctcaaggaaatttttagcttgtgttgtgttcgtccgagtattttgttgttcgtctgtctttgttgatgtggtaggttgagtatctgtatttgtaggttttggggcagttttcctgggggaagtcaactgctttgttacattgttcggctttgtgtcacttgtcttttgtagtgatgagttcaacggctgagaagtatttgtagcttttaatggggatttaggaagtgttactttagttgagctcgaaacatttgttttattagttgtactcattgttgttgtagttactgtctgtgctttctttttatttgtcaatgaattaattaacgcattacatagtttcgatcgaatgtcatcatgattaaattctttcattttatcttttgcaaatgtaatcactctttggatatctgactgctgttgcatgtctttaagctgattagccaaagctacccaacatttacaataaaatgaatctgtaggaatggttcctctaaaattgctcattccgccgagtaaaccattgaatatttctatcggcggcaatttattaaataatttgaaaatgatcgaattcgttgcttgagaaataccttccattaacaccaattttctttgccatctatttgcaatgaaggtcactgcaagtaatatttttattaattcttcttgatcaaaattacaataaattatcatttgatgaatcgcaatcattacaaatttcattgagacccaatcagtatcacttgataataattcataaagtaatgaatttagaattacattacttttatcaattattgctttagaattaagtttcaattgttctaataaatttcgacataatttaattttcttaacagaatccattttcgaaaaagaagtgaaatctaaatcattcgacatatcaattggaattactgatcttgcaagttctctttgatttggtgtcaatgattttataaattgttctttttctggttttgtcatttttcgataaagcattgaaagagcgccgctacatgcagcagctacttcaatagatttatgatcaacataattgattatttctaaaaatatggatgagttattgtcattatttccaatggcaaattgtaattcattaaaaagatgtacaagtgatgtggcattacaaacattaagacatgagcggagaacgttagagtactctgatggttctgagtgcgttctcacgaagaaaagaaggtctaaagaagaaccaacaacttgtggaggcttcgattcaatgctccaaagaataacaggaacaagagattcaatctcttgttgtgaaattaattcttcttcaaaaatggtcataagaaagttaacaccttcaactataaccttgacattcttatcgaaaaatcgtgttgatacccaacgaacatataaatcactacattggaaaaatgtggattgatcagattcatataaagaacgactttcattaagactttcaatttgatctggtaaaagactagaaaacattttgtcaaatattgactgaggtagaatttgttgtgcttctgcttttaattttccaataattgttgtgacattttgacgatttgatattaaaaacaatccaagatttggttgttgtgattttaggcgttttatcttttttgcttgtgttggtgtagaaatatattttgggacatatatttctttttctttaacttcttgtttttcttcattaatgttattttgtgcttctgctttattttgaactactgaacctcttctatttggtttcttcggtgattgtggttgtgtatctttagtttcttgtttttctttttgtctttggttattttggggcgcctcatccttaacgttctccatgtgagcgtttatgtatcgttgagaagcacttggcaaatttttaagtgctgcattaaaagaatctggaatttcttgtttaatacaagaagctacttgtatagcaatttgtctagttgaagacactctatcttctaaacattgtaaagtaaaaggtattaatttttccatttcattttgaggtatttcattaatatgtgatcgaatccatttaataatttcaagtctaatatcaggattcggcttaaatgaaatgtttgcaaatgatctaacaaaaggagaaggggttgcatgaacacaataagcattaattgtttttgtagcttgttctctaatatttggtctttgatcagcccaatttgtaacaattgcaggtgcaattgtattaacatattttgatatacctttatcagaagcattagcgatttgttctaaaacagataaagtccttaagacaagattcttattaccatcgcctaaatatttctttaaaattttcattaaatgatctaaatcatttgatgaaatttgcttgcatttatttaatgctgtttcaacattttcgataaattctttttgtcctgcccatttagttgcattttctccttcttttagttgttcttctgttaaaaatttggacatttttactcttacaatatttgcttcaagtggtttatttttcgatgtatttctttgccgataaaatgtttttaatggttcaggtaaatcttttgctgtttcgaaatcttttttaagtctaattaatgcatgttctggtaaaccggttaaataactttcgaaattttgaccaaaatatttatataaatattttgcaacaagtgaagcaggtgtttttacttctggtgttttatgttgtaataatgtaatcaaataaggaaagaaatctttttgtatatcacctacaccgaattgttgtataatttcgatacatatatctaatgccgatttaattgttgctgaacttaaactttttactcctctattagtactacaaatttcaaaaacttgttgaaggacaaacgaaggacatattaactctgatataataagaagtaaatcatgaattggttgtttaagttgtcgcattgataatttttcgataagatatggaaatatgattgataaaatactttttcgtattttgttcgatttaacaattacatgtcgaattatatcaattattacttggttaactccaatgtttgattgattaaatcccggtattttctctaatccacgaataatcgcatcgctaagatcatttaaatctttatatgtcgataatttatcttgtaaatcatttaagccggaaatcttttgcttaaaattagaatttgatagtttcgattggatttcacttgttataaattgattccaatttgataatgaagcatcttttggtatagtggaatcaaagttggtgtctttttcggtgtcgttttgtatttgtaaaggtggaagtggtaatgatagtatttttggtgtgataacttcttcgcttttattgatggatgctgatggtgctggagctggagttggctgcgttgcacttgtggttttcattggtgaattttgcattcgtgtgctggctttaaacgctgatgcatcatccaaaatgttatcgaaattgtaatctgcttttggaacttcaatttcttcatcttctgttgtttcttttggtgtgcttcttctaacatttctctttggctgtgtttgaacttttggttgtgtttgagcattcgctggtttcattggagagttctgcatctttgtgctggctttaaacgctgatgcatcgtccaaaatattatcataatcataatccgcttttggaacttctatttcttcatcttctgttgtttcttttggaatgcttcttctaacatttctctttggctgtgtttgaacatttgctggcttcattggggagttctgcatctttgtgctggctttaaacgctgatgcatcgtccaaaatattatcataatcataatccgcttttggaacttctatttcatcttctgttgtttcttttggtatatttcgtttgatatttcgttttggctttgcttgtgtagtttttggtgaattttgtatgcgattacttgatttaaatgctgatgcgtcatcttttatttgttcgaatttatattctttttgtggtatattaatatcttcatcatttttgtcttttatttgaagattttgattcggttttcgtggcagcttcggtgagttttgcattagtagactcggtttagatggaaaaacttcatcatttaaattatcaaaatcgtactctttttgaggaacctcaatttcgtcatcatcaataatcttttctttcggaacattcattcgaatgttttttcttacatttctttttggttgttgttgtatctttggggaattttgcattaaagtacttgatttgaaggcagcagcttcatcatttagattatcaaaattatagcctctttttggaacttctatttcttcgttttcggtttttctattttgagatatgtttttttcctttgattgaattggcgaattcattactttagttgattttgttgttggaaaagcatcttctgtgaatgactctggataataaccaggtggaggatcatttatttctggactatccaaagatgttgttgatttcttcatgtttttctgcaattttaaacggacgtacttcatataaaacggttaaagattcaatttgatcctgaaatgatttcagcatttacgtttcagtaattaaagttctacataaataaatgttagtaaaaattagctaatgaatttgatggtatattgaaaggaatattaatagattttggttaaaaaattgattaattttcaacaagatctaggatttttactacatatataaataaaaataacgtgctttgtcatgaaaaaaattataattgtgaatgttattaggaattagtttgtttcgtataggagaagtcgagttgtttatgattaattttgattacattttattgataactttcctaaaaagtgtcactgattcctaagcgaccgtttatatgaattattaacatccaactgttcaattttcttgatgaccaatattctcacatgtttaagttatgagtattaatttcttataaattaaaataaaatatattttttcaataataatttaagctaacaattctttatttatctgttcttgatttctattccaattcttcatgaacattattatcaaaaaaatataggtaacggcttgggtataaatgaaaaatgatgtaaaaattgaaaatataccaccataaaacaaacaagctattacccatgtgacagtttccattatcaaagccaaactatttatagagatttccaatttttgtaataaacaaagttgaactgattcgaaataaattccacatatattaattacaggtaaaacccataataaataatagcaaatcataattccataagaatgtatatcgaaatatatatttttgttattattattatatgaccaagtgatagctatataattttcaatttgtgtttcagtataaggtaaaattaaagttactaatgttaaagttattataaaagtataaacatgtattggaacttttcttaacctattataaatatatagaggaccgagaaaaatttgtttgtaaattgaaattaaatcgcttccttcataaaacatataattttcaaattcatcaagttctttcttatatggaatccacagaggaattaaattaagtattgtatcaaaaagaaaaacaaatgcaaatgaacgtataatattttctgtatttgaattttgcaatatttttataaaaaaattaaattctttattttcttcaattttaagtttgtgtcttccattttttaatgtaacatttagggaataaagtataatattgtctttaaatttttttgtcatcggaattttgtaaacttttttccctttagttaacaatgtgaaatttaattcgtggttcgagcatccaattacttgtatggtaaaattgttttcattaggtattttgattttgcgagattgtatcaatgatggagaatgaaaaaaattcggttcaagtttattcattatagaaccatttgtaatgttatcataaataaaagttattgttgatatatttctattttttgatataattttatatatattttcgattctagcagcatttgaagaattgtcaaattcaagcatttgagcaaaataaaatggaatttgaggaaaactttttttatatagaaaatgaatataatgaacattattaattgttgataattttgttatgataaaagcacttaaaaagcaaataatcaaaaagatgatgtttaaataatgtgataaaaaatatggcaaataacgaacatgatattttttttcgtttgagatcgcttccattaatggtaaatcgatgaagtgtgatttgtggaaacaccaccggagaacttccctcaaattgagcacactaaaatttttgaacgcacaatttttgaattactttcaaatttttgagtgaaaaccttattcaattgaattttgagcgggtgcacaaaaatggacagtacgatagaactttttgaaaagtcaattttccaccgttttaacgtttgtttttttgagctttgacaaatctgtttcggtgacggttaactccaaaagaaagaaacagaactaaatctaattagattcacatgtaggtgtaacatctatatcaacaacatttcatattttctcggatacaaaaaatatctttgcgattactttgattatatagaatgtttcatgaaacggataaaattgctaagtttttaaatcaagcatcttttaaggtctgtggtacaacttaaaaacgtttgtatgtaaggaattacattatgcgagtacaatttttttgtcattaaaaaagataccatattaaggttattaataaagtgttacactaaaagccaatgaaactatgtacattaggctttctaatttacatgtgttttctcttttggaaaagttcatcaaattagcatataattttatcaattgatttgtctaacaatttaatgaaaagagtatttttccaggatactttgtatgtgtggtgtaggcgagtctttcaaatcagtgctgatttttttcaataaagtttctcagactaaactttcgtattcacttcgttacaactttacagtaaatttcgttttgttgaaagaagagaaatcaatgaagttaagtaaactgtgagtacttgttcatcctgagtctccttttttgatatgaactgaccgatcatccaaacgaaattttttcaatgcttttcattgaaaaaggaaattattctgttgtttattttatcaccgaaataaaaaacactgaaatcgaaagtaaatttctgaattattgctaatgaaactttttccctaacaacatccttcatcaacattgttaaattgtaataacaccacccactaagaaaatgcggttttggctcaaagtgaaagatgaaaatgttagttgtccatttttaaattcaatgcttcaaaaatttagaaaacaatattatgtaattaacaagcatgaaaagtaatgctcccttattttatgaacccgttttaatttgtgggttgcaaaaaaggatcttatgtaactttaaaatttgaaaaaaacgtttttgtatttcttctccccattgaaagacgtttaaaagactatcgttgacggttttggtctggcctttggtaatgagactcactctcgcttatccagatcatgggacacaaatttgcattgatgtagaagatcctgttgctcttaatagcctttacgatcaccgtcttggtcaggacattgatggttcaattcttggacaacaatttgcaggatatcttttccgtcttggtggtggattcgacaagcaaggattcccaatgaaacaaggtgttcttactccacgtcgtgttcgtcttcttcttcgtgcaggcacatcttgctatcgcccacgtaaggatggagaacgcaagaggaaaactgtccgtggctgtgtcatttcatcagaaatctctgctctccacctcatagttcttaagaagggtgatgctgaaattgaaggtcttacagataaagtcgttccacgtcgttatggaccaaagcgtgctacaaggatcagggctatctttggtgctgataagaaggctgatgtcaccaagcttgttcttcgtcgtgaagttaagccaggcaaattcacacaaccaaaaatccaacgtcttatcaccccacgtcgtcttgctcgtaaggctaagttcttgaaggaaaagaaggcccgtagggaagcagctgttaagaaggcagaagcttataaggcattactcgaacaaagaggtctcaagcactaaaccattaattttgacatattgtttgatctatgcttctgaattggtgtcattttagaatgtatcttatttatatatatctcaaaaaatacatttaaaaaataaggtgcatgagaatctttcatgtatctgagctatattatttaggtttctttaaaaatattttttttaatggcgctattttgatttttttggtcgcttaatccccaaggcaaaatgtaaaccatagaaacacaaaaacaaagagaaaatgggtttcagaccttgcgagtcaagaaatgaccttcttaacagatgggttcgtatgaagagagaagagcgttttgagaagtattgggaaaagccaacagatcctggtactgttctaacacttgccgaatgcgaaagatggagaaaacgtgtacttgaaacaatggatgaaaaactcactagattatacacagagccaatcccaccagcagaaacgcgttttttgaatgatgaagtaaataaaatgataaaggaggtgcggcggtgggagatgagaatagtggagctagggggtattgattattccagagtaggggtgaaaatgcctgatggagatatccttaatacaaataataatcaatatcaatattttggaagagcccgaaatctaccaggagtaaaagaactccttgaggaagagagaaagcaattaattgagaaagcaactggggcacaaaaaattaacaaagaacaattaatggagaaagttaattcggattactatggcttaatggatgatgaaaagataactgaacaagagataaaatttgcaatggacaataattatgataacttttcatgggagcctgatttaacaccagccaaaataccacagccacatgaaatccaaattgggctcaacgagctgtactctggtaaaacagcaagcgttattgtttgattgatgaactgggaatccataacctaaaaaacaatttttttgaaataatttttttttttgaaaatgtataattacctaaatttttggtacaaacaaaaatcgttttgttcatgtaatgcgtcgttattatatttttatttaattcatatgaaaatttcattttttgaaatatgtttcttccattaaatagaacaaaatctgaatgtcctattgtatgcatacatgaaaatttcattcaaatttgctaaatattgtttaatcaattgcattgctaaagcaatgctaaatttgaaaatatgattaaaaatgtatatacttattaaatttttttatttattgaagttgtgcatgcaaacatattaaagcatatcaattatacataaaaaaataaataaaatataaaaatcatttagccattaaatcttgtgggttcttagaactgtcaccgttaatgtcattccttaatgagaagaaggtagcaaaaggcatcagtattaaattgattcctgctttttctacaaagaaaatccaaaccaaggcaatgaccagtcctggaacaaagctaaccgcacacattccccatgttaagtagtttaagattggccgagatataaatgttaaaacagtcaatacagtccaaataattccgcttgataaatcatgtgatatttttgcgatgtaccgataaaaagagataatagccattgcaaagcatatggctacatatgttgatggaacataaaaaccgatataacacgtttcttctaatgtttccattccaaatgctgactttagtataaattcattaataaaagctgtaactgcaatcataaggaggttagaaaaagttgttaatctctttgttgttaatagtctgaatatttgtgaaaaaattcccattggagctagaggtatcataagagagaacagtaaggtccacttcctattttcatcccaacaacttttccagaaccagagataatgaatctttctcattttccaagtttttttaatgattttcatatcacatttcacataatttatatttcacgtcacattacacaaatttcgatgagtgagacacaaaacgctgatcagacaaaaaaacatccagcaattcttgatattgacatgaatcactcatcgaaagattcgatagttttatcaatttttcttttatttttctttgcatttgccatgtttaataatatatttgattccgaagtatatgtagaagaatcaacatttccttttgatacaaattgccaaacaaaattaaagcatgttgcatttgaattaagttcaatgaaaatggataattgtccaatgaagatcgatatttcatttaaaattaataataacattattaaacctttttataacatctcatttgatgttgcaatgactcatacatatcaaagcaagtcatatttattccatcgttttcagcatagatatgctttatttggttcatccaagcctggtatggtcactgatccagttactatttatacaggtatggttcccaaatatgattctctctttatatcattaactgctcgcgaagatatcagtgaattcagttcattagttgccactgtttattatgatccatcacccactgatttgtcatatttctttactatttttgcatgtgtttcatgtactattttactcatcaatcacatcatcaatttttggtatcatcgaaaagaaatcataccaaaagaattctatgttacctttgttttattggtcattggagccattatcttttgggtattaatgttttctggcttgaattcgttttttggcgaatcattggtttcggtttattctgccgcattgagagggttctcaatttgggtcattttgaatttggttgtaaaggacacatcaaagctgaacatcatcatcatcctgttgtcttcagcaattgccgcagttgaggtaagtgaggcgggtataatatatgcatctgtttcggagctaacaaaattagatttccctttaattattttgtacgattgcattttccttgttacagccgtttacggaaatatgaaaatagaggagaagaagaaatccaaattatccaaatatttggtgttgggaactctaatgatgttttattgtacttttatatcactgagattaagtgatagtaactatgatagaatgagaaataccattcagttctttaaaagagttgtggtattcggttatttaatgtgcattgtgtcattccatgtgattcagattcagaaggtgaaaggtgaataagtttttgtggattatttttttgtagtttgatcaaacagaaatgttaaataaaaaaatgtttaaaaaaacgatttttcatcgaacatacgcagtacctttaacttaatttattgatgaaaatattttcaccagatagaagggaagatcagacatgtgatatgaaatggagcgttccgaagtaaatttgatttaaaatctttacgaattctttcattatgacttctatatataacatggttttcataacattttgatacgagagaatgtgtgattaaaatcaatagattgacctttgttacaatcaacttcaagtacagagcgaacaaaaagatgaattggttagtaaaaatgaatgtttttaaagatttattaaaaagtaggtattgtttgatttggaagttgggctttgctttacccgataagagcagtaaaaatcgacattaaaaagtgtcaaacagtaaaacgctcaaattttgaattgatagatacgataattcaattgttgtaacgctcttcacttcacccaatgcattttttatttttactcataaatattattccttaaccaaaaatgatggtggccttacatgttgtcttacactatatcttcttcttaccgctactcctggttcgcgaggttgttctctcacggtttgcgctggtgtctccgtttgcacgtcatcgttcgtgagtatacttggcggcggcgctcctccgatgacagtgccagaacggcgcttgttcattgggacacccatcggccctcccatcggtgcgcccattggcattcccatgggccttcccatcggagtgtccttgaacataacaagacgctctctgatgcttccgcgccgctcaggaggattattgttccgattcggcgctggcggattttcgcgtgtctgtggcggtggcgctgcaggcggcgttgacgatggcgatggtgatggctgtagagctggtggcgttctttggaatgctgacattcggttccgaactgatgatgatgaagaagaaggtgcgggtgagggtgcgggcgatggcgcagcattgtttcgctggaaggcagagagcctatcacgaatggagctgccggatgaggatgctggcgatggtttaggtggctgtgcgcggagtgttggctggggaggcggctgtgctgttggcgatggtgctggagtaaactgtgtgcggagccttggcgaaggaggtgctgcagtaggctgttgcggcggcggtgctgttggtggaggtgctggtgtaaactgtgtgcgaagctttggcgaaggaggtgctgcggtaggctgttgcggtggtgctggagtaaattgtgtgcggagccttggtgaaggcggtgctgcggtaggttcatgttgaggtggtgctgaagtagatggagctggctttgacggttgtgttgtcggcgcaggtgttgctgttgttgctggcttaggaggctgtgtatgctgtgttgatgttgatgatgttgtcgctgttgttgttggtttaggaggctgtgtatgctgtgttgatgttgttgatggtgttgttgttggtttaggaggctgtgcgtgctgtgttgatgttgttgttggtttaggaggctgtgtatgctgtgttgatgttgttgatgttgttgttgttggcttaggaggctgtgtatgctgtgttgatgttgatgatgttgatggtgttgttgttggtttaggaggctgtgcgtgctgtgttgatgttgttgatgttgttgttgttggtttaggaggctgtgtatgctgtgttgatgttgttgatgttgttgttgttggtttaggaggctgtgcgtgctgtgttgatgttgttgttggtttaggaggctgtgtatgctgtgttgatgttgttgatggtgttgttgttggtttaggaggctgtgcgtgctgtgttgatgttgttgttggtttaggaggctgtgtatgctgtgttgatgttgttgatggtgttgttgttggtttaggaggctgtgcgtgctgtgttgatgttgttgttggtttaggaggctgtgtatgctgtgttgatgttgttgatgttgttgttgttggcttaggaggctgtgtatgctgtgttgatgttgatgatgttgatggtgttgttgttggtttaggaggctgtgtatgctgtgttgatgttgttgatgttgttgttgttggtttaggaggctgtgcgtgctgtgttgatgttgttgatggtgttgttgttggtttaggaggctgtgtatgctgtgttgatgttgttgatggtgttgttgctggcttaggaggctgtgtatgctgtgttgatgttgatggtgttgtcgctgttgttgttggtttaggaggctgtgtgcgaaatgaatttgcgggtgcaggtgctgtatgctgtggtgcggcgttatttttccaagcagcaagcctatcacgcatggacatacctgtggacgaagaagttgttgatggttttgactgtactgttgttggcgttggttttgactgtactggagttgttggttttgtctgttcacctgttgtcgaagtttttggttttgcttgtgttgttgttgctgatgtcgtaggtgttgttggctttgattgtactgttgttgtagatgttgttggctttgattgtactgttgttgtagatgttgttggcttcgattgtgctgttgatgttgctggtgttgctggttttgtttgtgctgtagttgttcttgaattttgttgtggtgttgaagcattacttcttccttggaatactgaaagtctgtctttcatagacattcctgttgatgttcctgttgaagttggtgggtgtgaggatgttgtttgttgttggcgttgctggactgtattagtttgactaggagttgatggatgttgtgcttgcgttggtttcgaaacatttgattgaggcgttgcttgcgccggttgatttgttgtattagccgtatacgcctgtggtggctttggttgagttgaagcagatgcattgctttttcctgagaaagctgatattctatctctcatagaagttcctgtggatcgaaaagccgatgcctgaccaggctgcggagggtttccttggttcgcattattttggaaagcattaatccgatccctgaaagaactcatgtttgcgcgtaataaatgtcagttattaattgaaattatcgtcatataaacgttcgaaaatgtcctttatcaatttgaaaagcggcaaaaattagtttctttcaatttattatggggaaaattaaatgactttaacttcaatttgaagaagagataaaacattaaaactcaaatttaagtatgcacgctacttggagtttttaactttaaagaaacttttttattataatattatttcgaattaacccaaattatttatcatatagatatgtattaggttatttgttctggaattttcctttggaatggcttcaattttggattttgagcgaaaataatggattcttgttaaatcacaatcatccaattggattcattaatgaaagttatttaatcgttttgcacggttttcgtgagtccctttaaaagtgatgactgtaatgttacagtttttagggggggttaagaaaatattaactcagtctgtttgcataagaaaaattcaaataacatgtctgtttatttaaccgttatttctttgctttgcaatttctagcaaaaaaatttgccttttaatgtgcaaaaataaaaatgagaattttaataagttataatcgttataaaatgttataacattttttgttttaagattttataaatgattaaatgtactcagtgaaattcgtttttggaaaaaaatgagttagcttttttgttcgttaagcatggctttgttctttttggctacgtttttggttggctggttttgcaaagcacaaaaggtgaacttcctggtgaagtaaatttgagagcaaaaccgtctttaaagcacttttgattgatgtgatagttgatgttaaatcacttcatttttatattatgtcccaagagcaagttgagcaaacaacaactgaacaacaaagccaagaagaagcgaaggtagagactaaagaacaagaacaaattgaaactacaattgaagataatcatcttcctccagaagctgaagaaaacaatgtaaatacacctgtcgaaacaccaggagaagataaagtcgaagaagccaatgaggaaactgaaaacgagaaagttttagagcaaagtgctgaagacaagtctacacaagctgcagttactgaataaaattttgctgcaaagaaatttcttctgttttttccaaaagaaaacagaattttttgttaaaaaattgaaaatccaaatataaattgatcaatttaaaacacttctcgcttggtttgcggaagaaaatgtttgcggaaacgagtacatcctaatgcacatgaaaccgtatgattcacattatattatattatatgaatatatatatatctatatatatttctctctaataatgaatatatgaataagattaataactataatggactttcgcttgtaaagcaccgtgagcgtttgcttataagttgttaattttgtggtacatttggagctattgatgaattagaagtgacgattaaaaccgtggtgtaaaatatacgttaagcatttgaccggttaaaacgttattttccagatgtttcgcgatcgatatcaagcagggtttttaaatttgttttattctgttggttccaaacctctaagtatatgggatcagcatgtagaaaatgggtatattaaaagaatcacagatcaagacattagaagttgtgtcattgaaatcgtaagtacaaatgtaaatagcacatatataacatgtcctaaaggacctagagaagaacttggaatcaaattaccatttcttgttttggttctcaaatatctcaaaaaatattttacttttgaaattcaagttttggatgatatgaacatgcgccgtaggttcagagcttcaaattatcagtccaaaacgcgcgtgaagccttttgtttgtactcttccaatgcgtttagatccaggctggaaccaaattcaattcaacctttccgacttcacacgccgcgcttatggtacaaactatcttgaaactcttagagttagtgtttatgcaaattgtagaattaggcgaatttactttagtgatcgtctatatacagaagacgaagtgccacctgaatatcgccttatacctaataaaactgaaagcgaagaatgagcaaattgtcaagcaatgtataaaggagcacctttataaaattatcacaaaataaaaaaacgttatataaatatttgaaaaagtcgtgtaatgttctctaaatattcaatgtttaaatggtcagagcaaatgaacgttgcaaacactgaaagatacaaagaatggcaaaaacaatactcgtcagtatttgttccagaaaatctccagagatcagatgagaccaagttaatagaaggttattctgttcattcaaaattttttcagggaggagagaattctttatcagcttatgaaaatgaattggttgattatcaagggcaagtgatttataggtggaggaacttagattctcatcaaagtttgtcgatgtttaaacatcgaaatgggaatcattatcttgtgtttcagatagagttatatggatatagtgtgtatgagttagaagctgggaaggaaatgcattttgtgccattacaagttcatcctgaaaataaaaaaaattttgttgaagtattcatctggacatcggctgactatgatccgaatagtgatcttttggccgtaggtggctgttattgggcatgcccttggtcaacaattgttgttgattttgcagatcctctccatgaacaacctgtcgagcattggttgtatgtcgaagatttaattgattccaagcaaattgatggcgatgtggatttcgaaagttgggtcgacggaaatcttctacttaatatcaattccgaaaatcaacataaaattctattaccaatatcaaacataaaaaacgccttgatagaacttaaggcaaaagatagggtgtgcgacttaatctaacgtcttcgatttttgaaactcattccaaatttttcataatgaaataacgacttataaatatttttctctatacaattttctttttttcacaaacattttgatcaatgcgaacaataattaaaatattttttgacttctaattttaaagaaaacatctctaaacaaaatgatttttggtaatatcaaaacgagtttataccttaataatttcgattaaagtgaaaatatagacataactatcatagcattgtttgctaaattttatattatatttgtaaaaaagataatattctaaataaataggaaattatgcataacattattttctagattatctacctctttcagaagaaacacattcttttatttaatattcaaacataaacacaaaaaaataccacaattttattgttttattgcaaccattgtgaagagcacttgaatcaaattgttcattttgcataagaaacgctattgcaattgcttaaaattcttatggaagagctttcttctttaaagtttaattccatcaattttcaacggaattacttgttctaaccagaaagaagttcagcattttgtttaacagatattatgataattcgttcctttttaatccttgaactctctccctacattttttagcaattcttcccgagagaagctcatcaagtaaaattccacgttcaatttctattatgggaacatcttcgaagaagttgttgaacgatcttctcttgatgctcctgagctcattccgtaatttaatggaaagccgcacagtttgcaaagtaaatactatgtttaaccacatcacaacaacaacaataacatgaaatatttaacggtctctaatttattcaaatacaaaaagtgccatacaatgaactcggacgacattctccagcgccagctccaaatgatcggctacaaaaaggcctcttcaattcagagcttcggtgacattacttcggaccaatttattgatataattctttacattttcaaccaaattcctcaaacggcaaatcagctttctgctccacccaaatcacactccgctttgttcaagtacaccactcaaatggttagtttgatgagctctcttggatactatggcgatttacgatacgacaatttcatgtatccaaaggcagacaaaacttatgatgtccttcgtttccttcttgagaaggtaccacgatcggagtcagtcgcgacaaagacgacaacctcagtcactccactttccttgtcgatatcctctgcaatttccaccttctccgaagcccaaaagcagaagaacaatcgcgagccaatcgctcagccacttccccttcttaattcctctctcccagagcaaactaagtcgtccataaaatcaattctcaaacagccaaagatcccattcatcgccgtcccaatcctcagcaactccattccgttcaacaaacaatgcggccccaactcctttgcgtcacttctttcccgcaacgatagagaaagtgacatcgacacttttgttctccctgaggccgatgaagaaatcgcaaccaaacagacctccacaaagtcgctacaaaaagtcgccaaacgtgcgtttgcgacttcactctcatcgacggaagacgtttccatatcggcgcagccaacgtcgacggcgccatcggccaaaatcaaatcgcgacttgagaacatcgcacgttttgagttcggtatctccgacactaaaatcggcgcatctgtagttgtgccaactgtcgcagcatcgtcactcgtcagtcgtgaagcggaaatacaacaaacagaagaagtgcaacagataaaagatgtgtctaaagagccgaagttaacaatggaacaagtgcgctcgataaaagctgagcaacatgaagaactccaaagtacagttgaattacttcaagcgacagaacaaaaagttgcggaaatcgaagaccaacttgaggccgaacgtgaagaacttaacacaataacagtggatcttcagtcattgattaatgagaatgagaaacttgaagctgaagctgagcgagttaaaaacgttgcaactgtatcgacatcagattcgacacaaatcaaacaattgaaacgtgatctaatcgatagtacatccgaaattttggatatcgcgaaccaatgggaaccaaagaggaagcaattaatcgctgagtatagagaattgacgtcgttcttgaagaggagaaaagaagatcgtcaattacaaatggcgaaacttgcgaagttaaagagacaattacaagaaggtgaagaaaaaatgcaaagtttcgacgtgtctattaatgagcttaagaatgcattggaagcaagaggtgaacaaatgcctagacatcattacgttgaaatgatattcgatatgattaagaagatatcgaagcaagaagctgaggtcgaaaaaatgagagtcgattatatcgctgaaaatcaaagaatgaatcaaacagtggagaccgttaagagaacatggatgttattggacgaaacaatttattcggaagctaagaagaagaaagaagaatggatgaataagtcgtatagaatggtggtggaattgttgactatattggaaaatacatcagaaaatgtagagttgtcaggtaaattaagtgcacaagcaatggaattggaatcgaagatcgataaaattaaacaacaaaacgatccaaaggcattgaagagaatattgaaggatttggaagaggtaaaagaagaaattaaagaactcgaaagcagataagtaaaaggccaattaacttgatgtggttttgatgcactattgaaatttcgaatgtaaagctttgaaaattagctttggaaagaagaaaaaaaacagcgataaaatatttggatataaacaaaaggagctgcgaaagaagtttttgattataagcattacaataaaatatagactacagaaaaaacatgtatgccgacaccttaatataacctaagcctacactgtagcattattcatagataacatacttagtaatatttatttactaaaaattttttcgatttaattatgtaaatttcgagatattcctatttttaactcacttcactaaggagaaggttaacacaaaaaatttttttttcgtttttctttacatattttaattaattcatatttttgggactgagtatacttaatagatattaaaatttcaatttgccaaaaaactttataaatatttatgatttatctaaaattatgttgtttgtttaaagttttttcgcaatctatttatgattaactttattacaaaaagattttctcaatatttattgacacatgcggtgcactatttgtgtaccttcttcatcgtattcatcacgtgtgataacgcattgtgggaaccaattgagtgatgcaaagatagagccgcctatccaaactccatacctaagttctggtggagcaatgactttaatacacattgatggtggagcaatgtttactatttccttatacattcgttctggaaaaccttttaacgctgtgtttcctcctgacacaacaatattttggtaaaagctcttttgttcctctattttaaatgaattaattgaatcataaaagattcgatgaattcctttctcttcgaatccatttaacattggtttaaaaagaagttctccacatttaaatcgttcttcactaatatttatgatgtctttatttgggagtgtatattttatttcacgaatagatgaagtcgaaaatttatatctttcttcatcataatcaattgcaacataagaatgtttttctttaatgtcgcgaataatgtccttttctgcatttgaaataaaagtattttcatgttcattaataagtatttggagataatctgtgatactttcaccagcaagatttgtttttcgagcttcagtttttctacatttgaattcataaattggaagaatttgtgaaacacctcccccagattcaagaacaattcctgttttagttcctgatgcaagtaatggaagatatggttgataagcaacataaaaagctggaacattaaatgtctcaaattgaatctgaatcattttttcccgattagatttcggatttaatattgcatctgtaaggagaactggatgttcggttacatctacttttaatttgttattatatagatagctccatattttttccatattatcccaatttctaatcaccccatgttctattggataatttaaaatatatttacttatgtcagatataacttcatcaccaatgtatatatctttagatgatgaattcatttttgaatggccgataattgatggaataattgtacaaggcgattcttcaccagcataacctgctgcacacatgcttgatccattatcaatgactaacacttgaatttcacaatcaaaactcatcaaatgtcaaaaaagaggaagaaagtgaacacaattttggcattttttgaccatattcaaataaattatacagtaaagtatttaaacaacaactgttatttcctaaaaacgattaactcattttattgctgataattattttaatactttatcacaaattttttgcagtgatataaataatttatgaataagaaagttatggataaattaatctcaggaagaatatgatataaacattttctcattgagtcaaaaaaatggtgaaacttgcaaagttaaagagattttcaagatgttaatatttattattaaaaaaagaaaatagttttaaatatcaaagcttattttatattaaacaaaattacatttgcacgacaaatatgtcttctttgaaatcagcaaaagggtcttcttcaattgtcggtatagaaattcctgttaaaaatgtatttgtagtttctttttcgttgacattttcttctgaactttcgtttataatattttctgcttttttgtttcgaattcgaatcaataatatgacgagtagtgtcaaaataatcataactataataacaacacaaacaataataataattgttgttagattatcattacttaggaattaatttatatttatatatgtataaaaatttgaataataattataatatgttgaataaataacaattgtgtaatcatagtaaataaatttagtttcaatatatgaaaacattgaattacgtaaaaataatgaaaatgatttgatttgagtttcataaaatgttaatttatgtgtaattaaaatggtgaatgtataagaaaatgataaagttaaataactttgaagtgatttcacaaatgtattcaaattggtgaatgcacttgatttatgtgtttgattgtgtgtatgtgtttgatttaatgaatgagtttgattatgtatatgtacttgatctagtgaaagtatttgattgtgtgtatgtacttgatttaatgaatgagtttgattgtgcatatttatttgaacttgaaaatgattgagtaaataacagtttacattcactgtaaatggaccaaatcttgtatcttcatatgttggatatgtaagaactgttgcattaactgaaaaaaatgcactttctccaatcgatagttgtgaaataccgtaataataaatatatttaagattattatgcgaaaatgcacttgttgcaatcgctgataatatctttacccaattaaagtggaaactaaagaaggattaacttcaattggttatgcatttagtggttgttatagtttaaagtcaatcatattacctaattctcttcttaacattggctcatatgcattatattcgacttcattacaaaatattacattaggaaataaaataaatattatcaatagttatacgttttcaaaatgcacatcattagaaaatattataaatggaaataatataagcaaaattggttcatgttcattttatgattgtaaatcattattaaatattccgtttgataataatttaattaaaattggttcaagttcatttgataattgtatatcatttcaaacaattagacttggaaataatttaaaacaaattggttcatatgcattttataattgtacttcattacaaaccattacatttcctggttcacttcgttatattcatgaaggtagttttgaatattgtacttcattagttacaataatctttgaatctaatataaccggggttggagcgtatgcattttatgaatgcacatcattaaattgtatttattatcacagtgataaatacgtcgatgtagattcctatgcttttagtggtgtaaaaacagagtgtgtgtatgttgataagtcgtatccttatgaaaaatttggaggtctcgaagttaaaaaaggatttcctaaatgcactgcatcgacgattaatcgtgatctatctggaatacttataccaacactttgttctataatacctttttttgttgtaggaacgacatttgttgtttttatactcattcgtcgtaaactattaagtgttcaaccggatgataattctcaattaaaacagtcattaattatcgaagaagaactactgggaaatgaagaattagaaccaaaagttcagttagaaaacgaagaaaaacaagtgaattcaagtgaatgtcaaaaagaatcattagaagattatacttgatttgataacccttacaatgatgttggtaatgatttcatttagtttgatgtaattttataaatgcacttttttaataaaaattatttttattttttcatatctatttttaagtataagaagtgacttagaagtgaatttaattattgagataaataaatataaaacattgcgttttgaattcaaaaattatagattttaataattatatttaattttgaaaaactctataaaatcaaagttgatccgtaataaaattcattagatgttatctacatttgattcactaatgaaccttttctgtcaaagcgatacatagtttttccattcctctttttttttaatccgaatacaaaaaaaaatatacataacacttcattgtggtttatttatgtggtagattttaaccaagatgagaatgaaattcatttctagatatcttttttgggtaacaaattcttctcatgagattttcgcattaactttgatgatggaaagcattagataatcagaaaaaaatagaaaaatttttaataccacaaaatttaatgaattttttatccaagttttaaccactctattgtatttttttattgtgatgtatttatgctattggtatttaccagtaataaacatttttttttttttggaaataacatttggaaataattaaagttatttttgtcagcgcttatgtatgcatccgaaaatatattgatattcatgctaaagatatttttttcttgtatttaaaatcaatttttatgatataatattttataataatatactctcacaaaaacattttttttgtaattataatatttgattggctttttttagctccaaaatatttcattaatattttaataagcctttttcatcatgttttatttttatctcaccaattgagaacataaccgaaaatttgattcaattcccatccttcaaaatgacaaatctctccaacaagacaaagattctcaaaacattatttaaggaagttatagaacacagcaagtgcgcattgatctgttctaagcagcttgaagctattcttccatccataatcacatatcgagataagttattaaattcaaatcttaaaatcagtggtttatcatcaaatttagtaactatgcacatcgaaactataaccacaatactctctaattttgatttacttcttcaactctgttcaaaaaattcatggccgaaactatctctttcgctctcaatttcaacgcctttcaacgagataaaagatattacacaacgacttgaagaagagtttaagcaattacaacttggaacaacaccaataacaattccgaaagccgctattgagcaagacctcaaatatgtgtttgatgtttacagtgcatccgaatccaaaacaccgaaagccaaagatcagctgaatcttgtcaaaaatttatattcagcatatgatatcaatgttccatcttcaccatccaaagttgatgacattgtttcacaagcgggaaattgggaaatcaatttaaatcaaatttcggatgaccttcaaatcattcttggatcctcccaatcttcattgtcgaaaactacaattgtcggcaagaaagacgaaatattccttctcaggatcgttgccagaaatcagcatgtacttgaccgagcgcaacgtgagctcatgttgttatcgacattgaagcataagaatattgcaaattttgtaggaggctccatcaaaaacggcattacgtgcgcgttcaaatatggcagcaactccattttatccaatttacttcgtcaagttgatggtgcgtcaccattagaattaacgaaaattgcgtatggaattgcatgtggcatgaactacttacatagcaacaagatcttacatcgtaaccttaactccaatgctgttattcttgagaaaaagaacaaaccattattatggaattttggtatttcatcccaactaacaaacccaacgataatgccaccagagtatcttgagtccggtgtttacacacgtaaatccgatgtatatcaatttggtttgttattatgggaaattggtacccatatgagaccgtttgggatggactcgtcagaaaccgttaaaattaacgtcatccagaaacatttgaggccccccatcaatgacacttttactccgcatatgaaacaattaattgaagattgctgggcacagaaccctaaggacaggccgactttcccacaaattcttcgacgttttgagacaggcaacatctactttttgaattcttccacacaaaacgtgtcaaaatatttcaagaagattcgaagtgatttgtggaaaccagagaaagtcactgatgctaaacttaaagactttgttactgcgtattcagttaaagggaaaggcgcaattaaaactaaagcgattactgaatttgttgataagtcagataaagagactttaattaaagccatttcacatggcatcgttaacaagatgaaaatacttgttaacaaagctgagaagaaacaaactatcattaatacattatgtaaattattgtcacattcagaagtcggcaaatatgcaattaaaagtttcatcttttccgatggtgtcaaatgtatcattaatttaatcaatgataagaacaacaaagaatatggatacaaaatcattacgacaattggaaataatttgtcatcgacttctgcatgtcaattattaccttatgtattaaaagataataacttaaatgtgtgtaaatcattggtgatattgggcggtaaggaatcggcaaaaatattgaacgaaaacatcgaaactttaacagacgcattaaaagatcaaaagatgaaagaagacgcttcgttcctaatacagttttatcttgaaaatgtatcagctcaagaatatgttaaaagaattactgtcctcgatgcaatatcgattggagatttaatattattgaaacgtttgatgatgtataatgaatttatcgaaacattttcaaatgatcaaattatatctttatgtcaattaattgtaaatggtggaaatgaacaaaaacaatgcgctttgttatttgcattaagtttaggtccggaattttatcaagttatttcacaattcccgaatttcattaattcgattttagatattaataacattgaattagttagtcgattcattgtaagagttacacgtttccctcaatcgtgtgaatatttgttaacgaataagtccaacatattcgaaaagaactttaataattcttggtatataatcgctttaagtcgaattgcttcttattacccaaccgccgtatcgtcactatcgtttgtcaaaaataaaatcaaagaaaacttgaatgacatgaaaaatattgaagcaactgttcgattattaggtacactttctagatgtaataatttttggcaagataatgaactaattaaattattatttaagatattagaatcaggtattattacaacattagagaaaatattaattttaagtgttatatcaaatgtaactgatttcatatctattggagatgaatacttcttacagttattgtcaattgctgaaaatgatggtaatatttcgggtatagctttaaaggttatatctacaatcgaattaccaaataagccttcaagagaattgttgagattattgatattgttaaagaacgctatcgaaaaaggtgatgataatgcaaaggctgcaagctcgaaaattatcgaaaagttggcatcaaacgcaaatttaagagaaatgtttcaaatccaaaagttcgatcaaacaattgtgaatgcgtccgctaatgaaagtgatccaatgacttttatagctttgatgtctgcactcgataaattggaagtgacgccgaaccctcaaattttgtcattgttcgataatatgttgatgaaatcattcggtgatcacgaggcttcggaagaattcatggaactcaggaggagaatgcggctgaaggcgaagtggtagtaaatgacgcgcatcaaataatatttgatgcgataattaaaaatttttttgattttatgactttgatgtgatttaattaacacgatgtgaagtgaatgaattgaaaaccgaattcagtgaacgaattttggtgtataatgtgcgtacgaataagctatggctggtgtttataaatttgttggtaatgagaaattaatttgtcgctcgaaaaaatgcattgataaaattatcaaaaatcatttgtgtaaactttgttcatcattgataaagaatataaaatcatatatgcaaaattgatgaacacacttagataaatataagaatagttatgaagatttgtaaaaaattcaaaaaagtggttttatcatacctataatctgatgcatccacattattcaactgatctcagatcatgtaatttttgatttttcggaagaatatatatatatattataaaagatgaatatgatttaaaaatcatgcattttcaacagtagataacgataagttcttaagagctttaatgaacgaatggaaaatttaaaccaagtaattgagcaaagtcaatttactaattaaataaaaatcatatgaaaaatctcttatgaaatcggaaggaatcaatgtttgtttgccttctatattaaacttataattattttaactttgttgtatttaatttgagttaaaaaaatatataattattagaataactttgtttattcatttcagatgctaagttgaacgctgtttctgttttattcatatattatttcttcttcagtatctctactgctacaactattttccaattctgagctttttgaattgtcttcatcgattgttatgtattttaatccacaaagacaaaattcttggtaattatgctttaataattttttaaacaatttaaattttttaacttttttcacaggtaacattccaaaaaaattgtattggtaatttttaaatgtgaatacttctgttgtttgttcaaatgctctagcccctattgtaggacttttgacaccagtaaaaaaaactttcaaattcttaactctataaaatgcatttctatatattaatactagattaggtccaaaatgtacagttttgagatttagacacccttgaaatgcattttttccaatttcaacaatttttggtaaacataaatatgatattcctttacacccatcaaatgcgaaaggtgaaattactttatcatcttttgttgaaaagaacatttcaatccttccaggtgggaaaagccttaatttcctccctttattatgaagaattccatcatttttataattaaaaatataccgacttgatgcatatatattaattagattattacatgcataaaatgctgagtggtgaataaatttaatcttactcccgatatttatttctttgatttttgtaaaagcaaatgcaaatgaattgattttgtccgctttcgttagtccttcaatttgttgtaagtttatgcaaagctcaaaagctgatggtccaataataagtgatcttttgctagcaataaattttttgagttttacacaagaataaaaagcttctttctcaattataaaaacatttgattgtgacatatcaatttcttcaatttcgttccattgataaaatgcgcgactcattacttttctaacaaaaagtgaaaatattattttcttataattttcttgcgtatactgctcgacattattttcattaacttcgtattgataaattgttaatgtattttgtgacatttcaaggttttgtcttctatctaataaatccatacacccaactttttttgtaaaaataaagatagaaagaaaaacaattttttttgcatacattaaaaaaaataaaatactttctgaatattttttagaagaaaaaataaaatttttaaacgaaaaagattattaaaccatatttcaccatttaaaataataactttaatcaccctatattgacagcacgaaaaggcaatgaaattttaattttaattttatcattacagtcaaaatatgtgttttacaattctattaaattatttatgccacatcactgaaatttcaattcttattcaatttttgaatccattaaaacacttcacctcacctcaattccacgtcgaatttttaagacttgaattctaattcatagatattatttacattaaaaagttatcattgtgtaccctacacttgagctattgctcattagcaccggcctccatttctgtttattaaaataacaatgcatccaatactttaatattggctcatcttccgccgagaatccgacctttttcatttcttcgagtattttatccttcgacaatattttgccgactgatatttcggccaatttcgtgataaacttgttcgcaatatttttgatcgaggaatataaaattaacataaacaatgattctgatccatctgcgcctttcccaagtgtcgacgacacaaatgaacgtgctggacatccatcgcccgagtaaacgctattatcgaagtcaagcaaactgatcatgctcttatttttttgctcaaagttcttaacaacaacaatggaatacttaagacacatgagtgcattagcattatcaatacgtgcaatataattcggcttaaaaaatggagataaaaccgaaaaacgtttcgctaatgacatcgcatcatctgtgttttgtgaccgaataactaaggtttgaccactgagaacagtaaaagcacaataaaaaaaggatttgttcgctacaagctctgtgagtttgaacttagaaagattaaagtcatcgcgaagaacttcaagaacaagttgagagtaaccgttgagataaccgccgaagtcgatagatggcaaatcttcggtgtagctgacttgcgtttcgactgtcgcgaggatgggagagacaggaagctgtgaaacaaagtcatacaagaagggctcaagtacggtgaagtgggtaagaactttaatatgtctgagatcattattaacaatcatgaaataacttggatgcttagattcaccttgattttcatcgatttccgtgatgttgaaatgggctaaaatgggtttgagtgcattaaacttggcattaagaatggaaatcgattcatcttgaagattggcatcaattgtttttttgagtgatgacgcaaatttcattaaatcttctggaaaacaatcaactgtaggatgctggatcttatttataatatccatgatttgttgctgacgagaatattgaattgaataaattatatcttttgattgattagctatgacaaaaactatagagcgacaaaaccctcgagcttctatgtcataaacttgagtataaactgcaatataataagctgattcatacttagaaattactgtagttattggtaactcacatgaatcatatgaatttgggttagctggcgtgttaacaacagcattcataaaagcagtagtatctgtgattccaggtgttttcccatattcccaaaaagcagatggaggagctccttgagaaaattcaaataaggcagaataatatctccgctcctcggggaacatttgtaaggtatcttcagcagttgctgaagaccaacgagacaatcttctgtgtgattttggggaatcttttgattccattgtcgtttacttggaaaaacgttaactaatgaaagttcaattttatttttcattgaaattttcaatgaatgccaacaaaaaattactatcgttttacttcattgtttcgactataaaaagtgccttttaacgttttaatcatgaaataaatgtaattaaaaaaaataaagaaaagaaatatttttattgagttaaaaacaatcaattagcttccggttaaattataattggtatatagtatttcctatgttgagctacataatcttgaaatatattctgaaagtcctaaataataagcatagttcgtgaaaacgattgcttcacttctattttctgacacaaacactccgtattcgttttgaatgtaataaccacagcatgtttcgccatcaacaaaatcagaattacaattatgaaatttatgtgagattccatattttttggtttcgcccatccataacaattcattgaattgagcagacgctgatttgctttgtaaacatgttgaattcaaatttgataattcattggtgatcaatataacaaagttaaaatatttttgaacgctccctccaatgatcttattgagggccatagtattggttatgaggttacttgcataacaattttggaataatgaacttaaagtatcatcactagatatcaacttgtcttgtaaaacgatgtggaggtctgtttgagtaatggtatctgtgaatggatctccttgaaaatatgtgtattgagaatcaacatccagaattcgggtaaaattattcatgttttgctcaaggaattgacgaattgcaaagtattttagaacttcaggaaatgaaaaatactttctttgtaagttatttgcgtaaaatgtatttatatcacatgagttgattatttcagaaatttctttaggaattctaacgccctcaaccgtaattaaataaacagttgatctaattccaatgcttctaatggaaactaaaagatcacgtatagtatcgaaattattatacacaaaagttattattagatctgatggagtacttgttattgggtttgttgaacattgataacaaacaggacaagttgctggtctggatgcattcatcatttgtgttaaaggagaattatttgtaaatttcatttctagagaaagaagaagaataagagcaaaaaccagtattactaatggtatgtaagaaaaaatgattgagatattggactttaaagcccttagcatttggctgtccactttttgagatattaccgatgattaactgcttaaatttttttttgaggaaaaaaaatcaacacttcattttcttattcaaaaagtaggaattaacgtcaatcgtccaacagaaccaataggtttccacttataagcaaatcatgactaaaattgcaaattcggaggtcatcaatttactagaaatcgtttcagaactattaagtccagcggcagtatatacagttacaacaccacagaattttcttgaattacttgggccaacctatgtaaaaagtcttcttgctctctcagaaataaaatcacctgaagagctccttaaggaactacaattatttaacccaactttagttaatgaatgtccaacttttgtatttttcacgtcaaaaggtcataattcaaaaaaatcaatcaaatggaatcttatcagtaatccaccatatttatacacatttgatcctataactaaggaagaaacaaaatcatcatttccatgtgaatccattataaagaaaggtaaaaacacactcaaaattcactacattgatggttctacttcagatttatattttattagcaattcaacttctttttatgattttgtttcacaatttcttctaaaaaataatacgcttaaaccttttgatacgtttattgaatgttgcagatattgtaataaatatcctaaaggcttcaaagcccttgagcagcacattgttaatctttttacacaatccaattatattcctatccgtcatctttatacacttcgagttgattctcgtttcaaacgcattattggaacctctttagtgaagattaactcatctaagaagatgctttgtttttatctcaattacataacagctttatacttcgagaatccaccatcaccacaagagataatgcgtgctgactcacttcttaccaactctttaggagcagttcgtgatgtttttactccaaatttttatcgtgtcatcactgattatttaatatctgaaaccaaaaacttcaatactaaagaagaagttcttagtggttttattaaacttgttaaaacatttcctattcccggaattcttcgttggatttgttggatgctttatacagaagcaaaacgagtttttccagaaggagatggcccatattatagtgttagtaactttttcttcttaagaggtttaggtccagttctcacaagtattagtgatcaagatgctaagaagaaatgtattcttatcactggacttatcaatttttcggcgaaacctgaataccaacaatttattccgcttttcaaagaattaatttccgaaatttcgttaaacataaacgaatcaaatcttgtgcaagcaattacagaagatgaattgacaacggctgtatgggatttggtgggagcaatagaagaaaatatagacgcagtaacagaaatattacataaggatttgcctggaaaacatccaatgcaatggttcattgaaagacagtacgaggcagcaaaagcttataaatctgattgaatattttggtgttagtttagtttgaactcattaaaataataattaatttttaaatttttagtttttgttaaaatgaatgaataaaattaggatttttcaactaatgttgcgaaaataaatacaatgttacacattttggtgtatctaaaataatttataagtcactttttaatacttcagattaaaaatatcacaaactcatcccaaaaattgtatgaccaaatatcagttcaaaagtcatttcaacgaaacgaccgcattatatacctaccgttgctgcacattatgcattgcactgactgtagcacattgacatagccttgaaacaaggaaggagagtacacggcaaaagtactttgttttcagttcgaacaatactttatcaaaatatcaattttttttttttgtcaaccatacatcaccaaaatttgtagtttgctggaagttcttattcggacgttcattccaaagcattaatagaccattaatacaacacacctagcccgaaatttataaaagaaaatactataattcaatgctttattttgactttttaacgagtttactcaacctaaaaatcactaagaataaactattgaattcctttcaaaagtcatcaaatctttcggatttttgggaatgagtttgtgtgacatcaagtttcacaaagttattatgtttttttttaatgtttgtccgtgagccaaacaatgttaattattttttttgtttctgttgttattagtaatttggtatattcagcatttttctcataaagattttcatgtaatttatattttgaatattgaaaagcaattcaagcattagaatttatgtattcgggaaagaaatattttcagaaaccattacaacattacccagttttcccatagttttcactttttgccacaggtttctatgtattgaattaatataccttattttatctcagcaaaaaacacctcccacattcagcccaattagacaaaacgaaaaacacttcgaacactcaataagagaaagcatcgggagatttgttgttcaataatattaaaaactaaaataaactttttttacatcagcagattttttattgatcataactttattcaaaacccatcaaatcatctaatttttgttgcgtagttcatcttttctggcctattttaagacttcttttcctcttctttttgtcttcttgatacttgcaattgagatgattttgatcgtttccctgccagtttttcaaataatcttccatttttgatgcaaataattggcctttacagctcttctgatgcctgatatatttcatacatattcatcctcctcttcatcatccacgagattttggaagttgtcagcatcacatgatttatcatcaatttccgcatcaccttcattttcctcttgtattcctttaaatatccatgtctttaacactgcatcccttggtagctctccccaacattccaagaacgaatcagcagcttctgatttgctatatccacgcgattgattccacaagaactcattaaatttggagctagcaatggacttaaggataccaaagacccttatgtcttagagctgatatttttcggttgctgatgtaggaataaaaaacatttcgatgttgttttttctggcttcttcctctattgctttggtaagatgtgattcatatctatcacacaaaagaagtcatctatcattgcctttccacttgcgaagtaaacgcaaatattcgatcatgcatgactaggaagtatttcctttttttgaatgcaagatttcatacttgcaaaggtttgacttcattgcaccaaactgttcatgacatgcgttcgttatcccctgtgcaataaatatcggcggatattttttgcctgaactagaaatagttacaattactgataagtttttcctatattcatccgggagctgtgcattgacttctccatgacctctttgggcaagaacttggtacctgatggaaacatagttccaccaagtctcgtccatatcgatgatatcatcgtctttataatttgctattgcatttaaataaagattggcaaattcatcaacttcttcttgagaaattttcattctttcattttcccatccttctagagaaaaggccatatcgttcacaaaagtttaaaacaaaatggtaagaaataggtatgttcatattggtctgtttttgtacatcaaaagacttccatgattctaagagtaaaaggcagagttgtttcctcttgacaacaatccccggaatgatttattggattttgatgaaatctgcaactgcttcttcttgctttggagtgaatctccttcaccaaacaccatactgctgtccgcgacgatagttattatttttgagttttttttccatttcgaaagaaggctggacggaacatctgttctcttttgaatattcataagtttcatgctcaatcaaaggcatgaaatatctattctaccaatgttttgtcttcgtgataacggctccaatgccttttggctttgtaacgatgtgaaaacttgaactggttcacaatggccacgcttttgtcagaacagactatgttaaatgattaacaaaaaatgaaaacaatgggaaaactaagtaatgttctgtttaaacattttaaaattcctgtaccatttcctaaaaaacaacatattttcctgaaacgaatgtttttagaaaaaaaatatctattttcgagaaaaataaggttttcctaatggctaatagcattactcaaaaacaaatgttttttaaaaaactttttccgagaatttctattgaagtaatttaactatttctgtatgaccattccaagatgcaattataaaagctgtatcaaataaattaaataatttccaaatactattttgaaattccagaatatgaaaataaattctaaatataacaaataaatattttagaattaatatcaattcctatttgttcaagaagtaatttaacaatttctatatgaccgcttgaagatgcccaaataagtgctgtatcaaataatttaaataattttcaaatattattttgaaatgaaaaattattaaaataaataaactggagaaaataatacggcattccaatagattgaaaaataatgggaagatatgtaaacttctcaaaattgaaaactggattattgtcgatttagtttcaaaaatctctttttcattcaatttttattaataaattttttaatttttttccaatatttctgactgcttctttattacacatgtgtaccacacatttttgcatgaaattggatctctttcgtttatatgttaagaaatcaatttccattgatatccaatttttgttaccaattcatgatgcatcttgaagtgttttaatttctatatattctcttatttgattattaattacctgaggctttccacgttccgattcttttggaatttcatttgttgaggtaaactgtcgaattgtattatcaactcgatgagttccaacatgtagtatccctgctatttgtttttggctgaatccttgtttgtaaaggttaattatgttctcggcattgttcatgatttccctaataataaacggtctgtattcaaaaaattcatagagtttcctcaatgccgatttattttcacaagtttaataaataaaacaaatgaatatctttagcattaatatgaattccttcttgttcaagaagtaatttaactatttctatatgaccattttcagatgcacacataagtgctgtttcagataatttaaataatttccaaatattattttaaaatataaaattattaaaaaaaattttaaataaaacaaataaatatctttagcattaatatcaattccttcttgttcaagaagtaatttaactatttctatatgaccattttcagatgcacacataagtgctgtttcagataatttaaataatttccaaatattattttgaattaccaaattattaaaataaattctaaataaaacatataaatatctttaacattaatatcaattccttcttgttcaagaagtaatttaactatttctatatgaccatttttagatgcataaattagtgctgtttcaaataatttaaataatttccaaatattattttgaaacataaaattattaaaataaattctaaataaaacatataaatatctttaacattaatatcaattccttcttgttcaagaagtaatttaactatttctatatgaccattttcagatgcacacataagtgctgtttcagataatttaaataatttccaaatattattttaaaatataaaattattaaaaaaaattttaaataaaacaaataaatatttttagcattaatattaattcctttttgttcaagaagtaatttaactatttctgtatgaccatttgaagatgctttaataagtgctgtttcaaataatttaaataatttccaaatattattttgaaatataaaattattaaaataaatatcaaataaaacaaatgtgtatctttcgtattgatattaataactttttgttttaatatatatttaacaagttctatatttcctgattgtgaagaaaataccaaaatatcatttggaaaattattgttattaataaaatacttaacaagatataaattacctattcttgcagattcattaataatgctagcattaattttcattccttttgtttcaagatttacaaaaatttcataattacaatacaaaatacattttttccctaattcttctaaattatttttttctataattttattttcataaatatatttaaagatatcattgcgatgaaattcaattgctgtttcatgtgcatcttcaaatgttgaatgattttgttcacataaatgaattatttcaagatttccaccctgcaactgcatatttttgccagtgttatttacatttgcaccattcataagtaaatacttaaaacatttaattgatttaaaaatgctgcataatcaattaatgtaacatcttccccattaataaaatcacttctttcataaagtgatggttcaatgatttgattaatgtcaaaatcatttggtgatgatatttcttgaagtttatctacttcatcatttctaattattgttgcaatttcatttggactatgtccttcttcaatatatttttgatgaagttcccaatcgttttctgaaagttcttcataattattatagatttgtcctagataccgattaattttcagattcataggttcttcctctacaatataatgaataaaatatggaatttcaatattttcagttatattttttataattttagaatttaataaattttgtttaaataaatgataaaaaataattaaagtttcttttgaattttcattaagaagaaaatgcgaaaatacatcaagaaaattggatttaatgcttgcaaatttatttataaaacacaaatataaatcaagatcattcatattagcaatataagatgaatataacatttgactaataaataactgaaaagataacgaataagtatcatcaaatttgctcattaaccaatttactgttttttcaatagtttcttcttttaagcaaaaaaacatattactgatttgaagaaagtttataaactcatcttgaggtttctgctttatctccatattgacagttcttccgattatttttaaagaagacgtttatttcaaaccggggaaattaacgttcctgttctatcgttaatattaatttaaacgggtttaaatgaaaactcgtggtgaaaaaatcaccacaaatcccattgtatccgaaaggattgattctttccttagttccttacaacaaatcctagcctctgttacatctgatttgtttgtacagcaaatgtttgaagattctttatcgtcattatttattccagatcgagtttgtgaaatcataaaaattcatctaaatagtgataccaaaaaatttttagatactttaatgcaacgtttacaagcaattgaagcatgttttggtgaaaagaaatcacaatctcttgaatcaattggttataaaattctttcacttcaaaaagaaaaaagttcagatgatgcaatgaagatattaaggggacaaattatagaagtcttagatttaggaaatcataatgatcaaataaaaaaaatcaaaaccaaaacaaacaatttcaaatttgtacttaacaatttaaagcaacaaatagcacaattacatgaacaatatttagatgatacaaaaaaatctaaatcacaagttaaaacaaaactaaagaaattatttggtgaactttatgaatatcaacaaaatcaaatcgaatttcaaaatcaaatcctaaatagcacaaagaacaatgagttaaacagaatcaaaaaagattttgatgttgaacttgaaaagtattcaacacgcgagacatttcttcaagatgaaattgctaaattaaagaaagaaatcactaaacttaaacaagaaaattcacttaaatatgaagaaaattcgaaactaaaaaatcaattattaattattgatcaattaaaattagaaaagcagtcattagaaaatcataacgaatcacttcaaacgcaaatcgacatattaaagaatgaaaatagttccaaaagtaaacagataacaaatttattagatgaaaacaacaatttgtttaatcaaagttcgtcattacaaacatcactttcttcgttaaggaaaaaatatcaagaaaaagaaagagaaaatgtaaaattacaaaatataataaataaaaacgaatttgaaaaaaacgaattttcgaacataaaaaataaactcgaaattactataaatgaattaaaagaaaaagtattaaagttcgattcacttttaaacgaaaagaataaaatgaattcggagaacattatgttaaaacaaaaagttaaagaaatggaaatagacttaaaagatatgaaagaaaaatccgatttttatatgaatgaaataaatcattattcgaaatatgttactgagaacaaaaaattatcttttttatcagaacaaaacgtaaaagaaatcaaagaattaaattccgaaatagataatatgaaaacaaaaaatttaagtcttcaaaatcaaattcaacaaatgaaaaacgaaatcgaaaaatccgaatcattaaacaatgaaattacttataaacttaagaacacagaaaatttgttacaagaaacgcaaaaagaacttaaaaaaactattgaagaatcgaatgaaaaaataaatgaaacaaataaaacaattgatgaattaaataatatgaattttaatttgataaatgataataaagaattaaatgataaaatcgatgatataaacatcgaattaaataatacgaaacttaaactaaataaatataaaagttcatttcttaaagttaacgaagaaattaaaattaaaaatatatcaaatgaagatttgcaaaaaagtcaaagagttataataaaacaaaaagatcaaatgaataatgaaataaaattattaaaacataataatgaaaaattacaaatgaaaattaatgaaattgaaaatgaaaataaaaatttgatattaaaaattaaagaacatgaaaatcaagtaaaagaactatcgaattcaaccgaattattagcaaataaaattaaaaacattaacgaatccaagaaaaaaataaaaagtcaaaatgaaaaacttaaagaaatgataaagaacaaagaagaagaaattataaatttaaacgaatcaaacgatacattgaaattgaaactgaaatcaattcaatcagaagtaaatcattcaaaaggtagaatcaattcaattgaaacaacaaacaacgaattgatgaaacaaattgacaatataatgaaagaattaacacctattttccctgatatagaaacaattgaagaaattcctaaaaaattaattcaattaaacacacaaaatgaaagtataagaaatgaatttcaaatcgaaaaagatgaaaactttgttacttctgttaaaacaataaaaaatgaatttgatcaaatgaaacacattcaaaacgaaataatttctttattaaaaatgagttctaatgataattctgatgtaatttttcttgttaaaactttaaaagaaaattatgagaatttatataacgaaaaaaacgaaatattaaaacatttaaatactaaagaaccgataatcgaaactataaaaaatatagaaaaacaaattccaaatttatttataggaaattttgaagaaaagtttcatcaattattaacagaaagagaaaatttaattggagaaaagaataatatacaaaaaacacttaaatgtgatacaaatcaaattgttaatcaagttgaagaaatgtttaaatgtattaaagaacttcaaaacatattcgagacaaacgatttaataaatgtttctaaaagttataaagatttttatgtttcattacaaaacgaattaaaatgtaaatccagaaaagaaattatagaaactattaaacgaaataataaaaaccaaatcgaaacaaatgaattaatttcgaaaattttattaattttgtttaatatcaaaataataattatttcggatataacaaacgaaatgaaaaataaaataatcgaaacaataacaaattttaaatcaaaagctgataaagataataaaaacgtaatatctttaattaataaggctaagaattacggatatgttggcgattcattcgatgatgcatttgatttcattacgaattcaattgtcgaaatcgaacatcaaaaatcaatcgaaaatatgcatcaagaaatgtcgaaatttaaatccttacaagaaaaagaaagaaacatggtaatacaagaaaagaagaaattaagaaagaagattaaggatcaacttgatgaaatcgcaagtattaaagagttacaaattcaacaagaaaatgatttcttgttacaaagtgaaaaacttaagaatttaacaaaaaacacacaaaatgaatgcgaaatacaaaagaaaattagaaaagaattaataagattaataggaggaaaagtagtcgactttgattatctgaagttgaaattgtccccaaatgaatacatcgtggcgaagtcagcagatgtagcgaaaaaacatgacttaaataaaactttgtaatgtagtgtatatacttttttaaactgtttttatattatatactcgcattcttgatttaatacaagaaactgaaatggtttatcagtatcatcgcttatttaacagaaaaaaaattgtgttaaattattttaggaattgctttgttctaataaatatttatgtaggttgtgatacgtacgttacacaaaaaacaagaaatagagctaaatgaatgaagaatcatcggatttatatttcgcaggattaacggtcgataagaaaatgatcgggtttaattcaaaaatccactttttgatgaattggggtggtgtattatttggcaaaaattggctgtgaaaaaacgattttcaaaatgtgccagccggcaaaatcaaattttattaaccacaatttttaatgatgtccagcacgatgaaagatctacacgttaaacgtggtgtagaagatttcgtaattcataattttttgactgctgctaataagtgcaatgcaattcttcaacatatccaagaaaatggaacaagagtcccatttgaaattgaaaacacatattcatctgagtctgtctccatttttgttcagtttcttaatggagaaaatattccttttgaatttgatcaacaacttaataatgaactttttgatcttgccaaaaaataccagtgcccatctcttcttagaaatcttgccacaaattgctcacgtacagttgaacttcttctatctgaaattgaaaatggtcttgataccactctaacagaaaacaatttaattaccttcatttctcttggtgatttcgacaatttagaattattaagttcaaaagtacttagtcgcatcattagcaaaggtattgaaaaccaacaaataattcttcctgcgctcatatttttcattcaatatgcatctgcacataatatccttgatgcgaactatgataaaatccttggaaacattgaatttactaaggaatctatccaacaattaacagattctcctgatttcaactgtcctccgagaattaaacttgtttcacttgtgaatagtattgaagaactacttataaatttcaagagtattttacctggacgtgaaatcaaatcagaaatttgcgatcaaatttgtactgatttaactttagcacaagcaatgctttttaattctctaaatgaaattgtcaacgccagaaatgaagatagaaatggtgcaaatcaaaatagtaaccaaaatagaaaccaaaatagtaatcaaaataatggaaatcaaaatagtaaccaaaatcgtaatcaaaataataatgatgcttcaccaaacgcagggtgtggtataagaagatatgtggaacataataattaaggtttaatttttttcaaaaaaaaattaataaaatttccattttcttctactttattgttctttttcaaatgaatttggctcttcaataaattgatgacgaccacatttttacttctgttataggtttgatatctttgtgtaagttgttatttttgcgtgtttttgattttgtacgtttaaatatatacgttaaaaaatggaagatgagaacaaaggaactgaggaaagttcttcattttcacagacagaaaaacaattaaatgaaatacaaaatgaaattcttcggcaaggaaaagatgtagaaaaatttattattgaacattcaaaaattcatcaaaatcctgcaattaaatcattacaaatattgtttgaattatttaagtcggaattatctattaatctttcttttagaaaagctttaatgaatgataaagccctcattcaacaattaaaagatatcataaataagaaaaataaagaaattccaactgttttaacacaactatctgacgaactaaacataagaattgaaaaaatttcagatattaccaaaatatttcaagaaatccaaaatgaaaatcaattattaaaattcaaacttactcaaatgacacaagaaaaagaagacataaatgctcaatccataattgaaatagccaagcataactctcgagctgaattggcagaaacacaaaatcaagattatcaaaatcaactttatgaacttaaatccaaatatactaaacttattaaatttaatgaagaacttcaaagcaatatattacttttgaaaaagaaactttcaaatcaccatcaaatcaaaaaagaaaataaagaacttaaagaacaaatcaatagacacaaacatgaaacagaatcttccaataaacaaattcaagaacttaaatcaaaacttaaagcacaaaaacggaatcaaaagcgtattttaacagaaatacaaaataacattactaaccaacaaacacaaaacactatttataaaacggatcaaaagaccaaagatattgaaacaaaattttcaaacgcattagatgaaaacaatcgattattaaaaaagttacaacaatcatccaaagatatttcaagacttgaagaagaaaatgcaaagttaatgtcaacattggaaagatacaaacatttaagtagttcggtaatgtatgattcagatgtgtcaacaccaacaaaagtcaaaagttcgtcattttattcatcagaagatatatcaggaatgtcaaattcttcttatatattaagaccattaatgttggcaacgattgcatgcaatagattaatatcaaagaataagaattcgtcaactaatgtgtctgatagttcattcgacgtaaagaaagaacttgtgtcactgaagagggaaatagtatcacttcagagtgagcttgctaaatgattaattgttgtaaataaattgttatcatatattaaaatttataaattataattcgattatattattgattcttaatttccaattgatatacactgaaaaatcatttatgccataaacatttctaattttattagattacggaatttactgaatgaaaaagaaaaaataagttcatatttcaatgattaatacaaaatatattttatttataattattatttaaatcaaatcatttattctttctataatttcttgtaatgtatttgttgatccgaacattcttctatattccccgctgagcatcatttctattaatcttgtaacccttgttttatttaactttaaaatactgccttttgcaaatccgatatcactatcaccaaactgatcgaaataaacaggtccaaaattataatgttctctaccaaaatcgcaatccaccaattgaacagttgatgccatattgccagttaacatcaaaaatggtgtaactgtcatttctgtacatttcatacagtgatctattgtatcatccaaacctatttgatttataagtccaaaacttttataacaaatttttccacaaaacaaacatttcgcaagagtcactatttcggttttcaaatattttcctaaattttcattctaaaagaaatcaacaaaattctcacataatgtagtaaactcaaacttcacacatggcgataaaaatgctatatctgtgatttctgcttttgaatcttcgatcattttttggaaaggcatcagctcgtacttttctgtaaactcctcaactgaaggtattgaaattgtatcgttcgggtttgatgccatttgatgtaataactcaacgcgtcttataaacacttcgaataatgacttatgtatatctttatcatgaggagctactgacatagccaatatcttccaatatttcttaatcattttttgaaatatttcttcattatcacttaaatttgcactattaaagaaatcaatagcaaataaagcaaaaggatcattagtatctgaaacattattatctttaacaatgaaagcgattctaatcaaatgtattaaagcaagaatcatttttttatcatcgatacatttaggttcagttctatttaatacttcaagtaaagcaatattatatgcaactgtttgagcaatagaaactccacataatgaaataatttcactagaaattctttctatttcttgttcaatttgtgtatttaaattttcgaacacaggtattatagtattacaagtagttctatccattggacattgttttatactttcatttaatgccaaaagatatacaacgttttcattaccggagttaaaacatttaatatgagcccaatgaccacaagtttgaactctacaagtaatcggataacgtggaatggaatcatgtgcaatgatttgttcgattttcgaaaggattcctgttcgatatattgtagaaataataccataaggctctttcattatcattaaatgattcactacaaaagcgcaagtaaaatgaattaggtgaagcagaatcgaaagttgctaattcattagaatttgcatctgcaaagcatttaattgtttttggaacttggctaaaatcgctgagcgatctatctcgcttaggctttggctctattcgattcatcaatttcgatttttgattttacataattcgaaatcattgaagaaacttcagatgattcattcacgaaattatttaacaatttaatgccattttctaatgataaaatattcgaaattaacaaatcggtgattttcataagtttattttcggtttcattgggaaaagtatataatattaatcgatataatgcgaaaatagtacgttttaatgtatatgaagtttttgaaggatttgcgtttaataatttttccattaatttaattaatactttggacttaaggaaatctctgattctattcattggatcaggtaataattccaatttaggaatcgttaataacttttctttatgttcattaattttattatagaaattacttgatgaaatatataaaaatacatttgcctcatttaagcattcaggttttaataccaatttaatacctttatctatttgttgagggtcagctacttccaaaaatgtttcgtcgagagtatcattatcgactttaaacttatttaactcaataattaattgttctcttgtattaacaccggaatatatatattgaattatcgcttttcgtaatgattccttcttgaaatgataaccagagaacgttgtgtcgcacgcaatgattattaagaaccgacataacaaatgtcagtcaactttggttccatttcacatctcgactaaactcgctgctgcatttttatcccaataattaatactaaattcttcagcaaattattgaatatggtatttgtatctttgagcactcaacattgtaaacatattttcgtaatacctgcttgttatagtagtctgtaatgatatttcgaaagtctttgcggatgtctgtattgattcactcatttgaaatgcgaaagagagttattttggattatcaaaacaattgcccgaaacagaagacatgacatatgctgttaattcatcaataatatcattaaacccaatcgtttcagggagattaatttcggatcaatgttggttatgtaatgagaaacatattaacgtattaatcactaaagtcaataagtggactgtgagataggggaaaattcgttataaggatttcaatattatcaaattttgtttgaatatttcagatgacatttcattgatattgatctcgaagttttattgccttagaaaataattcttcgaatattttgtcaatgattttgaaaattattttcattcaaatttaaactcgattcatagccagatggctttggggaacgtttggtcctttggaaattcagtagaaattaacgaggtgcattgtgaaatgattggtattaactcatagacacataaatagatgaagttccgtttgataataattatccgtttgatagagctcatgttcaccttcttttacgtttgattacgttcacaatttgtctcattgaaatgaatttaattatttctgcaatggcagttgaatctcacgctcgttaagtgctctccaaaaattatcggatactcagtttcctcgatgtcaacgaactccaccgccaggatgaaatttggggtgcccgatggaatgcaacttcagaattatcattaacgatggagtaatgtgagatgtaattatacagcactttaaatgaatgaccactgactttgatgcttcttttctgactcgagaatattctgtatgaaataaagcacattgcgatgaaagtccacttgctttctgtaaatatattgcttagaaggatgtgtagttaagtagaaatggttcgtagaaatctgcgagatgtaaagttggaagaggtccgtcgacaaactctctctggaagtatgacagaataaatacatcggaattaaattgctgtatcaaatcgtcatcaattggatcgatgtcatcttatttggcgtgatttccttcaaatagtaaatgacgaagatgattcaacaaatgtacctctattgaaaacgtataactcaaaactttgtaaatcctgtggaagttttgcggctcttgcacctcgttcgatgatagtcacccggagtaatctggacttattctgccgctttgaagctgacgagataactcccgacacttccgccggcctggcgcggcgttcggcgtttttcgcaccactctcgcgatttatttgcgttt

SEQ ID NO: 26 - DNA, 1725435 bp, Histomonas meleagridis
  misc_feature: contig_51_vir
tgcaataatgatagatttaaaataccacatttctttttagtagttttaattaaattttcaacgcccatacaagtatttgcaaacggcctgtgtgtcattttgccaatgcaaattagaaatgttcttcaagggagaacccataatgaaatacacgagaaaaagatttgagaagaagattaaaaccgtgatattagatgaactcatgaatgaaagctatcaatttataattatcaaaaattatcaagtatttccagaatccactttaaaatattggaagaaacaaatgtctattaacaacaattggaaattcgtggttgaataataatgggattgggcatagaatatttactgatgacgaagaagctgcaatcaaagattatattttcactaattttatctcccaaaggattctacttcaatgacgaagatttttgcagatgtacatatcttataccttagaaaagaacaatcaaaatgaaaaaatgttttgaaaaagaatttttttgattagcaaatgctttatccataatttcaagaagaaaccacatacttcaggaaacctcatttaaataggggacctgtaacaccagaagatgacaagaataaatttggccaggcatttcaatcttcttgagactactgatcacggctcaagaatgagtgaatgctgatgcgagacaagctggaaaagagaaactttccaggtggagatttttaacatggtccgagaaaggatccagataatgtgaaagttttttggaaaaaatccgaagcaatatgtttactgtattggctaaaataaagaaggccgatggaacgaaagttgctttgtttatcattgcaaagggcacaattagagagaacagaaagaaatttaggtgacatttcatatcacatgtcggtagatcaaagagcggatggactacagaaggcacatttcaagattattcaacatttcttcataaagcatatcagcgacaacgataagatacacctcatagttgatcatttacaaatctcacgagacgcgcaaaagatcaaagatcttgcaaatcgattaaacagtgatttgattttcataccagctggactaacagattgcctgaagcccctcagtagattggtgtttggctgcttaaaatcaataacccgaagactctataaaaaaacatatcaagaaaatccaaatacggtctttaacaaagagaaatggcaattaagcacttactggcaacttgggaacacttacaaatgcatacaattacagaatcatggtccatttatgatgaataaaaattcattattcctgttcgtctttcgactacaaaaagaaatgaggaagctatatgaatgaaaatgctcagagtgtaatcccaaattatgattttagtgaaatcttaaattatcacatgcaaaaggcaaaggtgttataacttgaagaacaattgcatgatactgtagggaatgttgatcattaaaaatattgaaagaattgaatgaaaaaaagttggccaggtgtaggaccttttgtatgtacacaaggagatggagaagcatttacatgtgtacctcatttgaaatatcatgagaaacaaatacataataaaacatttccaggttgtacaatgttagaatttctaaactttttaagtttaaaagataattattgggaacaagttaatttacaagaccaacatcaaagttatcataagaatctttatttttgcttctgtccaaattgtgattattttactatgaatcagggttcattttcttcacatatgaaaaccaaacacaaatatatagttgataaaaaatcagaaataggatggatttgggcgactattaaatattggattaatcaagttaatagaacaccaaatattaaagaattaatgaaaaaaagaaatggtttataatgtggttattgtaaaaagacaattacagctaatgaaggaaatataaaattacatgcattttcaatgcatagtgattcaagaataaaaggtacaattattacaaaacaaaagattaaaattaaatccacaatatttagaatcctgttacaagaacaaattgatgagattgaaaatgaaattaaagttcaagaacaattaacagatgataacaataataatcacttcaatgatagaaatattattattaatcaacaaaataatggagaaattaatagaaataataatattattatacaaaatcaagatcaaagagtcattcaacaagaacaaccaaataatcaagaagtacaacaaaaataataatctagaacaacaacgagaagaacaactaaataataatcaagaagaacaacaaaataataatcaggaacaacaacaagtagaaaatataagaatgactcaagaagaacaacaaattattttagaagaaagaaataatttattaataaaatgtagaaaatggttaaatagggtagaaatagaagaacaaaatgagattcatttacctaaacttactaaaaactttagacaaaaacttatttatcccaatcaaagaatgtatgaaaaataaaataattccaatattaaagaaatgtttaccaataaatgaaagtgaaacagaatggataatctttgaaggaggattagccaaaatgaatttattaattagaaaaactattagaaaaactttacatattcctttagaaaagatgttagataaatctatcaagaagaataaaatcacagatagaaaaaaagatacaattagaagacaaaacaatataattagaaatttatcagaaattactagttatattaaaaggattatagaattaaaagataaaacacctacacaaactatattaaatactatttcaagtattgaaatagaaatagtaaatattttaaagaatactaataatgatatattaaataaaataattggaggaaataacattgaatatattcgaaacattattaatgataatccagaacatagagaaaatagattaaattatatttcagctacattagaaaatattcaacaagataatatgaatattatatcaagaaaatataaaaatataactcaaaacatgtatcgagaagatccagttagagctattagatggtatatattaaatgatcctataccagaatgtgatttaaatatagaagaagttgggaattattataaaatacaatttgagaaaattgcgaattttgaataaccaaaagaaaatagtttatgggacttaaaagaaatgattgacgaataaaatagagattttttattaaataatctattagataaggatttaattagaaattcaataagatcaagatcaaatatggctgctaatggtccagatggaattggaaatcctatatggaaaatagatattaaatcaactactaaaattattaaaatgattaatgaacaaataattaaattcggaaaatttccacaaactttaaagaattcgaaaacaatattattatataaaaaaggtgatccaaaagaaattaaatcttggagacctatatcaatatcaaatacattgtatagaattgtaatgtgtcagatatcaaagattatccaaattataaatcaaaattgtaacttcattaatcatgtacaaaaaggatttaaagctggtattaatggtatttcagaacatatagcaactataaatgaattaatttctgaagctaaaagaaataattcttcaatcattattactacactagattttactaatgcttttgggtctgttcctcataaagctattttatggagtttaaagaaaagaggattcccaacgaaatttatagaagcaattaaagacttatatgataattcttatactactatcaaagttggaaataaaaaaaactgaacaaattaaaataaatagaggtgtaagacaaggatgtcctttatcacctttattatttaatttatgcttagaacctttattaaagaaaatccagattaaacataaactagatggtgttccaattaatacaaatgataatgaggtaatatattttaatattcaagcttatgctgatgatatagtcttgatttctcaaacccctgaaggtatgcaaaacatgttaaatacagtagaaaagttctgtaagaagaatgatatgtcaatggctccacaaaaatgtaaaactttaagttatattaaagaaaataatcgaagagttacattaaattataaattacaaattcagaatgaaaatattcctaatttacctttattagaagctttagaatatttaggttcatctgcagtaattaaataaaaaggtagttttgatcatactaatattagattatataaaaattaaaaatgaaatcattaaaattatgaaatcctcattaaaatttaatcaaaagatagatgtgataaaaagaatgattcttcctgaaatagatttcgaattattaaatggttattgttcagagaaagaattaaataatattgatacaatgattaagaaattaattatgaaggattgtaaaactaatagtttacctaaagaattattttatactaaatggagtgatggaggtttaggattaccaaaattatgggaaagagctaaaactttacaaattaagaacttcctaaatattataaaatcttttgatccaaattctaggaaattattcagacaatcttttattaatgaaatagattatagaaagatcgaaaaagattacaattcaccctatttaaatattccagttgatgagaataatataattacacaaattagtcaaaacagaacaaattgtttattctcaagaacaattaaatctttagccaaattaaaaattggtatgaagatgaactttaataaagaaactgctaaaatatgggacaataattcaaatgatattaataaaataatagttgatgaaacaaatatattaaaagaattaaataatattattaaaaacagacatggagaaaaattaagagcaaaacctatcaaaggtcacacatttaacacattacaaaattctccgttatccaatttcttcattgggaattataaagctccaactgctgactctattatacatttcgccgtagtttcaagaacaaataatttgcctacaggcgaaattttgtataaaaatggaatcggcgatggaatttgtcataaatgtaataacaattacaatgattccctcatgcacagattaaatggttgtattaatttaagaaataaatatactattcgacataatgcaatcattaaagaagtattaaaagaaattaaaccaaataataatattatatttaattatgataggccaatcagtaaaaagaaatataagattagaaggaaactccagaaatcttaaaccggatgtatggtggttttccagtaattatcaaaatcttaaaattattgaagtaacgtcaccatatggtcaattaactgacgacccaaatagtaatgaaagaaaatcaactttagagttaagaagaatagagaagattaacaagtatagacaactaattgaagattgtaggaatacatttaacgtccaagtggaattttatgttatagtagtatcctcgttaggtgcaattcctgaagaaacaattcatgaattaaaactattatataataatgaaagaacagcgagattagtagcaaaaagatgttcagtagccgctttaagagaatctatgttgttattatataagagttttaaagagtataacgtactacaaaataataatgatactactattaacattcagccaacatcatcaaatgaagaagattcaatcgatgatttacaagaagatgttggtgtaaatcaagaagaacttgttgacgaaaatgttgaggatgggttagggcatccccaacatgacgatcaataaagtccttaaaaaaaaccgacgagatttggtttatgaataaaacaagagtcaaagtgaagtagaataaggcggtcgcgtctataattaaagataatatcactaataacatacgataatgaataaacaagtcccgtcgaaggtgaattttttcttttttaatagaattaaattatattcgaacaaaagaaaaaaaaaattattcgacttttgctcaaatatatttcaaataatattttgatccaactatcaaagtttcccaaattaattttttattttttaacgttactattaattccaagaaacaaattgacaatttctttatttttcatttgagttgctagtgaggctgctgtgtgtaataatcaaaataatttccgaatattattttaagacataaaatttttataataaatatcaaataaaacaagcaaatatcataagcatttatggcaatttctttttgtttaagaagtaatttaactatttctgtatgaccatataaagatgcatagataagtgctgttttaaatagtttatatgatttccaaatattattttgatatcgtaaattattagaataaacaatatatataacaaaaaaaatttctttagcattaatatcaattccctttttgttcaagaagtaatttaactatttctgtataacctttttcagatgctttaataagtgctgtttcaaataatattttgatatatccaaaaaaaattttaataaacgataaataaaggaaataaatattgttggcattaatatcaattccttcttgttcaagaagtaatttaactatttctgtatgacctttttgagatgctataaatagtgctgttttaaataatttatataatttccaaatattattttgaaatatcaaattattaaaataaattttaaataaaacaaataaatattttttagcattaatatcaattcctttaagttcaataagtattttaaatatattttttgttattaattttagttgcagttataagtgctgtttcaaacattttaaataattttcaaaatgtaattagaaattgtaaaatcttaaaataaatataaaataaaacaaataaaacctaaataaaaaaattaaacatctttaacattaatatcaattactttttgttcaacaatgaatttaacaagttcaaaattttcagattttattgatgaaaacaatacatatccagaaagaagatcattttgaaggaaacattgcataagatataagttcccaaattgagctatataatcaataagactttttgtttattttcatttcttttataagcaaatacgacaaaatatcataattagaatattttaaacatttttcaaagtcaatttgttcaattttcttttcataaatatatttaaagatatcattcttatggaatttaattgcagcttcacatgcattatcaaatgatgaattattttgttcacacaaatgaatgatttcaatatttccacctgcaactgcatatttacctgtattttctacatttgcatcattcataagtaaaaatttaaaacatttaattgatccaaaaaatgctgcataatcaattaatgaaacatcttcttgattaataaatgaacatctttcataaagtgatggttcaattgtttgattaaaatcaaaatcattttttgatgatatttcttgaagtttttcgatttcatcatttcgaattattttcgcaatttcattcggattaaatccttcttcaactaacttcttatctagtccaaaatcttcttttgaaaatatttcagatgtagaagaaaaatatttagaaaatttataaataatttcatcttcacttacatatatgcgatattttggattgatttttttgagaacatttttgtcatttaaatcaactaaatttttttcaatcatttttagaattaaataatatgattcttgtgaattaatttttacttaaataattacaaaaatattttaataatttttggtttatctttgtttagagcttctaagtagttcagataaatataattgttttcttttttggaataaaatatagaataaattaggttacaaagaaggagtttatgtgaatatggaaaacttatatcaaataatttctttgtttgttcaacagagattttaaaattgtcttgtgttaaattatatattatttgtttaagtttatggactaacttattaaagtcagcgaacttattttcactttgggtattattaccatttaattgttcttgattgtcgggttgtgacattttaaatgtgaaaagacaagcttgttcatgagaacgatcaatttcaatttaattattatatcgaattatttaattttttcaaaagaagcttctaaagaagttataaattacttatacttatttacattttaataaatttccaccttcatatctttataattaacctctaagaaccataaaataaaatcactaaagttttgcttgtagtgaaaactattgtttgaatattcattgtcttttttgttcaacgttagataattatttaatatgatttgtagatactttatgtaaaaagtattttaaaaaatgataatataattttcaagcctaattttacacaaaaaatctaaagaaaatcattaaatttcttaatatataaaatcaaaaaataataaaaattcagataaatcatttattcatttcatcattcagcattaattttattctctttttcaaatccaatagggatttctcctccatatttttgatttaataattgaatttttattttgaatttcttctggaatttcttgaagaatttctttgttatattttataataatttgaaggagttgaagttgttgaggattaatttcttgttttcgaatattttcttgaagaatttcgatagcttttgttttattgataatagttaataattcttctttaggaattatttgaagttgttgaattaattgatgaataattgaccaatgaatatttgtttgtaaaatcatttgaagacattcttcatttgaatgtttaatatttaatgatgaaaaagattttatagctgaatttaaatctttatttaaataaaattcattatcatatttatgaataatttcttgaattttcgttgatttttcttgaagatttttaattaatcgataaatttctatttttgatattttatctttaagaattttcgctgattcaattaattctaaaagaacattttccgtagtaaaactttctttaattaattcttcttcaaatccttttaaaaatatttgacgaagtgcataaattgatataaaaatattaatattagaattatttagattacttttaatatgtcgtgaaataattggaacaaatcgtttaggtaaatatttagtaaactctgtttctaatataataataaattcaacgactgagattaaatttaaatgattggttaaatcttctataatatttggaaagaattctaaatatttacctgatgattgtcgaagaagatgaacaaaaattttttgaaaatgtccaacacatatcgaatcccattcatcatcgttccctaaaaaattagaacaaaatgttttaaatgatttcgaattaagtaaaattgtagaatacgaacttccaccacaaactaaaacttctgtagataaacgtgataaatgttcaaatttcgtctctttttcatatttaagtgtcatagaccattcacataattcagtaatgatatcttcacgtgaaaaatatgatgttaactcttgatgacctgttcgaaattcttgaagcatagtaccttcttcaagaatttctcgaagtcgtgtgtcttctttttgtaaaagttccataagtggatctgttgcaatttccatatcccaaaacattttttccttttttattgtggcggtggacgttaattttcggtttatattaaagaaatttcattaaaaagtttcatataaagaaaagattattaagaaaatttaaacattaaaaaaaaaacaactatttatcttgtattataaaacaaataactatgattccaagaaaaaaaatattaaaaattaacatttaaaattatgtttaaaaaaatgtttattgactaattaaatgatgcgtaattccaagcctatgttcatcattaagttctttaagaataaatgtcataacacttggttgactattaattaaggtgttaacagtaataataatttgtgttttatcagaaaatggttgtgattcatatttaagtggttgagttgtttgaatgtttccaagtgttttaagtttcgcacattgacggtgatgtttgaattaactctgaattaaattctaaaatactatcatcagtataaaatggttgaactaaattaacatcatctttaattaatttgaaataatgttcaacaaattttgttgatatttcttgaaagaaatcttccatcttttgaccaagatgaagacgtttattataaacttttcaattatatcttgtcagttttattgagttttttttcatgaaaaaattcaaaattaaaatcagaattatattaaaaatcacacacagaaatgatatattttaaagcaaaattttttttaaattttaatttacaaaaataaaaatttattatttaattacatttcatacatttattctatattttatctattcactcgcttcatttgtgttttgtattttttgaatttaaagaaacaagttcattcatcatttcttgaatttcttcttgcaacatgtcgcatttctgtgttaattttccatgaagaacttttcctttgtcaatttgttggttaatttcaattatttgttgctccatgtgtcgaatgctttcaagttgttgctccatttcctcatatccttcttcttcttcatttccagaatttttttctgattcaagttcagctgcagttcgctttagttgaagattaagtgttttgatttctttcttgagacgtctgtttgccgattcaacttcataaacagatgattgaagagatggaacttgcttagattgcttgttttcatccctatattttgcaatgagtgaagcttcctccctttcgtgtatttcgtatttttggatgagcttagaaagtactgtattttcaagagatgaccacatttcgcgtttttgttttccaagtgggataatttctaattctgtataaagcacatctttaattatttcttgatatatttgttgcgtttcttgcattaatgtttcgtttttggtgatttcttcttctaataattttcttgcaatcgattcgtcgagaaatgtgcataatcgaggttcaacgaatgggacttcttgtactgagttgtctatagtatcggcaatttctgatatagattttttatatctatttgaagcaagaagatcacctaattccataccaatacgttaaaatacaaaaaacgcaataaaactgacaagatataattgaaaagtttataataaacgtcttcatcttggtcaaaagatggaagatttctttcaagaaatatcaacaaaatttgttgaacattatttcaaattaattaaagatgatgttaatttagttcaaccattttatactgatgatagtattttagaatttaattcagagttaattcaaacatcaccgtcaattattgcgaaacttaaaacacttggaaacattcaaacaactcaaccacttaaatatgaatcacaaccattttctgataaaacacaaattattattactgttaacaccttaattaatagtcaaccaagtgttatgacatttattcttaaagaacttaatgatgaacataggcttggaattacgcatcatttaattagtcaataaacatttttttaaacataattttaaatgttaattttaatattttttttcttggaatcatagttatttgttttataatacaagataaatagttgttttttttttaatgtttaaattttcttaataatcttttctttatatgaaactttttaatgaaatttctttaatataaaccgaaaattaacgtccaccgccacaataaaaaaggaaaaaatgttttgggatatggaaattgcaacagatccacttatggaacttttacaaaaagaagacacacgacttcgagaaattcttgaagaaggtactatgcttcaagaatttcgaacaggtcatcaagagttaacatcatatttttcacgtgaagatatcattactgaattatgtgaatggtctatgacacttaaatatgaaaaagagacgaaatttgaacatttatcacgtttatctacagaagttttagtttgtggtggaagttcgtattctacaattttacttaattcgaaatcatttaaaacattttgttctaattttttagggaacgatgatgaatgggattcgatatgtgttggacattttcaaaaaatttttgttcatcttcttcgacaatcatcaggtaaatatttagaattctttccaaatattatagaagatttaaccaatcatttaaatttaatctcagtcgttgaatttattattatattagaaacagagtttactaaatatttacctaaacgatttgttccaattatttcacgacatattaaaagtaatctaaataattctaatattaatattttttatatcaatttatgcacttcgtcaaatattttttaaaaggatttgaagaagaattaattaaagaaagttttactacggaaaatgttcttttagaattaattgaatcagcgaaaattcttaaagataaaatatcaaaaatagaaatttatcgattaattaaaaatcttcaagaaaaatcaacgaaaattcaagaaattattcataaatatgataatgaattttatttaaataaagatttaaattcagctataaaatctttttcatcattaaatattaaacattcaaatgaagaatgtcttcaaatgattttacaaacaaatattcattggtcaattattcatcaattaattcaacaacttcaaataattcctaaagaagaattattaactattatcaataaaacaaaagctatcgaaattcttcaagaaaatattcgaaaacaagaaattaatcctcaacaacttcaactccttcaaattattataaaatataacaaagaaattcttcaagaaattccagaagaaattcaacataaaattcaattattaaatcaaaaatatggaggagaaatccctattggatttgaaaaagagaataaaattaatgctgaatgatgaaatgaataaatgatttatctgaatttttattattttttgattttatatattaagaaatttaatgattttctttagattttttgtgtaaaattaggcttgaaaattatattatcattttttaaaatactttttacataaagtatctacaaatcatattaaataattatctaacgttgaacaaaaaagacaatgaatattcaaacaatagttttcactacaagcaaaactttagtgattttattttatggttcttagaggttaattataaagatatgaaggtggaaatttattaaaatgtaaataagtataagtaatttataacttctttagaagcttcttttgaaaaaattaaataattcgatataataattaaattgaaattgatcgttctcatgaacaagcttgtcttttcacatttaaaaatgtcacaacccgacaatcaagaacaattaaatggtaataatacccaaagtgaaaataagttcgctgactttaataagttagtccataaacttaaacaaataatatataatttaacacaagacaattttaaaatctctgttgaacaaacaaagaaattatttgatataagttttccatattcacataaactccttctttgtaacctaatttattctatattttattccaaaaaagaaaacaattatatttatctgaactacttagaagctctaaacaaagataaaccaaaaattattaaaatattttgtaattatttaagtaaaattaattcacaagaatcatattatttaattctaaaaatgattgaaaaaaatttagttgatttaaatgacaaaaatgttctcaaaaaaatcaatccaaaatatcgcatatatgtaagtgaagatgaaattatttataaattttctaaatatttttcttctacatctgaaatattttcaaaagaagattttggactagataagaagttagttgaagaaggatttaatccgaatgaaattgcgaaaataattcgaaatgatgaaatcgaaaaacttcaagaaatatcatcaaaaaatgattttgattttaatcaaacaattgaaccatcactttatgaaagatgttcatttattaatcaagaagatgtttcattaattgattatgcagcattttttggatcaattaaatgttttaaatttttacttatgaatgatgcaaatgtagaaaatacaggtaaatatgcagttgcaggtggaaatattgaaatcattcatttgtgtgaacaaaataattcatcatttgataatgcatgtgaagctgcaattaaattccataagaatgatatctttaaatatatttatgaaaagaaaattgaacaaattgactttgaaaaatgtttaaaatattctaattatgatattttgtcgtatttgcttataaaagaaatgaaaataaacaaaagtcttattgattatatagctcaatttgggaacttatatcttatgcaatgtttccttcaaaatgatcttctttctggatatgtattgttttcatcaataaaatctgaaaattttgaacttgttaaattcattgttgaacaaaaagtaattgatattaatgttaaagatgtttaatttttttatttaggttttatttgttttattttatatttattttaagattttacaatttctaattacattttgaaaattatttaaaatgtttgaaacagcacttataactgcaactaaaattaataacaaaaatattgttaaaatacttcttgagcttaaaggaattgatattaatgctaaaaatatttatttgttttatttaaaatttattttaataatttgatatttcaaaataatatttggaaattatataaattatttaaaacagcactatttatagcatctcaaaaaggtcatacagaaatagttaaattacttcttgaacaagaaggaattgatattaatgccaacaatatttatttcctttatttatcgtttattaaaattttttttggatatatcaaaatattatttgaaacagcacttattaaagcatctgaaaaaggttatacagaaatagttaaattacttcttgaacaaaaaggaattgatattaatgctaaagaaatttttttgttatatatattgtttattctaataatttacgatatcaaaataatatttggaaatcatataaactatttaaaacagcacttatctatgcatctttatatggtcatacagaaatagttaaattacttcttaaacaaaaagaaattgccataaatgcttatgatatttgcttgttttatttgatatttattataaaaattttatgtcttaaaaataatattcggaaattattttgattattacacacagcagcctcactagcaactcaaatgaaaaataaagaaattgtcaatttgtttcttggaattaatagtaacgttaaaaaataaaaaattaatttgggaaactttgatagttggatcaaaatattatttgaaatatatttgagcaaaagtcgaataattttttttttcttttgttcgaatataatttaattctattaaaaaagaaaaaattcaccttcgacgggacttgtttattcattatcgtatgttattagtgatattatctttaattatagacgcgaccgccttattctacttcactttgactcttgttttattcataaaccaaatctcgtcggttttttttaaggactttattgatcgtcatgttggggatgccctaacccatcctcaacattttcgtcaacaagttcttcttgatttacaccaacatcttcttgtaaatcgattttctttcattactatttgggtcgtcagttaattgaccatatggtgacgttacttcaataattttaagattttgataattactggaaaaccaccatacatccggtttaagatttctggagtttccttctaatcttatatttcttttactgattggcctatcataattaaatataatattattatttggtttaatttcttttaatacttctttaatgattgcattatgtcgaatagtatatttatttcttaaattaatacaaccatttaatctgtgcatgagggaatcattgtaattgttattacatttatgacaaattccatcgccgattccatttttatacaaaatttcgcctgtaggcaaattatttgttcttgaaactacggcgaaatgtataatagagtcagcagttggagctttataattccccaatgaagaaattggataacggagaatttttgtaatgtgttaaatgtgtgacctttgataggttttgctcttaatttttctccatgtctgtttttaataatattatttaattcatttaatatatttgtttcatcaactattattttattaatatcatttgaattattgtcccatattttagcagtttctttattaaagttcatcttcataccaatttttaatttggctaaagatttaattgtccttgagaataaacaatttgttctgctttgactaatttgtgtaattatattattctcatcaactggaatatttaaatagggtgaattgtaatctttttcgatctttctataatctatttcattaataaaagattgtctgaataatttcctaaaatttggatcaaaagattttataatatttaggaagttcttaatttgtaaagttttagctctttcccataattttggtaaccctaaacctccatcactccatttagtataaaataattctttaggtaaactattagttttacaatccttcataattaatttcttaatcattgtatcaatattatttaattctttctctgaacaataaccatttaataattcgaaatctatttcaggaagaatcattctttttatcacatctatcttttgattaaattttaatgaggatttcataattttaatgatttcatttttaatttttatataatctaatattagtatgatcaaaactacctttttatttaattactgcagatgaacctaaatattctaaagcttctaataaaggtaaattaggaatattttcattctgaatttgtaatttataatttaatgtaactcttcgattattttctttaatataacttaaagttttacattttttttttttttttgtcatataattcttcttacagcacttttctactgtctttaacatgttttgcataccttcagggggtttgagaaatcaagactatatcatcagcataagcttgaatattaaaaatatattacctcattatcatttgtattaattggaacaccatctagtttatgtttaatctggattttctttaataaaggttctaagcataaattaaataataaaggtgataaaggacatccttgtcttacacctctatttattttaatttgttcagttcttttatttccaactttgatagtagtataagaattatcatataagtctttaattgcttctataaatttcgttgggaatcctcttttctttaaactccataaaatagctttatgaggaacagacccaaaagcattagtaaaatctagtgtagtaataatgattgaagaattatttcttttagcttcagaaattaattcatttatagttgctatatgttctgaaataccattaataccagctttaaatcctttttgtacatgattaatgaagttacaattttgatttataatttggataatctttgatatctgacacattacaattctatacaatgtatttgatattgatataggtctccaagatttaatttcttttggatcaccttttttatataataatattgttttcgaattctttaaagtttgtggaaattttccgaatttaattatttgttcattaatcattttaataattttagtagttgatttaatatctattttccatataggatttccaattccatctggaccattagcagccatatttgatcttgatcttattgaatttctaattaaatccttatctaatagattatttaataaaaaatctctattttcttcgtcaatcatttcttttaagtcctataaactattttcttttggttattcaaaattcgcaattttctcaaattgtattttataataattcccaacttcttctatatttaaatcacattctggtataggatcatttaatatataccatctgatagctctaactggatcttctcgatacatgttttgagttatatttttatatttctttgatataatattcatattatcttgttgaatattttctaatgtagctgaaatataatttaatctattttctctatgttctggattatcattaataatgtttcgaatatattcaatgttatttcctccaattattttatttaatatatcattattagtattctttaaaatatttactatttctatttcaatacttgaaatagtatttaatatagtttgtgtaggtgttttatcttttaattctataatccttttaatataactagtaatttctgataaatttctaattatattgttttgtcttctaattgtaagtttttgtctaaagtttttagtaagtttaggtaaatgaatctcattttgttcttctatttctaccctatttaaccattttctacattttattaataaattatttctttcttctaaaataatttgttgttcttcttgagtcattcctatattttctacttgttgttgttcctgattattattttgttgttcttcttgattattatttagttgttcttctcgttgttgttctagattattattttgttgtacttcttgattatttggttgttcttgttgaatgactctttgatcttgattttgtataataatattattatttctattaatttctccattattttgttgattaataataatatttctatcattgaagtgattattattgttatcatctgttaattgttcttgaactttaatttcattttcaatctcatcaatttgttcttgtaacaggattctaaatattgtggatttaattttaatcttttgttttgtaataattgtaccttttattcttgaatcactatgcattgaaaatgcatgtaattttatatttccttcattagctgtaattgtcttttttacaataaccacattataaaccatttctttttttcattaattctttaatatttggtgttctattaacttgatttatccaatatttaatagtcgcccaaatccatcctatttctgattttttatcaactatatatttgtgtttggttttcatatgtgaagaaaatgaaccctgattcataatagtaaaataatcacaatttggacagaagcaaaaataaagattcttatgataactttgatgttggtcttgtaaattaacttgttcccaataattatcttttaaacttaaaaagtttagaaattctaacattgtacaacctggaaatgttttattatgtatttgtttctcatgatatttcaaatgaggtacacatgtgtaaatgcttctccatctccttgtgtacatacaaaaggtcctacacctggccaacttttttcgaatgctataatatttaaaattggtattttaaatctattattattgcacatgaataagttctcgtttaaatctttattcttccatttattaattactaatttaatttcttctttagtattcgcatttctaatatcatttaataaattttctggtgttaaatcttcttcatcattaatattattattatttccattattgtgattattattattattattatttaaattgatgttattgatttgattttgattttcttgtggaatattattgttattgaatcctaaggttgtaatatttgagtttagttgattttgattatcattgttattttgattttgagtttcgttattatttagatttatattgatattaatattgggtaaattatagtttggtgttggaaaattgatatctttttctacaaatttaatttttggtatttctataatttgttcattaactttaatctgtggaatattaaatggtatacaattccttcattgtaatacggaataggaatattaatattttgtacttgattttgatagtttggtattggaatattaatgttttgtatttgattttgataatttggaatattaactaaaaagttttcttggttgtattgaggtattggtattgtataattttgtaaattttgttggtaattcggtatgtctattttgaaatcttcttgttgataattaggtattggaattataaaattttctgtttgtttctcatactctggtattttaataggtaccaatttttttttttttttaggaattggtattaaataattttctttattgattttaaaattaggaattgtaattaacttgtcttctttattgtaataaggtataacgacattaatttcttcattattgattttgaagtctggaatatcaataattttttctttaacttttactactggtaaatcacaatttatgtttttctgtgtaatagagaaattaggaacattaattggatattgtttaacttgtgtaacatgagaaatgtttttatttagtctaattttgttatttaagaattgtaatgtgtcaggtctgattgataatgttttatttataattcgaaaagtatctggtggtaaaattaaacctcgataagaacatatattcgggatctcaatattgatgttattttgttcgatgattaatatccaatatggtaaatcaatttcagtaaaatctttgttttcataatgttcattaattaaataaatttctctccaagcatctggattaatattattgaatattccaaaaatcaacttgtgtttttaataaatttaatgctgtcggtaatttttccgtaagtttttgtccatgaaaagattaacgtccaaaataacccgacggtttgtaaagaatttataattatttctgaactgtggtcttgatttatatggttgattaattcaaaattgttagaaataattttataacaatttggaaacggacagaatcttttataattttttgattttataatatatttgtttttagtcaataatctttgtatgattctttcgtgaaagagtaattcttgattagggtcaatatcatgttcttctgataaatgttttgatagtatttgaaaatcttttgtgaaaaaattacattctggaactaatgaacaacaaaatggttcgagtaatggaatttcacgaaactcatttaatttgaataattgagaaattgggaaatttaaaaaattatgaattaataataaattttgctgtaaccaaatgttaggctttggtatttgtttcttgattgctttgataatagttcttttaatttcttctttgttgggaaaatctttattaattatataattttgtaaaaagttttgtaatgttcgatctgtaataatttctttgttatctctataataattttcattaatatcccatatattaatcttatcttgtagtacatggtcgaactttaaaatgtaaatatcttcataattattcgtaattaaagattcgtttcttgttgatcgtaattcagatgtatgaccctctattcctgtaaaattgttcgtctgaagttttgaatttccaaataatctatctgatgaaaattcgaattttgagaaaagggtatcattcgattcctctccctgtaacggagctaaaggcgaattctcagcaaaaatagaactctccatcaaaaaaacaaaaaaaattcaccttcgacgggattcgaacccgcaaccccaggattaaaagtcctatgctctaaccgttgagctacggaggttcttgttatcttaaattcaaaaaaataaaatatattatagctttattttcatgtgatgatcttttttgtttttctcattaacttaaaaaaatttattactgtttaattttcatttttctcatattttagttgactcaaaaattatatcaaatttcaaagtgaataaataggtattttttgcttatttttgtttttattttttaattactaatatcattatatatgagtttatactgattccgagtttgaatctcccatctgtcatttggatcgaagtattcaaacttgcctagctcatactctgatgttttttctgtcggttctgcagctttccgtaaccaaatctgcaaatttgtatcaaataaccaatctcttctttttaactcttttcctgcgaaatatctggttatagaactctttgtgtaatagaatatgaaaaacaatgttgataaatcatattttcgcattgtttctggttgaagaagctgttgtagtggtttctgtggataaccatttggatgtgaattattagaatctaccgttggcatcatgtcataaggagggtctggtataagattttgtgaagaagaaagggcataagcaaaatcttgttgactgagatctgattgaaaaattgcttctggtgattttataccaaaagcatttaattgctgaaacaaagttggctgtggtattggtttctttattgattctggttgatttgaaacaggagctgaggaagcagaaggtggtggatgcgtaacattattagggtgttggttacgctttggaagcgacgaaaaagaagggaattcttcgtcaagctttttattataagaagaatttacacggctcatttcctaaataagtcgtccgtttgttcagattattaacggtcccattctaattccatcaccatcaaactttttgaatgcatattcggccgattacagcggttttttactatttcctatatattaaactcgacttatgatttccacccatcgtaaatagcgatcatcctacgatattgatatcatgaatatataatatatatgcatagttgcatctatgattaatacaaatctaaatataatatcataattatcacgagataaatctattctttcattttaaaagtgacaaaaatcgacttttgcatgatttatatcaaacgatagcagtaacgattagtgacgataaaagcaaatttgaatgatggtaaatattatcaaaattttaccctttcctcggaaagatacgttatttatctacatcattgtaatttgggaacatccaaattaaaattcttggttcgttaaagaataaaaatattgatatttcatcatagaatcctgatttgttatttattccaaataattatatgaaatcttgattttcttgaatttatggatttattaaaaaaatgaatgatgtgataatttttgtaataccttaatgatttacttatctaacctgattaataatttattatcgataaaatagtttctgtgtaagtacatattcttgaaatatcttgaaacgactatgattttttttctgaaaaaaccgatttttgatcattgaatttatttgatgatttttttatttattttcattaccctatattagcaaaatgttcaattttatcgattaaatatctatacaaatgcaatttgcaaattatctttaaaatactaacttgaaatacatttatcgattccttttatctcatattacttatgtgctttcaaatttcaaatatattacatttttcaatttatttgacatctaatgttatgatgttgatttctctatttttccgaatttgattcgatatcaccgtttcttgagcaagctttattctgaaattgtctctgagaacgatacgagctgattgcgtgatttttatacgtccactcattcaaatttgacttcgaaccgcttgaacatgtaaaatgatatcaataacttataatcagattataatcgtatatagcgatcttcctacaaccttgatatttatgaatatataatatataaatacattgtgcattcatgattaataaaactaagaataatatctcgatctattaagtaattgaaaattcagaaattaaagtattcttcaataagtttcccgaacgatacacttttttaggccaataaccctcgcacttctattaaaaagttctattgtttgggaaatttattgaagaattcaaaatttatttgttttttttagtagttggtatgattttcattattgcgaataacttgttgcagtctgtcttgcatagagtttgcaagattttgaagcatttcaggggagatgcttttccagacttcgaatatcgcagcacagagctcacaaatggttttcggtctaagttcataaacttttcttttcataatcgcccatagattctcaattggattgagatctgggctcattgtaggccagtcttctagaatgttaacgtacattcttaagtaatctatagtttctctgcaagtatgagcggttgctccatcttgcattaaaatccaacccatgattccatagacttcattcatatgcggtatcaaaccgcttccatttatcagttcgtctacataggaaacatggtcaatggtccctctttcaataatgatgaggtttgttttgacttgggaagacatcccaccaaacaccaaaaccttatctgggaattttttttcactaactataacttcaggacatttctcgcctttttctcgataaagaggtcgatgatcctcgttgagccaaaagtagctttcatctgtgaacagcacttttgtccagtcggttccaagctgcaaatgcttttgtgcaaacaataaacggtcgcttttctgtttctcagtaagtgcaaatgaaatcaatgggtagctgaatcgatattctagaatttctctcgctatcatgatggtagattcgcttataatgttgttgaatttttcagattggttagcaaagactgataacgaaagatttgataatcgtcgattttctttcgtcatatcatcaacaaattccaggagttctgtcgtaatttttgtcggggctccaagttttgttttttgaaagcaaatgtcttccccatctttaatcatttttcgaaccaattttacagtcttgtggtcatgaccagtcatccgttggatgtccatatctgaataccctaggtatatccattttgctatttcctgccttctttttattgttgtttttgtcgccagcatgttccttgtctgcggaagttatttgatagctttacgtgggaaacttattgaagaatactttatttgagaaataatgaaatattacttgttttatttgattatataaaatcttgatattaaattttcttcaaatcaatcgaaaatattgataaactcaaaaaaattcgaatatattattgatggcatattcatgtaattgtcgtatatgagttattttcaataagtgaatgcacattcagccatatattggtacaaacaatacaaaactttctaacgataacttttttaaatggaatgacagtttttttattattgaattttttcaacggtacttttttcccctttgcatgataatttaaaatcaattgaaaaattatcagtcatcctgaacaagaaggaattgatattaatgctaaaaatatttatttgttttatttagaatttattttaataattttatatttcaaaataatatttggaaattattttgattagttgagacagcacttatgaatgcatcttcaaatggtcatatagaaatagttgaattactttttgaacaagaaggaattgatattaatgctaaaaatgaaatttattttaataattttatatttcaaaataatatttggaaattattttgattagttgagacagcacttatgattgcatcacaaaaaggttatatagaaatagttaaattactttttgaacaagaaggaattgatatcaatgctaaagatatttttttgttttatttaaaatattttgaaaaaatatgaaatttcatataaacatttggaattacttataaacatataaaacagcgcttatgatagcatcaaaaaagaaaaatgcagaaattattcgattatttgcagacaaaattcaacatcataaatgtgacgacataacaaaattaaaagattctaaaggataaaagatgtaatatttaaatattgaaataaacatttcctaaattcagtttgtcttcatatattattatcaacgcattaaatttgattaatattattattatataaatcaaaatttgataaatagaatattttatatcatatttcattgtatgattttcatataatttgatgataataatgtgaaaaaaatgatgaaaaattcatagcaacaaaatattaattattattcatagtattatttactcttaaagtttaatggaaatctattgagtacaccttattattttcagtcccattatacaaaatatttgtgaggaatcgtattaccagggcataacggtcgtttccattgaattattgtatagtttatgctttcaaattttttcgataagtgacgctttacgccaagtgaaattaaaataaaaaattgaatgtgataaatcgttttgcattgatcaaaattgaataaaaattgaattcaattcaaaaaatcagcttgtgtatctaagattgaaagaattttattaattgtcttcatttattttcaattttttttttctaaactttcgatatatcaattagaacttcctctatttattattacgaattttcattcagcacaaaataataaaattattttttatttattacattttaattttctttcgcttttccttctattaaatccaacaaattctgtgtttgcgtatacaatgatccccacgatccgccgcttcttttattatcattttccaaattatcgactcgcgcatttaactgcaccgattgcgtccatttattcaatgcgccatttacctcatcgaacattggtaatcgcaaagttacatctttttcgtcgaccttcacagccattacgttatgaattcttgttaaattagagaacgcgttacacaaactttcgatttgtgccgaaatattttctttatttgcgtgtggtattgcgtctgttaatttcatgattctatttttaatgtttgcaatgatgtttgttattccatttgtataatctctttcattgtttatcagttgttcaattttatcgattaacaaaacgattttttgttcttttttaactttatcaatgttatgtttatcatagatatgaagtcgttctgattgtaaatctattatttgctttaataatttgatatattcattagttaatgtttgagttcgttgagaacatttataacgctcaagttcgaatgtatcaattcgttcataaatagtaattgcgtcatgtaatgtattatcacttttataatggatttcattaattaattgttgcgatttctctaattcgcttttagctttagtgatttcttcatcaatttgcgataagtcatttaatgatgctttaaataatatgtcattcgaatatgtaatttttggtatgttaatgttctccgataatgtttcaatttcagtataaagagtttcgagctcttctttcgatctcattatcgatttcttggattctgttttcaatgtaattatcgatgtacataactcagaacatcgttttttatattcatttaaatcataaatatcaatttcagagtgaacagaattcgatccttgcgtttgttggatgctttttaaggtgctgattaaccttttaagaagtatctttttctttggtatgtgatgtgatcgcaattgctgtatcttctaatatgtctttatgatagaacttttcaatctctaaatacatgttgagcttttcttgtgagagaaaacgtcgggccttttgagctgccataattaaaggtgacgttttttgcttcttggaattgatgtcgagtaaacttgacaaaaattcaatgtacttcggatcgtcaacccccgtaaacggttcctcgtttgatttgtagtaaagaacagtggaattttggcccgtttcatctatgaaaaagataccacgcttcattggaaacacaaagagtgacgattcgattgatgtggaaaattcaagattaagccatacattatgctcaaaaatatatatgagagcatcacttgatacgaccgattgtgaaagacctccagtgataaacaagttaccaaagaataatgaggcatgatgtgacctacgtgctggatataaatatggagaatcaattattgtgacttcgcccgttgaaagatcaatcaaatacatgtttcgattttctgctttgttagcatgaattcctccatataaacaaacttgggtacctgatacatatgtgactgtatgatgagagaatggtaaaggtgttgataaaggaattgttttggattttcctgattttagatctagaagaacaaaatcttgataaacattatgatcaaaagatcctccagataataaaactgatgacattgttggtatccaagtgcaactgtgataagcacgtggagccaaatcatgtgtaaaagcacgccacctatcaactgcaaaaatccatgcatcagatattgtttttccactaacattgcctccaaaaacgacaattccatgtggtgtagaagtcatagaatgaccactttctattgaaaattgtggatcagcttcctttttccattcttttgagttatatgtcaatgaataaagtccgtttggtccaagataatacaactgatcattgtgtacagtcattaactgatggtgaagtctagaacgctctgaatcgataactggtttgtgggaaagagtgttcccttcatgaagcttcgtcatttcattcattgatgaacaccgtttaatagttgaacgttattataaacaagagaaaagaattttattcagtaaaagaatcgtgaaaaaacattttctgagtgacatgtcttataaaactatagattcttggtcaatagaaaaccattgaagcttcaatctctctcaatggcatagcgaaataattttaaaggagaatcttcataataatcataatcttcaagtctcaaaaagtcatgcataagtcttccttaagaacttatcacataaagattggaattggactcaatattgtaaaaacttaattgtttcgaatcttctaattctttctataaaaagatcagactcaggataactgatgttgaaaaaattcttgagcatgatggcactttttatgaagaaaattcaaataatttattacaattgtaaggtttatttacttcattgagaaggatccactttttgaagccttaatgaagaaatgggtcaatctggaagaaaatattgtgcttggacaaagaaagaagaaaaaaattcaaagatttaagcagcagctttggcggtgatctcaatgaatttatgaaatattttcctgatcgctccggagtcaataaaaaagaaaataacaagaatgaacgttaaataaaattcttaactttacttcgctattttttgtgagaataattggttggaagttctctgttgaattccttggcataagcttttaataacaatgtgttattatcctgaagacatttgtttcggcttttttattcagtcaattataacaggtatcggctcaattattatggtcatatgtggaggtgtgttttgggggagattgaactttgatccaaaattattatccatggtttcacttccgttaacaccatctactgacaatccgcgagatatatatatagtttcaaatctaaccaatcaatctattttttgtgataataagttttcaattaattatccaggtgtgtctggaagtagttttttttcgttttatatcatacacaacatgtttagctatgatatcaaaattactattgatggtgaaaatgtgaataactttaatgtcagcttcaatacaaatcgtgaaaatctaacaattattgaatatcaaaattttgaagatcttaaaatcgattcatcccctcttagggctggtgaatattttagggcttggtgtccatcttcatcacttattacccaatacaatgacattgatcagttatgtagtacaagtgaatatccaatgaaattcgacagcaaatatacaatttcatacattggtggtgctacactctcacaaacacaaaatattttggaattttacaattcgacatttattccaaataattacattgaaattccagaagtgtttttggcaaacattatcaattatgataaggactatacttgggaaatagtaaccattgtcggtgttgtggcctttcctctttcattgatcgagggtttgttgatattttgttgtgttctcctttaagcaaggaaaaatatttataactgtattaaatatcattttaaggtttacttttttgatattttcattaattaataaccttgtgtctcatcatattatcaaaaaaaaattgagaattatactatatatatgaatcagatcaacaaataaaattttatgattcaccgatgggatttcattcataaattatttattctttacactcataacataaaacatttacaaattatttattatttacattaaatatttacaaattatttattatttacattaaacatttacaaattatttattatttacattaaacatttacaaattatttattatttacattaaacatttacaaattatttattatttacattaaacatttacaaattatttattatttacattaaatatttacaaattatttattatttacattaaacatttacaaattatttattatttacattaaatatttacaaattatttattatttacattaaacatttacaaattatttattatttacattaaatatttacaaattatttattatttacattaaatatttacaaattatttattatttacattaaatatttacaaattatttattatttacattaaatatttacaaattatttattatttacattaaatatttacaaattatttattatttacattaaatatttacaaattatttattatttacattaaatatttacaaattatttattatttacattaaatatttacaaattatttattatttacattaaatatttacaaatcattaaacgcaattcacaaaatgttttaatgtttactaattatttacataaactttaagttgctcaagttcacattttctttcttctttatgcatttacttaactttttcccgttttctgcgatgaacctttcgaactttttattcatttgatttatttcatctatttctctaattttgagttcttcagtatcatttaatattttatcgaagtttttatacaattcgcaatttctatttcttaaacatttattttcttcttctatttttctattttcgtattcgatattatctattttttgtttcatttcttctatttccattttaatatttttgttaatatttttcaattcatttatttttagttttaattctttaatttgagaattttttttcagtttttggattttatcgttttggcactttttcatcaacttcaaaatttttttacatttttcttcattataacaattttcataaaatggttcaacttcgaattcgcttttgtttttatcattaatttcttggacaaacgaagttttcgatttgttacaaaacaatttgcaataattttcatctgatgattgaagaaatataattatcgaacaattatttgttatgaattttaatatttcgtcaaagttattgttatttgttatgatatttttcgatttgtttttgatttgatatattatcttcgaaagttcaatgatttcattgtcgtctgttaactcgataataccaaaatatgaattaaatgttgaaattattgttatgttattcagagggtgaaatgtttcatcaagtttttcgcttccaatgtaataattcttttgttgcgttgattgtaattcattgtttgtggtcaatatgaatgaaattatatgagaaaaattaattacatgacaattaatagaaacaagtaaaaaattagagcctgacatgaactttatgatgttcttttggatgatatgaaaaatgttttcttctattcgtttggttgaaagtaatgatacagttgaaaaataatatttgttttcgatttcttgagctttatcattagtcttaataaatgatacattgttcattccaatcttttgttcatcttcaatttgttcaagtaaaaaatgagtttcaacaaatgtttcaaatttctcatttatcggtaatttttttgtattacttaaattttcaagtgctcttgcgccgcttttctttccttttatcaaagaagaaacagattttgagacgtgaagaaaacttttattttgttgattaatcgttaattaattttgatgtgaaaacatcaaatgaaaaaaaacgttttttctattgaatttttgaatgcacattgaatttgcattcaaaaagattttatgaatttgttgatgcaaaaaaatcttcattctcatatatgagtaatccacaatcatccatgcaacaaagaggatatagaccaattgttcctaataaaaaaagaaatcaaaatattcgatatagaaatgcatcaaaatcaggtgctttgttttatgttcctgacgaaatgaacttcatgcttagaatggcgttcttgttatcattgttcttgttcccaatgttcttggtatggaagcaatttttcttacctttattggtttgtgcttcattaatttatataatgagagtagcaatcgaccacaaatccgaaaaattggtaaagaagatggcatcgatttattcttttgatgatattgaatcaatgatagaaaccaggaaacttgatgcagacgtttcaagaagagcaaagttatttttaatacgaaatggccaccaaatgcgtcggagaacattgcaataaatcattcataaatttctctttttttttatctaactgaaccttctgcttttcattaacttttaaatatttctttaatattattttgatattgtacaaagttgttgccaattgattcaccattaaatttgtaaaactgtttgcatgataatttaacggcctctcagtcagatctgtcacttttatataaatgtttcaaaatcaacaaaaaagtgcttgatcgatgatatcaacagcaaaacaactttattaatgtatatatattatgtattagatccatttatcaccttcaccaaagaatttggcaatactttcgcttaggcctttctcatcgttttcaaggtcttgcatttgttcatcaaatttcttgtcagccgcaatattatttccgaagtttgaagaacttttggtgttttgtttatttttattttttttatatagatatataattattccgataataatcaaaacaattgcaaatgaacaacatactatacctatcaaaacattagtacttattgtatcatttgcttgattaaattcgtaataaaccaaagtgaagaaatcggaataatatgttcttaaataggaatatataacatagtcatattcataataaataaactctgtataaataaaaatatgcgaatatgaattagttaaagatttcgtatatgaatatgaataatacattgttttaattgtaattgatttggtgtatgttttttgttgcagaaggataaatgaatgtgaaacactggcatcaattggaaatgttgaagtatatgtgctggaaattatgtttgagcctgaaaatgtttttgaataagtgtatgattctttattaatattcgattcagtgggtgtatttgatttagtaatagtattcgtttgtgaatatgtatttgatttagtgaatgttaatgttgatagttcttttgtgataaagatatgtgatgtaccacttaatattccatagttatcaattgatgcaacatgaacatgaagatctccatctttaatatttgttattgttccatttgttatttgatcttcatttaagttttcttttgtaatattcgtgttttcattttcatcaataatgtaataatattttttgacaaatgttgtaagattaaattgtgttggtgatgattcatatttaatttcatttgttgtgtaagctacgactttatagtaaattgttgcggtttcataattattacttgtgttaatttcaattgatctttctccttcaattcgggttatatttggtggatttaattttggcgtttcgactgaattatcatatccatattgaagtgatgttctttgatataaataataaatagtgtttacaagaagttgtctttcatataatgtcgcactacctaataaatgtcctgtttgaatcattgcggtgtttttatatgttgtcaagtaataatgcggattaccatatcgtgttccggaatatccatcaagtgtccattcatagttttctatttctgtaaaatttccgaaatttggattttcaaattcacctaattcaacccaaacatcaccaaatgcagcatttgaacttgtatgcgttaaattaattggtaaggaaacatcagatggaatgtagtatggataatttgtaactaaacctcgattagttactttaatttctttagaaaaatgattccaatttgtcgatattgtacctgttgaacaatagccactaacattacatgttgctgaaccaagtttgattccgaatttatctgcaatttgtccataaccaaaagagttcccataaaaataaccaacaacatcatggccaaataaaacactatagttaagatcaatatattgccaaacacgttgaactgtttcactatacgattggcaataaggtccgccattcatatccataaaaccaataacaataatatcataatttattatactttctaaactcattaattcaaaatcactacttgatattggagtaacacttataatttcttcttttgtttcaaaattcattcctaaactttcaaaatcaaaattttctccattatatgtataactacctccttcaacccatactttaagaatggctgaaagatgaagtgttttattctctgttggttgagttttatatacaaaattaacctcggtacctgttttcggatatacattaagtacttttatgttttttgtggtagcaaaatcgaataaactgattggatgccaatataattcatttctttgtgaataaactttatatgttaaattgtgatctatatgagatcctgtccaattgagtaaaacatgattatcttcatatttaacttgaagattaattacatttgctacaatagaagatattaaaataaaaaacaatccataaaatttgaaatgttttttaaaaaaatttttgcaaacgaaatggttgagtaatggtttgagtgagggtaagctttttgcatatggatatgcatttgaaaagccaaattggagtgatttgcttttcgtgttgtttatcatttgagttttgaatggatgttgggaatttttcaaatcgaattggagttaagctttgaaaattgtgtggttcaacccgcaataatttttttgactgttttacaaaattatagttacttaattttgttccaagtgaccgttaaatggaaaaaagtcgcttacatccatctgaaaaatctcaacgatagaatcgaatgaattaaaaattatcggatttatattcaaagtgctatagaaagccaaccaacattttttacccaaattttctactaatcaatgtgtactcgtcacatttacattgcaatataaaacttatcataaacaaacaacaatatgtacaatattttttcatattttgtaattttaaatttgacaatatatttttcttattttgcgtcattcaattcgatgcacatgcatctgttggtgttttatttctcatatatatttgctctaactttccaagataattgattaaaaacatctaaaattaacaacaattttattcaattaccgtaaaatacaacatcaggcacacaacttcctgtttcatttccgaagttatctaatatgttaatatatattgttctcaagcgaacaacatccgggagattgaattcatattgatcgtctcccattgaaaattccgctatcgttttcgtcacatcattttccaattttgctgaaacagaaaactttttaagtaaacacgattggataacagttttctggaaaacgattttcgaaacgttataaaaattatttccgttgttaaaacgaagccttcctttaatgttatctaagtaccataaattgttgaaatcttttggaattggcgaatctttaaactgcggaaagaactttggcattgttttgatgcttctgtgaatgcgtctgcgtgatgccttagtgcggatggtctttagaattagagggagttcgtattgataattcgtaatattaaacattttttgcatgttttcgaatatcgaaatttcggagtgaagaatatctttgagaagtcgaatttgatctgttgcgcttacgctgcggaagtgcgcggcgtcaatgaggtgcggatgagacgcgacttggaaactcagagtctccggaaagcggtacacggatatggcttcggactcttcggtggatgagctttcggctggcgcttcgtttgtatctatctgaaattgcgtttgtgactgattaatttcatctgtttcttctgtgtcagctttggcatctgtagaaatttcttcttgtgaaatttctgcttgtgattgattaatttcatctgcttcttctgctttgttatcttcttgagtttcttccaatgtaatttctgcttgcaaatcaccatttgcatctgcttgtacttccttacttatatctgtttgtgtttcttcgatttgatctgttttagttttttcaaatgcatttgtttgtacttcttcatttatgtctgctttaatttcttcattttcatctgtctgcttttcctcatttcgttttgtttcaagttcttcatttgtttgcgcttcaaatgaattttctatttgtatttcttcatttgcatctgtttgtgtttctttgatttcttctgttatttcattacaagtttcgagttcttctgcttctttatttaatattagttgaacattttcatatgtttgtgccattgtttcattgtttactgtttgttcttctgttatttctttatttgtattatttagatcaacttcttcagtgttatcttttgagagaatttgttcgtcttctggtaaaatactgtggttgttttcttctattatataaacattgtcgttttcgtttgttttatctgttaaaagagagtaattattttcttctgttttatctgttaaaagacttttattgtcttccactaaaagagagtaattattttcttctgttagtgtgatatcattttcttttattgaaagagtattattttcatcttttattaaatatgaatcattttcttcagtttcttctgtagaaagagaattattttcattttctattaaatgtatatcattttcttcagttttatctgttaaaagagttttattgtcttccactaaaagagagtatttattttcttctgttagtgtgatatcgttttcttctattgaaagagagttatttattgtatcgcacaaatgcgcatcatcttgttctattaagatagcactgtcatcttcttctgttttattaattgaaagagtttcattgctatacattaaatgcattttattttcttctgtttcatctttagaaagagtattcttgatatatgctgacagagtattattttcttcttttgtttcttctattaaaagcgtatcgttattttcttgatttaaaattattttattattttcttcttctattaaagtggaatcatttccttcgaatttatctgttaaaagaatattgttatgttcttctgttttactttctatgagagtttcgttttcttttgtcgaaactgtttcattatttgcttcttcaatcaaaaaattatttttagtttctgcaaatttatctgaatgtgtgtcgttctcatctacaaaaagagtacaattatgttcttcaaccaaaagagtattttcatctattggaacaatataattatcatttccttcttcaatcgaaagagtattattgtcttcttctgttctatttgttgaaactgtgttgttttcatctacagaaagagtggaattgttttcatcatttaaaagagtgttgctggtttcttccattaaaagagtatttttattatcattttcttcatcaatcaaaagagtatcattagtttcttcaaatttatctgttgaaactgtgtcattttcatctataaaaagagttttgttgcgttcttcagtcgtaagagtataattagtttctgttttgcttgaaagtgtattatttcccgttataaaaagagtggtgttgctttcttcagtcgtaagagttttattagtttctggtgcattttctgtttcttctactaaaggtgtgaaattgctttcttcttctgtagttgagagagtattattactttctttttcaatcaaaagagttttatttatttctactaaaggcgtgaaattgttttcttctgtttcattcgtcataagagtattatttgtttctactataagagtgtgattactttcttcttctattgaaagagtttcattttctgtttcttcaattaaaagagcgcaattgtcttcttgtttcgaaagagtattattttcttcttctatttcttcagttaaaaaagtattattgttttcttctgtttcattcgtcataagagtattgtttgtttcttctaaaagagtgtgattattatcttcttcgattgaaagagtattgttttcttcttctatttcttcagttaaaaaagtattattgttttcttctgtttcattcgtcataagagtattgtttgtttcttctaaaagagtgtgattattatcttcttcgattgaaagagtattgttttcttcttctatttcttcagttaaaagagtattattgttttcttctgtttcatctattggattgtcgattgtttcttcgactaaaattgtgtaattattttcttcttcgattgaaagagtattgttttcttcttctattatttcatttaaaagagtattattgttttcttctgtttcatttattgaattgtcgattgtttcttcgactaaaattgtgtaattattttcttctttaacattaaatgttatattttcgctttcatttggttcacttatcattgtttggttcactaattcattctccaaatgcgtatagttcatttccatggtttcatttggattttcattaattatttcttctgacatattggcaattaatgattcattttgaatattttctattgccgcattttttatttcttgaatcttagcttgatttgtttctttctcgtttgaaatttgattattatctgcatttatttgtttttcctgttcatagaatgaggaaataattacaatacctggcttattaatttcatctatgtttgtatcattttgattttgttcttccatattttccatttgattatcatcattatttattttagtttcacttatgttttcattaatactagaaacagaaggcattgtttggtttgtattattagggagatcaaaaggaaatatgatttcgaatgaaagtttttctgaaatttttttagcagattctttgattgaattcgagatatgtatgaaacgagaaacaatattttcaagctttggttcgcttactttttctatttccgccattgcatggcacaaaaacagcaagtaaaaaaccatatgtaaatcagggccaccccgacatttgaccaaaaaaaattgccattgaaaattttaaaatcaagattttaccacaacgcgacattgagaacgttacattaacggcgagcacttttgattacatttgttaatttacgttaacaaacgtattaaccgttatcaatcttcgctttatctaaaatcatgacttctaatttcaaaattttacaaaaattaaatcataaaggcgaaaaagataaatcacttgtcaaagatcttcttgctttaaaaccaataacatcaattgtaatcacagaagcacatccacttgtaccagtttacaatgatacgaatccaccaccacagccagttgatcaatttactccttatttatcacggaaacttactaacaaaagaattgaaaaaatccaaaaattaaaaggaaagcctgtccaaaattcaaagacatatatgcttacacgtgatcctcaaaccaataatcaaccaatgtcagcacaaaaaaacacatcaaatcgggaaattacaaatatgaattttttagaagaaaatccattaccacaattatcaaacaccaataaagaacttaccgaacatcttcaaatggaagcactttttgataaaattgttattggatcaccaacagtttcattaccacgattaattgaatcaacattaaatgtatattttcttgctgaaactgttctcttttatcatgacgtatcatctgttaaacttttatattgtccatctactacagcaagttgtccacatggatcaggcatagtcggatacacacaattttcccgtaaaattgtaaatattgatgtcgcacataatcatattgcatatttgccattattagagaagaatctttatcatcctgattcacgagttttatgttttccattatttgatattaatgaaaatgttgttgcagtaattcaagttataagaagtcctagttcaatgccatttacatcaaaagatgaaaaatttgttgaatatttccaatctaaatgtaaagcttattcaagatggttatttcaaccagttgtaagtaacgttttcatttccagtatcgttcaaacttccagacttcgcaaattcattgaatccacgacagaaaaattgacaagattattcggttgtaggggtgcagaaatttgggaaattgacacacaaactaacaaaattgtgaagtacgatcaaaattcaaaggaagccgttccgatagagtccagtgaaagtggcattgcagggttttcattacgaaatcaaatacctatctcatgtttaatgcaaaaagtccattcatcatatcagcaaaaaatagatgggaatggagaacattcagtgttagcaatgccaattcgtgatccagattcaccacgatgttatgcgatagtcttacgaggcaaacgtataccacaattctttacagatcatgatgagaaaatccttgtaaaaatatcgccatatgttatagcatcgttaaatagttcaatattaatcgaaaagaatcatcaactattaaaagactcattacagaagcaaaagcgacttgcagcgttacttgaagttgccgaaagtttatcaggagaacttaaaatggacgtattaatcccaaacattatgaacaaagcttgtgacttagttaacgctgatcgttgttcattatttatggtcaatgacacgcgtgataaacttgtaacaagttttcaaggcggcttaacaaactctattgaagtcccaattcatgcaggtattgttgggtacacagcaaccactggaaaaatattaaatattcaagatgcttatcaagatccacgatttaatcgagcgacagacttagcaacaggttatcgaactttaacattgttatgtgtaccaatatttgatgagaaaggagcaatttcaggtgttgttgaaatgattaataagttagatggagtatttactgaagaagatgaacgaatgatcaaaatatttaatatattcactggtatttcgattgaaaatgcacgattatatagagcgtcaattgatttgtcattacaattacgttcatttttagatatttcttattcattatcacagccacaaacgattaaaaagttaattgaagaaatcctgaaaaatactcgaaaagttgtcggtgcagttcgagcgcaaatgtttatgatcgaaaacaatggaattaattttactccttttgttactgatgaagatatcgaagcgaaaatcaaacgagaacaaaagaaactacaacaagaatcagaagataacttaggagttaaaaaagcaattatccaaaagttacttcaagggaaagtaccaaaattagatgatgaaatagtccaagaagaaaatgaacgaaaagtattaatcgaaaatgtaatttctactaaagaaagtatcttacaaaacgatgacttagtacccgaaaaatcattaatgatggttccaatagtttcatctgatcgagcagtaatgggatgtgttatgatgcaatggaaaaagtcattacaaaagttcacatttgatgacttaaaattattcgaaagttattccgttttcttatctatatcattagaaagaagtagactcaaaaacattgctaaacttggatcaatggaagttgaaatgcaaacatggatcactactaatgaacgaaatgaatcaggaattcctgaaaagcttatattatctgatgaacaaaagtcgaatttatattcgattaactttgatatttgtaattttaatgggattggcttagtcaagattatgtttaatttatttgatcattttcatttatttgatatatatcatatcactaatgaagtattttatcatttcatttataatattcgtgaatcgtataatcaagttccatatcataattggatgcatgcagttgatgtaactcaatttatttcatatgaattatattcaactgatttagaaaacgtgtttacgtcattagaaatattaggaatgataatagctgctgtatgtcatgatgctaatcatgatggcttttctaattcttataatgttaaagctcaaacgccattaggtatcttatttaagaacaatagtgttatggaaacacatcattgtacagtatcaatatcaattttaacaaaagacgaatgtaatctctttaaatctttgtctgataccgatttaacttatatatggaatttgtttatttcgttaatattggctactgatatggcaaaacatttcgtcatactagaaaacgctaaaaaaattcaggcaaataaatggacggaatctgatgaaggtcgtttaatgtttatgcaattacttttaaaatgtgctgacgtatcaaacgttgcacgaaaattcgatgtcgctaatagattatgtgatattttatgcgaggaattctttagacaaggagaattagaaaaggcaaatggaatggaatatacttcgccaatgaatgatagagaacatttggataaggctaaaagtcaaatagggttttatactggtgtttgtatcccattactcgaattaactaattcgttttgcccaaagttgaaacctttggtggatatggcaaaatcgaatttgaacgtttggataaaacaaactaaacaaaaagatgaaaacgaaaaaattaaaaaggtcgaagtcaaagaagaagaatcagaagaaaagaaaaaagaattggaaatcgcaagaagaaagttccaaagcgaaaatcaggaattggtaccaactaaaaatgaacataagaaaactaaaattaaatatggtgaagaaacgggaattgtgtacgagaataaataaaatttgttgttatttaataaaattaaaataaattgttcaattattgaaatttttcgtcatacaatagctaaatgaaaaaaattcaattggcatacatatgggctgcttaagtataaagtggttcataaattcttcattagtatttcgagcgaaaagaagtcaaaagggagtttactttttcttgtcaacattaatattattgtttacatttattacatctactttaattttagcataacgcacacgctattattctcattgaagctttgctcataaaaaagtgcacaaatatgttttattaaaaagtgctcaaaaatgaatgttctttccttaattttatttggtcctgaaacaaaaaataggaattttttctttcacgcagttcgtattttttcaatttcttgttttattatcttggcaacaaatgttcattcatcaattttaacaacttttttcacgattgtttctcttatagaatacacaagaaccctcaaaaaatttcagctttttgcatttttgggtgtttttacattttcttgctggctttctgcatacatatcaatttccccaataagttcacgaagtaatattttttcagatgttttaagagtggtggtatatttttccgtaattgttttagataaaatcgctgttaggcgatatggactatcatcaaaaataccatatttattatttccttttttacttgcaggatgtagcgagctactctctattttcgattcccttggaataatgacacatatttcaacattttcttccacatctccacaaatcacatatattccacttcattttttagggccagcagggcttgcctttatcattggatttattgtttctcttgtttcaatctatcacaacagtcatcttgttcctaaaaatcttcattggacaatattcaaaattattattccaatatttcttatatatcacattggcagatactttacacatgtacatatccctccttcttacatagatataacatcagtttatgattctaattatttcatgaatcaatcatcatttccaaaaagtgatataattgtttttgcaaaaccactttatgaaaacaaaacaatcgaactccagaacattgcatccaaaacgcaagcaatcgtaacttttgcaaacttttttgatacatttaaaaccgtttcggttattttccctaatcaaagtgtcataactcgatatctcagcaaatctgcagataaattcactttctggagactttgtctcaaggacatgcttgttattgacacaaaatttggtagaataggttttattgcaggaagagaaatgtataaaccagaattttttgcatcatcagatacagatttattaataacatttggtaatacagaatatgatgacagatgtaaccttgcgcaaaaaacagcaaacttggttagtcaagtaactggttcagcaagatttcatgcgagcggttattcgttaacgttcgctctggattctatcggcgaatacgttatgagagatgaattcatttcagataacatttcatcaaaagtgtaccaagtaagaatagacaagaaaatatttaaatacactgggattatttatatgacaagtgcttacttggctgttattgctttctttgtagcgattatttgtattttagatccaaaaaagttcatagttaaaactatcatgagattactaccaaaattagaagagaaaccaaaataaacttttcaaggatgatagtgttctcatacaaggatatattttagtaatgaacaaaatattttagaaaattgattattaactgagacatttaatagatctatatacaaacgcatattgtttctcttctttccaaagttgcaacaaatgtttgaatcacgtaaaattatcccaacgcacactcaatgttgtgcaccatcaaaaaaatgtattaaacggtttttcgtatagccacttttgtataaaatattgattttgtatttatcggcgttatatttttattagttcttgtataaatattaaaaacccgagtaatttattcaggatgtatatgtgcttaccaaaacttcattttctttttcggacgttcaatgttcacaatcttgtaaaattcttcaagagcatctgtatcgggatgagaaaagaaatatgagcgctttccaggaagcttaacatcgacttgaagcaaaagatcgcgtccatgcttattggtgatttgctttacattggttacatttgatattttgaatcttccaagcttttcaccaagtgttggatcagcgaaataagttatttcgtactcatcaatgtaaaaatatcgccatctccaaatgtttgtcattgtaactttggataatttgagcaacgctataaatttttgatgactattatagaatgatacttcattaacaggagaccattctggcgatacgttaattaatacagcttcgcgaaaacctgtgatccaattccatttttcttgatctgtttgtgctgcgaaatatagaatacggccatctctcttggttattataaaacaatgagctatttctgggttgttgtaaggttcaatttctgatatatcggataacttaattttttttacccatttatttttgtctccagggggaccatatcgaaaatatccgtcttcaccgacaacaaactctctgtctttataaccttgcatagcatgtcggccttttttcttgattataccactcattttcttcattgcaaatttaccagcccgtaacagcaaccgccattttacgctgaaatttcctgtcgttattatatttacacttaacgatcaaaaacaatacattttacatatccgatacgctttattcaaaaactgctattgttggggtgtcctaaatgaaaaacgtttttaatctaaagcaaaaaaatgtttttagtgattttattcacaagcattttcacaaaggaatttgtaatttccaacagttactgcccttgcgatattaacaatggtgtttgtgatgcgaattgctcatgtgatgaagattgttccacacaaaatgatgattcatatccactttattcagacaagttaaatcgatgtccaagtagcagatttagtacaaaaggttcacttgacaaatgggccttttctgaaatcttttgtttaaattcagatcatcgtagtacacaatctaccactcattattctacatcagctaatgtaaaatatgaaccggaaagtatttatgatacatcctctacaactactccaacatcatctacttataattatggagacagtttattaacatctgatgataccatattttatcttccaacttcaacattaatcaactcacaatgttcccgtatccttccaatacaattcctcaaaccaattcaagtctccacatgtactgttacagatctcgctgcatcgcaacttgatgtaacaaatttcattcaaacgcaatttaaacggtctccgcgatcaaccgaaaatatacctctcaattataatatcgttggatatgattcaccaagtggtctttatgccaaaagtcttagctatatctttttctataatagtataacattagatcttgttagtgttaatctaactattgttccacatgatacgactacgacatcaagtgtttatactacagatgttaatgttcattttgagtccgaatcacaaaatccaaatgcacttccacgatcaggtgaaattggatatgcttatggtcaaccaattattgttgcgcaagtcgaaaatggcacattgttgttgccaaaaagtacaaaaggatcatttccaattccatttggtgtaacatgtgaagaaggatctgtacattatacacctttacttttcggtgtcgaaactattggcggatgtacatatggaactaatacaagtccaccaacaatagatttcactcgtttttcatatttttcgaaacttggaactgcgaacccaatgtatgagaacgattgggttcaaatgagagataattgtgctggaattagttctccgattgagttaatgaaatattatttcttttatgagtatgttggaaatgtgaataatccacaaaatagaatagtttcagtaattagagaatgtacgccttcatcaagcccaaagaatttcgtgttcgttgcgtcgttccatagaatcgctgatacagaaacaaaaaggtatttgcctccactaccaaagattagaggtatcccaagagatactttttatcctttttaagttttgtaaatagaatttttagaaatatttttaatgttttattgatattattttggtttaaatttaatatatattattataaagtccaattttatttgaaattttttattatatatttatttcagagtttatggtttgccttaataaaagattcatttgtattacaataatatatttatttattatctgtagagaataaatcgagaaatgatttacattatgctaattaatattatagagagtttcctaaactagaggcagatgaaataaagcaagaagctgtgaaaaactattttttgtctacatggggttcttactttcttacgcttatttcaataataggtaaaaaatgtttatagttgaagcatatttattatttattcacttaaatgataaatctaaaaaagcatatgattggattgaatttaattttccaattattttgtttttggaattgtagtcttgcatctttgtgcattcataaaaacttatgaacaaatgatttaatgttcttaacatgttattgaatattcaagcaaacataataatcacaaagagtcaaaatttttccttgtaaaatatttaacgatttatgtagatacacctcttttattcacttatttcagttgaaattaaggaaaattattgcataaaataaaatgttagtatgttttctttagtcaaaagcttgaaatagagaaaaagttgttataaaaaaatttgaaaaatcttactttttcgatcaaaatagactcaaaaaattcaattatcttcgataaatttcagttttaaaaccgtaagttgacttgaaaaattgatcacaggatttcggttatctgattcaaattttatcgaagatatctcccaaaattattacctcattttctcaatgttatcccaaactttagacatagttgttggcgaccatacttttaatgctgacttagttgataattcttcaactgctgctttaatcgatttattgaaaaagggtccattaacaattcaaatgtctgattatggaaatatggaaaaaatggggcctattggcactaagctcccaacaaatgatgaacaattttcaactggtcctggcgacataattttatacctcggaacaacatttgtaatttattatgatcataattcttggaactttacaagaattggaaaaataaataatgtaacaaaaagcgatttattgaaggtatttgggaaaggaaacgtatcagttacattaaaattacactaaatctttaaacctttttaagtttaattttttcgtttcatcattttgttttattactttcatcttaacacagaaaatgtattttaaacatgtgttgctatacgctgttatacttttatattgcagcacacaatcacagcaattatctctatcagtgcaagagaagaaatcacaatgaaaacaatagttactattttccaagcaggagaacttgcttcaccagaaaatccagcgcacagaaacgcttgtggagtgtcaatgtaattattcagaatgaacgttgaattataaaaatcaataatattttgcgtctcagagattttgccttcgccaatgtaagaaacagtatacttaccatcaattttcattggatattcacctgcaaaacatttttggtcaatgccataatgttttgtaatgagtgatgaagatgggcaccaaactttaaaataatctccatcaactctaaatatggatgtatcaagatcaagttgattaaagtatcggaattcaatacttgtgatattttccggatttgtgttaaaatcaactttaatattagtttcttcttcgtcaacatgagtactcatgttaatgctataaccaaacatattatgtatgatatagaatgaaatagtagtcctagtagaaatagtaacaggataattaatcgaaaaattattattgtcataaatagaatgactggttagatttgaaacaatatatatatcacgtgggttttcataggaaggcgttaacggaagggaaaccaaagattgcaagtcgttgttaatgtttccaatgttactttttgaccaaaaaacacctccgcatattaccacgacaattgaaacaagaaaaaggatacccgcttgaaagaatattttaagtaaaaatacaaatgcctctgtcccctcatggccatcgctcatttttctttggcctgggtttcattcaaaaaacatattgttgataaccactttattcatagtttttacataaatattcttcttcatagttcctaatgcaggtacatttaaatacattaatattttaaagaaaattaaaatcatgattgtgacttttaaaagcgtaagtgatacaattagaataattaaacatgttaattaatccgaaagtataattttaattgtatctattcatctaaaagaagaaaatattgattttcgtttgtatattttttcttgatttcacaggatatctaccaaaatcctaaaaaagttaagatttcattggttttttcaaccatgtgccaaaattttggggtgccctacatgtttttggccattaaaaatgggaagaaagctaaaatttcatgaacaaaaacttttaaaaaagacaaatttaatccactggaaaagagaaaacaatctaagagtcggagaagttatgtcacgtttcagtcttaagagttctgacgaataccataattataatagactagtagggaaaatccagaatttcgtaaatttcatacgtcaaatgagtccagacaatgcaattaggattgaacttaccaatagatttgttgatagagtatataagcttggtttaattaatgttccaacattatccgaatgtgaaaaaatcaacgtttcctccatttgcaaaaggagacttcctgttgttcttgtttctttgaagttttgcgaaagagtatctgaagcagataaatatgtttgtcaaggtcatgttcgcatcggccctgacgttataaccaatccagcaactcttgtttctaaagagatggaagattttattcaatggactcatggatctaagatcgaggctcacgtcaaagaatacaatgaagaattcgatgattttgacatgttatcataataaaaataaaggattaatttttttaagatcttaaatgcgatgataaaatttatttggttttttattggatttcattttagggaaagaaaatcatttaatattgttcttcacgttgaagctcgtcaatatatttggaaagctcacaagtcattttctctgggatatatttcttttcatattttaataatatgtttacaatatctgtattacctttctcatatgcatacataattgctgtatcaaatattttatataatttccaaatatttttatcaaatcctaattttataaaataaatattaaaaaattttgatatatatcttgagcaaagatatcaatttcatcctgttctagtagtaattcaacgatttctttattaccaatataagaagctttcataagtggtgttgaaaataatataaataatttccaaaaattacttagaatttccaaaaaattaatataaacataaaataaaaatattaaatagctctacaatttacatcaacccctttttgctcaagtataatttttacaatttctacgtttttatagcgagaagcaaaacaaagcgctgtttcatataatcataacaaatcataaatgttattttgatatatcaaaaaatttatataaaccaaaaatgaaattaaataatataacgagcattgatatcaactttttcattttgtagtaataatttaagtacttctgtattcccttgataaattgcttttataatagcgttttcatatattttgaataatcatcaaatattattttcaaatcaaaaattataattataaatattttataaattaaaagtatatcagaacaagtaatatcaattccttcatgttcaagaagtattttaactatttctgtatgaccatttgaagatgctctgataagtgctgtataaaataatttaattaatttccaaatattattttcaaatataaaattatttaaataaatttcaaataaaacatataaatattttccgcattaatatcaattcctttttgtctaagtaggaatttaactaattctgcatgacctttatctgatgcaattataagtgctgtattaaatatattaaataatttctaaatattattttaaaatcttaatttattaaaatgaatattaaataaaataaattaatgtctcgagcattaacatcaactcctccttgttcaagaagtaatttgatctttccaatgtcaccatttctagatgattcaaaaaactcgagataaaataatataaacaattgcgaaatgttgttttttaatatcaaactttttaaataaattttgaaataatcaaataaatatcaacgctaatattacctccttgtttaagaattgatttatctacttcaatttgactattgccagttgaaagcacaaaatttccattatttttcatttgaaaatgtttggctaaacagaacgtatgacacttgtcactttttcatgaaaaagtggcaaatacctttttacactttttgcaagttatacaaatattattttgtattgtatgggcactatcccccattcaaatcgatctgacaacggtttgtcggttttagaaaaagtatcacgtgatatcaaaaacaaaagaaattcattttgtttaactttctgatgtttcacatgcaggaaattcaagttattatgtctcgtttttgatgacaatacgaagctcacctcaaccagttttgttcgttaatgcgtaagtgagagctcgaggatcattaataaaaaatgttcaacttctcaattttaaaaagtgacattgtcatacgttctgactaaacgttcaccagatattatgataatcgaaaaaacctaaaacttctactatatattcttcccctttatcgcaacgatccggaatttctatatctatttatgccacaatattttttttgttatatttttttttttagtctgtattaatgaggaaaaagtaacacaaattgaagttgatattaggttaactacagaagaaaatatagtcagaaaataattttactatttaaaattaaaatatattttaattataatttaatcaagatcaaatggtaaaaatagtagcatctaaaaaaggtaataaagaaataattaaattactcttgaacaagaaggatttgatattaataaaaaagatatttatttgttttatttgaaatttatttttgtaattcatatttttaaaaaatatttgaaaattatttaaataatttaaaacagcatttatttatgcatctcaaaatggtcatatagaaattgttaaatcaaacaaaaaattaaattcaaaaaaactgattaagaatttacttcaacattttaaaatgtatcatatgtgcacatggttaataataaataaacttaaaaattttcaatggaaatgtgccaaggttcgatctttaaatgtgctattgatataagtaaaaaatcttgcatatatcttatcgttcagttttaaccaagtttgttattgtcgtgtttgaattatgccgatcattttcattctgaaatatgacaacgatatctctcaaatatagcaacaaacccagtgaaatgccttcggacgaatttattttacaaccgaattatttctcaatttttgaatactacgtttcagtgtaacgttgctcggccattttgtcacttttattttcatcaaatggctttaagaagaatacagaaggaacttcaagaaatttctcgtgatcctccatgtaactgcagtgcaggtccagagggtcaagatcttttccactggacaggtacaatcttaggtcccccagatacaccatatgaaacaggtgttttctttgttgatataactttcccaccagattacccattcaagccgccacacatcatctttaagacacgtgtttatcatccaaatattagcccacgtggtgctatttgcttagatatattgaaagacaaatgggcgccagcacttacaatcagcaaagttcttctttcaatttgttcacttcttaatgatgcaaatccagaagatccacttgtacctgatattgcacgtcaatataaaaatgatcgcgaagcattcaaccgcacagcacgcgagtggacacaaagatatgcaacataagtaaagctttaattacgaattatttcatccattttcaaacgataaaaaatacaaagtaaagttctgaaaattaattattttctcttttgactaagtttgttcgaccacataaacaaaaatcaaaatcagtcactttttactttacaatagaaagttctattgtttcaaaagagtttttagtacttcaattcagagtttccgatgaactctctgatgcatgaagttggaggtgcaacttctggtgacaatggatagaagaagttaagcaatccgagcaatcttcttgcttcatttgtggtttcaattgcttctggtgagtctggatcttcatctttacttggttctgttgcttctgacaataaaacctttccaaagatcgaaagaactggtaactcataaaccattgaagaattgaagaaaagttgagcatttgcttgatatgggaaaatattcctttcttcaccaactctaacgcttgtccatcttctaattgttgtcctaggtgattggccacggaattgatggtcacggataattcttcttatcaatcttaaatcacttgtcgggaacctatggttgtaatcaatgttcaacggggtcaaagcagagacataaataggtgtaacattactagttccaaggcatttaagaagttcaggatttaatccatgaattccttcaagaatcaaaaatgcgtttggcttaagccttagcctttgcttaggattatcttcgccgactccacgtttgaagttgaacttccttcttgggattgatttaccttctagtaattcatgaactctttgtccaagaagttcaaggttcatggctgagatatgttcgaagtcttgaagcccatcctctccgaatgggattttacaggtgtcttggaagtaatcgtccatttcgataactgttgcttcatatccattgacgttcaattggatttctaaacgcttggcaaatgttgtcttgtttgaggatgatggacctgcaactgtaataactctctttgagttgaaattcttacataatttggatgcaattttgctgatcttcttttcgtgaagaccttcggcaactaatttgatcttcatgatttcgccagtatagattgcattgttaagtttggaaacacaatcgacatttgttaatttggcccatgcggcatactcactaaacatctcatgaaggactttaggatctttgtactctttgatagaagttggattaagcatggttggaagccgcataagaagtccttgttcatatttgcggatttcgaatattgtaagtctgtttttatcggtactcatgggttcaatgacataatcaaggaattctccacatcgaatgattgggatgttagcatcttgccatgcctttaaaactccgactttatcttgacatttgattgacttgaagtatttaataagttctgctcgtggcatagtgctaagctctaaaggagtgtcgttgttaacaagttgagtgaattcctttcgaatttcatcaatttgttgctcggtaattggttcttcagtggaatcgatataataaaaaccatctccaagagagtgttcaattctaaggtgacgaccataaagcttttggtaaagagatacgagtaaaaatgaacttacagcatgttcagagagaagttgggtacgagtgatcttctcattacgtgggtcgtggatcttatcaatggcaaagtcaaacacttccattgatggggcagttaatgatgcctgagactgaagttgttgctccatagaaaagtgaaatgttcatttttaaattgaatgttttgtgttgtttatagaacgatatacataggtttaatgcaaaacagaaatatctttatttctttatgttttattaatagctccaatgcataactagacatacattaattgtttttatataaatatacaaaatattaatcgtatttgtatgtttaactcaagaaaattggaccaaaacatcggtcccctcaattttgtatggtcagattttaagataaaaatgatcggtctatcaatttttatgaaattcaaaaagtaaaagttgatcgtttttttgcttattgaaaatttttgatgggtttttttcggttttgtaggtttgagtttcggagaggggtactccaaggaatgggcgagtcaaagataacacattctccacaagattgcatttatggtccattaacaatcccatcttactgttggaaaattattgatacttgcgaatttcaacgacttagacagattacacaacttggatcagtttcttatgtttatccaagtgcaaatcatacacgttttgaacattcattaggttgttgtcatttagcttgtaaatttatgaatcatatttctgaagtacaaccaaaattagaaattgaaccaaatcatatacaagctgttgtcattgcagcactttgccattgtctcggatgtggcccattttcgagtgcctttcgtgcatttgcccgagaaattgatactacatggtcacaaaaagaaatgtcaaccaaaatgttacgatatattattgacaaataccaacttaacttttccaaagaagtcattgatgctgcttgtgaatatatttatggcaatatctatgaaaaatatccacattggttatctcaagttgtagtcaatcataaaacagccattgatatcgttaaattcgatcgtctttcacgtgatagtagtcgatctcttaactcccatatgtttgagtatgaacgacttatattcaattgtcgagtcatcgatgatcaattgacatggaagatttcagaggtcccaaccattgagtccttattttataccatgaatgacatgcatttgcgtgtttataagcatcgagtcgttcaatcgatttcgtgcatgattcaagatatcttctcaataatctgcgacaaagcgaaaatttcggaatccttaaacgatccgaagctattttcatcattaaatgatgatatattatatcaatgcgaacttggcatgtttggccaagaagcgaaagaacttgttgaacgaattttatgtcgaaaactatatagttgtgttgatgaaattcgcataaaaccggatgatgaaaatggttttcgttattctcagaagtcccgcgaatcgattgtggatgatatcttaagatgttcgaatgagtgtgatagagataagtatagagttgtgtcaatgagatttaagtatggtttgtccaagacaaagcatcctttgttgtcgattctgttttggaaaaaggataatgagaaaattatttacttaaaagatgaggagatttcgtgtattgtcccagcgcatttcactgaaaacgcaatgagagtcttcgttacagataaagatgaagtaccaattgcaaaagtggcattccaaaaatgggctgaacaaaatcctttcttcaaataaataaatttatatttataaaaaataaagtaaaatttatgtttaactttttagtaaggtgtatattgcttatgaatataaaaattgggcttaaaattataattatttttgattttataaattcttcagtactcaagtaaactcgtttagaaacgaagtggtttaacatacgtatttcccgtattatcaaattttcatcgatacttttctttcattgatatatattttatattttgcgcatataaacattcttacattcgattaatctggagcaatatcttgtatatgcactttttgatgtgcctcattatcaaattctacaattccatcatctgctataatattttagtgtagtgcattttatgcttgtcttcagttggaaaaaataacaatgggagaaaatgcacaagcaatacgggaggattcatttctacaaattcttttattaaaggagactacaattcctttagtattaggtacctctgttaaatgaactcaatcaatatccattacaaactcacacattctcatattcatacgattttacacctttcatacaatagtacttttacatatgtaataacacaaacaattactctcgatattatttttacgaagcctatttctctttctgcattttgctcaacatatactaatatagagtagttgaatactcagcataaattgaatatttcactggattttatacaaatattaatcagaatgaaaacaaagcaaataaaaatataatcaatcaaatcattttattgtttttgtttatgctgtagtaataacaataattcttttaatatttgttgtatatttcattcgtatggatagaaaaaatattaagctacataaaaagtgttaatgcaaatgaatactttgaaataatttttatatacatatatttacaggctcttcaatagtatttgaaactaaagagtccttaatatataatcgtaaaattttattatcaaaattataattatcaagctgtttattttttgtagcatgtggtttttaaacatgacataagaatgatatattatttcttgaaaaaatatttatttgttatgtaacaatataccttccaatgagaagaagccgtttaaagaatgtatgcagcggttttgatcgtcatttattggatgtccagcaatgattctcttcttccttggatttatagttttgaaggagtaaccccggagaactgtccttcgttcaacaaccttcgtgaaggttttgctgttgccactatttttaatcaacttcaaaatacatgtcaaattgatacatcaaaattactaactgttgatcattcaaaggatgattggtacacatgcctcaagaatatcaaatctatccaagagaaaattaaagaaccatttgctgctgctaaacttaaaagcacatttgattgcacaggaattgcacgactttcttctccaacagcacttcctgatcttatacatacattaattttatattcattaaaaggccctgaaaaagctaaaggcctcgaacgaattaaaacattaccatctgaaacgcaaaaagcaatcaaatccattatccaatcaaagtccaagaagccatcatcaccaggaagtcctgaatcaagtcaaacaacaacaccaacccgatcaaatgccaaagcattattaaaatccaaatacgaaaaaatgcttcaaactcttaaaagcgaaaacgaaaaacttcttaaagagaatgctgagctgaaatcccaacaacctaaagcgtcagcacaaacaaaagaacaaattgaatttaacgaagcaaaaaagaaacgagatgatgcaattgcagcaggtgccgaactcgacaaagaacttcagtcgctacaagaagttgctgatcgcaagaagaagatgcagcttgagttggaagcaatcaacgccaaaatcaaagatttagagaaaaagtccaaagccgatacactaacggtcgacagctttaacggctccaccgatccaaccgtcatcaaacttcttgctgaaataaaagaagcagaagaattaattaagccggaatattatgaaagcttaaaaaagacagaagcaaagctcaaaaaggagcacgcaaaacttacggcatttataaaatcggttgaaccaaaagcaaatgcagatgatagcgatgatgctgcagctaagttgtccaaagaaatagaggaccttatcatggagaataacagaatgaatagtgaaacaatcggaatgctcgcacgtgttgaaagtattgaacgaatgaaaaacaaacaatcatttatcgaacatttgcgatcatcaacgctatttcttaagtaaaaagtgttgaatctttcttttttgagtttaatatatataaacacgtttaatatatttttgagtatcatcaaattggatcgaaaaaaaaaaattaaaaatcaatgaatattacagttaggtgatcatagagagaacagaaatgaataattggtcgttctttatattaaaaattatggagattttaaagaattttccaaagtcaaaaaaggtaattttgtgcactttttgttttacggttgcaatggttataaaagcagacatgaaagaaggaagaaaccccaaacaaacacggaaattcatattttatgatatggtatcaaccttatttcgaacagtaatcgactggttcaagaaaggtaatcctcctccaccaacacacaaaaaatcaatggcaattatgataggtcttctcgtatttggttttgcatttgtaaccatctgggcttcatcagtgcttgacataggtccattttcaacagttaattcaccatcatctctggcattctgttcatttataactctttgtcctggtctttatgctttgtggataacaatttgttgctggaggggcgttaaaggttatgattggggcatgatccctttttttgattaaaaaattttcagctgaagatatatcttaccttttttttgtgaatttaaaaagaaagaaaatatgaaaaacatttccgtttttattgattcattttagatgttaagcttccttctcctccaatggcggcgcattgggttttgaacatggcgaacgcctgtcattgcacggataaattgtggcattgggcgattttgcttgattttcttagcgagaatgcgcttcattctaagggtcttatgagcagtcattcgtaaaaaggacgaccaaaaccgttttcattaaaataagaagaacgttaacaataataaggaacaaaaattggtaaaattattttttattattaacgaggtatctgagccaaacaccatcaccatcaatcttttgtacatcctttaacttgaagaggaaagtttgagattttgttacaaaatcaggtttttcgaaaagcgttggtgtattattttcaccatcagctattggtgccattaaaatactaagttcatcaagcattccttcttgtaaaaatgaataattaatgatacctcctccatcaaccatcaaaatcttgatgtcaaataacttgagaagctttttggcagcaagctcacaatcaatatgctcttttccagcaatgatatatgatattttcatcttacggaggaatgcaagatattgattagtaactttttctgttaaaatttcaatgatatgtgcttcaggataatcctcatactttaaattattagatttccaacctaacttccctgatggatcaacagcacagaagtaaatttcggttttttctcctgcaacataatcaccttcttcaacttttggtgcattttcatcaagatcaggtttttcaaattttgtgaaaccttcgtcaatagtgacacgaccacaaaggaatgcattgaaattgaaagttttttgaattgtatcatatgcattcaaaacaggtgctgcatatggatgatccatataaggtcctgtaatcttaccgtctaatgcggttaacatgtggcagataatgtagggtctttccatttctaaaaatgttttgctaatttcgataagttttgaatgcactaattgtgaacgtacgataagttttcaatgagtgtgggaagtcataaacttcagaaaaatcatccaatatttttgctcatctttgtcctgattcagatctgaatttaggctatgtgtgtttgagtcaaaaatagtactgcttgattatttttaaacaacaactaacccagagaaattatattaaaatgatcatcgtcatgtgatcgcaaagacatattttctccataatgtataaaacaccttgactatttttatgaaattaaatttggttagacaatttgcttaaatttcgttttcatgaatagtacttatttttaatattttaatgttcccaactaaaaaataataaccaacattgatatctagccctgagaatgctttgccaaatgaaaagggatttatttgatttaaatattaagataaaacaaatttataaatagattcatatgtaatagcatagtgtaagcgacataagtaatagcgacataaaattagcgggaattaatgttgttttgctcattacgaagatatcttttttgacagtttacagtctgctttattctttatgaaaaaaagtgttttcaattgtaggccgttaaattcatacaaaaagtgcgtaaaatcagacttaagaattgaagaaatgaaaaaacaaacaaaagatgagccaaatcaaaataacgaaactgctgcaaaaatcttcgaagaaaacctacaatattttgcagctataaggaaaagcaaaaaggaaaaatcaacagattatcaaatttttccttctctatggaattacttttactcaattgatatggctcaaggtgttcgtaaggaaatgatgaaaattgggtctcaaagtcctaaaggttccaaagataaagaaaaatcaaaatcctcagataattcaaaaatgactccaactgactccaaaaatgataccaaggaaagctcaaatccaagtccattcaagcacaaaggtaataagaaggaaaaaacctttattaattttaacggaaattatattccgttttttgggtttaagtactcacctaaatattccaaagttagaatcctttgccttaagaattgcaatcttgctgaagttccatctggattaaccacacttcccaaacatgttatctcactagatttatcacataattatattacatctcttccaaatgaacttcactggaagaaccttcatggtatcaatctcagttttaatgctttttgtgaatggcccaattcattaaattccaatgcttttcctgggcttgttttcctatctttagcattcaatgacttaggtagatgcaacccttgtcagtcagcgtttaagaatcttaaatttttggatctttcattcacaaatttgaagatgtttccaacttggatttcgagttgtaagtcacttaattgtatatatcttcgagggaactcaaagatggagtcaacatggcaagctaaattggatcaattgcctgagctcaacataattgatttgacagatgtaaatttccctgagaatgcttcttttcctgcatcactagatgttgttgtaaataagaacgggaaacctaacgcttgggaaaacaaaaaatttgttgttttcaattgatcaattttgggcgatattaaataaaatatatagtttcgacaaaagaagtttgttgtgagtcttttttattcattgttttcaaagtgatcacaaccaatagtagctatgatttacttgaattataaaatcatagggatgaaatgaaatcattattagagggacataacttccaatagatgatatagaatcaccaaaattcacggaaataactgttgaccatgatgaaaatgcattatttggaattaattaaattccttcacaaatatttataaatttcgttttattttgatattgttcaatatcatcaaaatcatttttatttgttattattaatgtaaaattatcattataaaatatttgaaaagaatttatgaaaaattaaaacatttttctgttttttcttttcgtttgttttcaatttattaattaaatatttaatttgatttcataaaatataaaaaatcccaaaataaaaaagtaacgcattagaatttgaacagtttcattgaattcgaacattttcttcatgaagttaatattcagttaaaatggtaaataagcttacaaattcgaaacgcaatgttttaatgaaaagtgacagatagttccctcatttaaattgtcgaagcagacaaaaaactgaaagaaagaagatgatatcttaacagatttttaaatgaaaaatgatcaaaatgtggcataaaggaatttcaaaaatcaaatgaaacattaactttattatgttttaagagaagaatgcaaaaaagtcacttttatatgaaaacaactttttgtgattacgataataaccgctccgatagagtgttacttttttaaaaaatgtgctgccatttgcaaaaaaagcatgcttgccatatttttagaatttcagggtttccatggaaatgttcctggtttgtttagggtactctttagtgtttggcattgaaagagcttactattaagtattccatttgaatatacccatatcatatatatccatttcctaaatcattattggaggtgtatataagattttatattatatataaatgaatttacctttttggtatttataatccattttttggattttaaaacaaaacaaagaagataaaaataagtttcttactgagaaaaaaactttagtttcgatattctgtgatacttgaaaaaaaatgaaaatgtttttataaaaactgactaaaaaaaatgtcatttgaaaatttaatcaaaagcttaacgaaaataatataaattatattattaactagcaatttaataaacttggaaaaaaattcaaatattaattattcaacgaaataaaaaagagttaaattttaaatattttattctataacttgttatatactttgaattttttattataatttatatatatgattatcatgaatttgtagtttatatttttacatgtttagatattaagatttctttttaatattcaataaaaatcgattttaataaaaattaattcgaaccatatttgacatgagaaggttattttatacacatctgtatcattttatagccattttttgttcctctaggaatagaatttctacctgtgcaagttgtgtatcacatatttcatatccaattcgatttttattctttgcggatttaataattgaacatatgaaattcatattcagatctaaatatacaataaaaattagaacaaaatttattaaaaaacaattttacattataaaaaatgcagcaaatatcaacttaactcaggtctttgaggattttcatttccttctgtataagctgatgtattattttattcaaactttctctattttcatttttcccatccaaaacaattgtttccttgttttggagctcatcaaaacatttattataattcaaaagtttcttttgaacattttcaagttcaacaattagttcattttcattgtttatatttgtaatactttcatttattctttttatgtcttgttttaacattttgttctcgtttaatattaatgtcatttcattatttcttttttgttctctttcgaaatattttaatgtcgaaatgaattcgtccaaatctgaaacattttctggttgaaataatgaaacttcattaattatttgagatatcgaatcacaacattttttgatgtcgatttcttcgaatttatttccttcaaattctttattaatcgcttttaaggattttgatgtttcataaatttttttctcagtttcattcattttagtgatttctaagatgctttcctcgatctctataagttgcatttccaaaggaaactcatttttggataaatcaatttctttattataaaaatcaattttttctttgagagatataatgctatcaaaaagtggaagatcggattcaatagatttcaatagagcgttgatatcgtatttgatgtggtttttatcgtcttttttctcgatggaatttaactcatgttgaaacttctcgagtgatggtgaacatggcttcttaagtaacatattctcttgaaatatagcactgttagttttgggtatgtttaattgaattgctgatgagataattgaaccctttcgtttggagttttgagtatgcgctggtggtgttcgggattgtgtagaaagaactttggttgaggattttaggtttttacgttttggtctttcggaatttggaattgtggataaagaagaaataggtggtggagtttgaggacgtggtgaaactaaacgcttattagattcttctgatttaattatatctgaaatttgatcaaattcagaaggaattgtaatttcagaaatctcagattgtggtgattctaatactttgataagttgagatactatacttttaacattgttctgtgcctgagttttttcagctcgagttaaactagtggtctgaaaaaataatgagtatgtatttggaatatcatcatagaattttttcaatttatctatcagcaattgcgtattcccgctgtttcttgaagtgctcattttttggatttcatttacagtttttttaattccgatataagaattgttatgttttgatttaatattaggaagagttggcgctttatcatgagtacttgagatgattctttgtagatctgtaaataattgatttacagatttattttggtctaaatttcctaaagttttttgaacctgctttttaaattgttcccacttgccgaggagtgctgatggtgaaaatgaatttggtgatttacgaatcattgataaaatttcaccttgaattctccataaagtaatcaacaaattcccttttcgatctcctgctccattatcacctaaaaatttctctattgccgaaaacaattcgacaacttttgtcgtttttggcattcaagaaaaaaatgttgtctcgaaataaattagggggaaacgatagaaaggggtaccccatttttagtcatcaaaaattgtgagattttatattttgtcaacaattacatctgggtgtttattattaaaaacagaatattattccattgtagtgtactgatctttaacaatgttcgaaagatttgatatatcgtttgtttgaaagaaagaattgatatatatttgtcataaaaagttgaaataataaagaatctcaaattttggttttattgtttaagttgtaaaagaagtgttttcattttggaaacatctctttgatggagatctgacctattgaaatcgatgaagctaacaactttttcccatttgttgcttggctcgttttcaaggtcgctcatgaattgttgatcaacttcaagattatttttggctcttttctcttgtgcttcagataatttggaatgatagttagcaaggatttctttagccttatttttcatttcttcatcagcagcgtcatttttggcatcaagctgttgaatttctatttgtttctccttttcccattcaactaatgcagatgatttttcttcttcttggggttgctgtggctctggtgtctgagcaaaaagatcatcatcgtctgaaccagcaagcatatcatccacatttgttcctgcaagcatatcgtcaacatttgtacttggatttccagaaaaaatatcatcatttgaggccccaccatttgaaccaccaaaaaggtcgtcggttggtccattgcttggaatagatttggctcctcctccagacaaaatatcttccatttctgaaaagtgaaaaccgtcaaaaacgcccattgtaaaccgccgcaaaatgacatatcacaatagggtgccccaatcaattcgttgtctttagctcaaaagtagataattcaatagtttattaattcagaatctgtgttcgaacaaagaaacacaaaaaattggtatcggcagttcctattcccaacattggaaatatatatagtaacatgaaaataatgtcctttaaacaacccaaaagttggctttattggtgccgcattttgatttgatcttctaataattttttctgatctgttagttggcgacatattttttcaagcttattaacttctttttgtttttcatcagtttctactagaagttttctattacttaatttaattgcttcaagagtgttagcattggaaatttcttcatttgttaattcaggattactttcctgtaaatatgaccgaagagcaactatcctttgatttgtttctctcatcttagctttaaccaaatttaattggtatctgttttgagatattcttcttgaaatattagctttatgttcttcacttctttcaacaacaaaattcaaacgttctgcaaccatttggtaattagctttttcttcattaagtggtccttgatatgtaaaaatttcatttttcagaatagagattacatttgaaaatttttcttttgtttctttcattttttgactttccacatttgtcagctcttcaagtttaagcatttgctctctttgtgatttttttagattatcaaataaattctgtattgcgactttctttttacgaatattttctagttgttcactttggtctttaagtcgctcagcaagcttatttcgtttgtctgtaagttcttctagaatttttgcaaaatctgatgcagacgattgggacatatgttaaactttttgcatgaaaaaattgaggatatcactttttgaataaaaatctttttgccatttatgcgaccgttaacatttagactgaatcgaacgttaactctaaaatcgaccaatttcaatgttcaacaacaactttcttccacatttttcaaatgaatttttccattccgttggaaatggtttcatcgtaggacaaggcttgacagctgcatcatcagcttatcattctctcatgaataatccaccaggcaaaaaattacaaggatttatttctgaccttggatacaactcttttaacaatggaattgaaatggctaagtggtcaatagtaagttcgacaattgaaccatacattgcaccacatattcaaactccatggctcagaagtgtggttagcggtgcagcaacaggtgctcttatggaggttcgaaatggtttaaatggtattgctactggtgcattcagtggtgctatgcaatccgtaacaatgtctatattcaataatgttgttggttttgttctttcaccaatcaataacatgcgaatgagtagagctcgaaataagttcaatgaaaagcgaaacaaagctattttttcggaaccaattgatgttatatcgaaggcattttttgaatagaaaactttttgaatgtttacaatcagaattgtctatcgttcagttcaaacacaaataaacaaaacaaatctatttctttataatttcgcttctgttcccaaacaaattctcctcatttccgggataataccatcaaagtacggatggttaagcgcctcttttgctgatattcttttcattgggtcaaatcttagcattctcaaaactaagtcgattaacaaaggatcagcaccactcatcattgctgctaagttgcttccttcgtaatgaggcaattctacgttatatgtcctcatgaatttttctctaaatccaggagattcttcttcagttggagttcctaggaccttcaatattcttaccatttggtccaactggctatcgccagcaaaaagcggcgaataggttatcatttcatacaatatacaaccaatactccaaatatcaattgacaattcataaaaacttccaagtattagttctggtgctttgtaccatggcgttacaacccctttagtgtatagccgcattgggaccgcaaagtatcgcgccattccgaaatcacaaatttttaaaattccattttttgaaactaaaatattttcgggttttatatcgcgatgaatgattctgtgtgagtgaagatagtacacacctgcgagcatctggaatgcatatgatttgatgaggcttggtcgaaattgatgtgtttttaaattcattaaacgtgctaaatctatatcaacatattcaaatgcaagatatatcggcactgttgatgtgcaaacatcacgtaaagatatgacatttatgtgtgagagtgatttgagtattgatatctctcttagaagattagacggaatgccatctttttcaatgttttccaatttcaaaatttttagtgctactatttcattcgtgactttatctattgctttatatacaacaccataggatccttcgcctaatttttgatgtttttcatatcttgttattttcatttctgaaattaaacgtaggcatttttgaggttttttcaatgccactgacggttattttcatggccgatatacgtttattttttccaataaaaaataagaattcccgggaaataataacattttaggaaagggaacttcaatcgaagaatggcgttaataaaatgattattaaaacttattcatttagtatggtattaatatcttaatactaaattcattctaccgtgcgataagaacgataaaatcaaattgtgcacagaaacgatcataaaattatgaaaaagttttcttaagaaaaaatgacttcccaaaattttttttattatgtatcacaaagattgatcatgtggttctggcatgttcacacaagtaatgttataaaatttatagtaccgaattggaaaacagtatttttcaaattttttggaaaaaaaacatacttaaatttaatgtttaaaaacaagaaaattcatctcaaagatctcgaatagaacagaattgacctaaacttacttctcatttcagggtgagtctttaacaatgggtttatcacttcgttcacaagtgttttatatgcatttacgaactcattatcttcaattaaatgttttctttcaggttcgctttgcgaagcttgaatgaaagagcacatgcattcaatggtattatcgaagagaattgactggttttctcttgacgagcgtacagctgtttgtgtaaggagcttaaaaatcgatttttctgaaaattcgacaaaaaatagttcagtgtttaaactcaacaaattttggagacattgattaagaataaaggaaggggcagaaaaaatggtgagttgtggtggcgtggtgttgatcgaaagatgtgaacaggtttgaatatacgaaaggatttcagatgaaaattgcatgaattcatcaatgtttataataccaactgtttctttggctgtgaaacatagacaaagtaaagttgggatttcaaccaataaagttgatgtaataaaaggatcaaattttgttttttgattcactaactcccctttatctgaaattaccaaatcaccagacataaagccttttgaaacctgacgacagtattgtaaaagaaattgaattttggataagcgaagacattctctcacaacataatcaggccgatcatacacagaacctgacctatctattttgctttccatttctttatatgcttcgttttttagttggaaaatcgctgttgcaacgttttttaaatattttgaagttatatctaaaggctgtattaaaagcacaatattggtaagcttttgcatccatggatgaatgttaggaacatcagatggaaaaattaatgggcgaattgattcccaataattttgcatttttttggaacgatactgcggttaggggtaccccgtatgttccaaaaatcgaaatggaaaaagaactcaaggacagaataaagattgaaatcaaatattatggcattggaaaggtagtttactttatttacaataattttttccttttaagggttttattgtttatcttgggttgcctttttttatcaattggagtcaagcttcctttctttattttcttctttatagaaatagctgtagcatggtgtagattcaaagctccactcattgaccaagagagaagagaacaattcaagaaatgggttaatgaatcaattgttgcaagcggaggtgaaagttgtcattttgctaatcttctctttgagaacgtatatagcaaaatgataactgatacatacagtgattttttatgtccaattgcaagttctacattacaaggtttattaccattttttgttaagaatctcaatttcactgccatttcctttggttctaatccacctaagcttttacaagctgtcacagaagaaccaccatttcctaattctttatcacttcaaattgcaactgttcttgcgaatgatatttctctttcatgtgacttcactatatttcgagttccatttactgttgttattaaagacatagttctttacgcacctgtgcgcgtaattatcgagtcacccgaacataacgtcttttcgaacacatcggttatcacatcaatggcttttacagcggtaaaaccgcctatcgttctatcggcaaatatttatcttaacggtttctgtatcaaccgaatcccaatggtaatgtatcttatttcgattatagccgaacattttatttcattgattttagcgaatggagaatgtattgtttgggattggataacaaataagttgtcaatgagacatattaagagacctgaatcagctctttcatatcaactcttccatacaatagctgataaaagtaaggctgataaggactatggaaggttctcattttcaaatgacgctattgaaagattcgatgaaacaagaaagatgtattgggaaagagcgcaaaagactcctctcaaaccaaacgaaattttgttgccaatgtctcctgcacatggaaacgaaactgaacccgttttccctttctacccagaacgaaaagaatcacgtgaagtcggaatacagaagttcgaatctgaaggtttatctcaataaataatgtgatagaattctaaatataatatttaatggcatgaaactgttaaaaatattttttattagaggtattggttttaaatgaattacgaattttgtttcagcaaaaaagtttggctgcttcatatgaaaacattgttactaaaagtataatgtgaatacaaatttcaaaactagacttagggatttttataagtattttcaaatattaattaaaatgtttttatgattgatgtttataatgaatgaaaggggattattatttcattttttattagaattggttcaatatgttgaaatatttatataaattatttcgttttaatatcatgtgcaaattatttttgagtaaaatcaaacttatttcaaagtataaaagcataaatattttactaaacaatataatttaaagttttttccttagctcacttactatatttgaccaagtttgattgaaagtctttaattccagctgtacgcattgatctctcaaactatcatgacatataacttccgaacacaactttgggtaattaaaacaagtgatcaattgcgaagaagagtttgatggcgccctcttattcattatcgcataataattcacgccagcagcatttgcagctactttataccaatctctgcaaatataaccaaacggcaaaacctcaatcatatatgtcggaaattcatctgtactttcatgcatccacattacatgtgcgagaccacttccatgcagcccgacaagtacagaagcctttgaaaccaaactaatttgttcttgtacctttaagctctcaaattttatgcatcgcacatcacaaaaatcacatgtatttctcatcaattccacaacttcatcttgattgacaatacgccgatgactagtttgtctgtctatcattatcactaatagtttgctttcattagttttccgggcatttaaagggaatttcaaactctctaaaacagcatcacgaaagccgatagcattttggcggttaacttcatatttgaatgaaatcatttgattggaatcgcggtttgggtcggggttcttttcgagtttttcaatgccaacggttccttgtcgtaacaaaagtgtgtctctaacgatcgacagcacttggatgcctttgtgtgagaaaatattagcaacacaatgaaatagccagacgccatcattacggacaaagacttgactgttattcatggttgcattcggctttaataattgaatatgattccataatgggatactaaaatcaaatagaaaatgccagagcatataatagttatgaaatgtcccatagatgtaactaaaatcagtgacttctttgaagttagtaggaaactgtgaaattttgaaattaagaacaatgggttccgaattaaaacgatcaatggttttgtcaaatggaggagctcttgctcctggtactaaaaatggctcgggataccgaaattgggcaggcgagaaaaaataaaaatgattattaaaaaatattaaattttgatattcgcaccaacgctttgaaaatgaattcttatggtgacattttaattgtgaatattcggtggaattagcaaatcttgtagttgataattgaactttataagcagaatttataaatggcttaaaatcttcatatgactcagatacgttaataccggatgatgaacaaagaagttcgccttcataataatcaagaacaggcaaaaaaaatcgaagttgatacgtggtattatctattgataaaacttcccctttaccaattggaaagaaaatttgctgattaagccatgttgttcttagagcgaaatgtaagctaaaaatatttttgttttgagttggtaattctggatatgttatagaaatgatatcatcagtgattagtatggaattgatatctgtgcaaattgatggaactgaaggaatacgatttcgtgcaattattattttttgttctttccgttttattttttgagggtatggaattaatttagaaagaataacttcagatgtaaagaagaatacaataaaagttagtatgaatcttattttctggccaaaaaaaatgctttttttccgaaggtacatatggtcgaacgttaatttaataaagaataattgaataatcattcaaaaactgtgataaggtattcttccaaaaagaataaaaatatccgcaaatataagactttaaacaagcaaatattaattattgaaaaatgcacatgaatgttaaaaacaaatgtgttgtacatattactcaatgcttatgtattaaataagaccatcactttctttacgtcgttaatagataaaattctgcacaacgaacttccattattttttcattgtgtaaaactaaagaaatataatatattattaacaacataaaaaaaagatctcttaatttcaaaattacttcatggactatacttgtaaaatcatgaataaacagcccaactaaatgcaagaaactttttatcattaaacttcaaaattgtttaaaatcatacatgcattatcagaattcaaaaatctttatctatgggataaaatccaaacttgccataactcttcagtgaaaaatcttttttgcataaagtcctttacaaaaaaaattgatcaattaatttattcaatttttttaataaccaaaagaaattgtgtaaaaacaagttcatgtataaattaaacatttttctaatcatcatatatcacatttttgcaaaaataaaaaaaaaaaaaacaatattgttgaatcaaatctgaaaatcagattttgattaatagacctgaaaaacaaataaaatttcatgtacgtaaagagttgcattatcaaaattagatatctgttttcgattttttagtttcatgaattgtcactttttgtattcaatccaatgctttcgttgttttttcatcattttctttctatagaattgaatttaacacgagaaatttgggataagttgattttatctaatgacactgtctttgcaaatttttattcaccaacatcatttttttcaaaatatgttcaatcacatttttccaaagctgcaaaaagatttaaaaacattcattttttgaacatcaactgtgatgttttttcgtgggtttgcgacaaattttcaataatcgggcttcctacatttttatattttccagaatttcaaaatcaaacatatattcaatatacacttccaagaacagcagactcaattacagattttattgaaactcaatcgtattatcgaaatttttcacattcccatatccatagaattaatccaatttcatattattcgttcattaacaccagtgaatgtaatattttaatatttggaaatacttggtatcgaagcactaaagactttcgaatattaatgcgcaaagttgcaaagatattttctggcgacaaaaatgttaactttggatttattgactgtaaggaatactttaacatatgttacaatgaaatcgaaaatctgtttcctgttgccttcttttctaatgagagagttaaatactcatcacgattcgaaaccgtcgaagaagcggttttttccataaatgatttttgtggcacatttcgaagtgtggacggcacattacttgattcagccggtattaatgaaattgatgaggaaaatattgtgagtttttctgaaatcattaataattcgacaaaaaagcaacaaatggaatgggtcaaaaagaatattcctgagaaatgctttttgtcaaacgtaatgaataagatcgtagagaatggaaaagaagctttggagggcttactgaacgtgacaaaaaagatattcgaaagtaaaagaatgtcacgaaaagctaaagatcaattaaatatgaaattgaacttgttgaacttgttcaaaaaaactttgatatgaaatagaatataataataaatgttataaaattataatgttctttattaaattaagtgaattaactaatatttgaacatgaaataacttgaattattattatatatattaagatgcactcgttcaaaaataattatataatttgattaaaagcactactcaattaatattaaactaatcaaaaattatagaaaaccttaagatttcttagatgattaatgaaaaagttaagcatacgattgtaattaaaaaatataagttggaaatgcatttaatatgaaatgcagtcttactattgcaatttcatttattgtttgtactgtttcgtttggagcttcttcagcattatcttcattagcattaagatctttcacacctgagttggttgtaatgtacaggatattatttggattttgtttttgtttaattatattaatatttcgctgcttattcgaaagagattattttaataaagtaaaatctcatttaaatttcaaaatgattaatatatatttattaattggaggacttattaaccttggtattccacatacattaattgctgttgcattacaatggtgtcaatcagcaattattcagatttcaagaccactcacgacaattgtttcacaaattttttcccattttttatttgctgatgaaaaactcaacagatttaaattttctgctttaggatgtgcattcattggtgtttcttttaatgcaattccttctttcacaaaaccaccaaacacaacaaatgataccattataagttatgttttaatttttatgggtatgtctctttttggtgctgctgcagtatttttaaaatacaaaacgccacttgttgatataaccataagttcattgatccaaaatttaagttcttttattttttgtttgatttttactctaatttgtactggtcctcataatatgcataaatgtgcagttagagcagatgttattgattggatatggcttctaatattaggaatttttgcttctggaatatctattcaatgtatgatgtttcttattaaagaacttggtgcaggtggcgcaaactttgtatgtttcggtcaaataattgttggggtaattcttggaattttttggcttaaagaatggaattcatatagctcatgggaaatttcaatctctgttattgggcttaccctaattgcacttgctgttttaattggatttattgagaaaccaaaaaatgtatttaaatctgatgaagaaaaatactgaaatattaaaaaaaaaaaaaattgatgttgtcgtcggtgtgggagtgataatgagcgcattggctgtttcaacaatttaaaataaaaattattagttcgacaatttatttagcttgttttgcctttggtttttgttgtccatctgcagcgagagatgcttcttctggttcctttgcagtgaatatttgttttggtaatgaataatcaatttcgaaaaatggaataagatcttccattcgtgttggcttcttctttaaacttttcatgctcatgtacccttcttgatcataataatcataatattccatttcgattggattatccattttattcagcattgctttgcttggtctcattctaggatctggatagtccctttcgtcgcgtctttcatacttttttcttgcctcaggatgcatttcataatgttccttcttggacctgcctcctttcatgataattatttggcaaaattactgacaaagaaaatttgaatgaaaatattcgttgcattattatttacgttcaaaaaataaattgacaaaaaagatatctaatgtaacacatttatagcttcatatctaagaaagaaaacataactactgaacgtaattatacaagagattattaaaatcatcataatttcaaaaaaaaatatgtatcacattgttattcaatttttatgtgtaaacgagtttgtggaattatgagaatattattatgtttataaaaattataaatgcattttctaaaaaaagtttttataaacttgtatcaataaattcatttgagttatttccatttttcatttttatataaaagattatacctcctgtaatggcacttatcccagcaagagctgctataattcccacaatcaatccaactcttgaaaatttgctgtgatcctttttattgttggtaatttgacttgttatattggatgatttatctgtttttggaggattttctggttcttcagttttctttccaggttcatctggttcttgaggcacatcaggctcatcagggacttctggttcatttggttgtgcatctgttatcataacgccgagacaattttgcaattcgctttcatccttaaggaagtaagatgtacaaaatggttttattcttgaattttttccattaagttctggattatctgatttaaatgtaactaattttttatatgaattacaattttgtatagaaaatatttttctctttgcacaatagacaaagcttattgaattaagcaagtcatctgtaattttatctttaccttcatatcttaatataatttcttttggagttgtcattccatttctggttaaaattaaagggaatgaaccgaatgaataattaatttcaacaattccattttttatatcaatataattagattttaatgttttggtatttttaagtgataattttttaccaataattaaatctccaaatattatttcatcagattccattacattaatattattagtaattaatttgttattaatttttgaattttccataaagcttgattcaatattattacattttataaaattaatttcagtatatttaataattccattatttgcacgataagagaatttctcattattacaatttattgtaattggatcatttaataaataattaatattatcatatttaaaagaaaaagaagcatcatttacctcatttaatgataactttatattatttgtaatatctacaaatttaagattatttcctttaattattaaaggtttagtaaattttgaattttcccaatttcctttaaaattcaaagttaattctttgtttaatgcttgagtatttaagatgaatccatcaaatttaacactattttgagaaagagtgacttcattattatttaatgaatctgttaaaatttgatattcaataattcctttatgtttttctttcttaattaaattcgtcccaatattaatatcattatcgttaaactgaatagacattggatatgtagattgtaatcctaaattattatacactgattttgtaagtgatccaaaagttttaaaatcaagaaaaacttcttttcctagaaacaaaacattatcttcataaagttttcctttgatagtattgttaataagttctacatatggaatcttcatttcaatatctttattagatattatatttttaaaattaatatctaaagaacaattttcaattctaagttttttaatatgttgaatatcagtttgatctatatcaatggttaattcattttttatcaatgatgttattgatatttcagtattgatatttggtaattcagataattttattgaatcttttaatgattcattaaataaaaagtttattttctttgttcctttatgtattatactttttggatttgtaatttcagtgagttttacaggaacataatcattattgttaacattacattttgaaccataacaatatttttcaggaatagaagcaggaagacttttcataatcatttgaatgcaatcttgattgttaatatgttcaattttgaattctgtaatttccttaaattcatcagcatcctcatttataaaattataattaaatgcattttgaggaattttatttgcgcacatgagatttaaaggaatattaatttttttctttaactcttcaaaatgaattgatttatccatatttaaatttatgtttaaattatattttaagttatgtgaatcataaggaatttcagctttataattaatattaggtaatattattttaccagtcttctcaattttgatttctaatgttatagtacctccggaaattaagtcaaagtaattagattctttgtttttattacttaaaatattaatattcatagatttggttttcacattttttgaagaagagattggtatgtctaaataagaaaccattaaagttaactgattattagaatttaaatcagaatttaattccaaatttttaacttcatttgcataaaaaattataggttctgtgatttgagaatttattgagttacttgatgattttaatatcaaactatttgttattccacattctcttgatgttgttattatattaattccagcactaccaatatttgcaattaaagcaggaacatttaatcctccaatttcaattgttgacttttctttttgtataatattgaaaattggacctaacactttatttgaaggcattccaaatgataatgacttttggaaatcatttggaaaagaaactattcctccattaagctttaaatcaaaaagaaatgattcatgaaaaccaaatttttctttttgaataaatgtatatttagaagtgatatctttgaaatatacttttgtgaatgaatattttgttttaaaagaaattttattattcccattgtatggtttgattgaaaatgaataagcagaaagaattatttcagcattttctttgatatcttttgaaatagtaattctaggtccaataaagaaagttggcgttaggtaagtagtttgaaaatgttcgatgtttattgtaatatcagaagtaatatctttatcaatgcttgttaagatgaaatttgcagaagtaatagaatcaaaataaataagcgattttgaatcactaacagtaaaagtagaatcaagtacacattttgatatttgattacctttcttaaaaataacattattcatatccattttaacgcatgaaacaatttcagacacacttataatgacaatatttcttaatttaatggtatttatagcgttaatgtttccaatgtcaaatgtaattataggttcaatattgtctttaccagaaattcctatgatttcaaattctagtggagcattaacaaaagaaatttttacggaactagcatcaccataaacatataaagtgctaccactattcaattcatctggatcaaaatctttgatttcgtaaaatttatcagcatatgtttctttgcattgctcatttgatgtaccaatgcatattgaataacttaaacatttattaattaatattaagcagaatatcattctttaataatgagtaattaaggtttttggttcagctaaaaatgaaatttcaaaaaaattcgtgaaaaaattgaaaaattgagagaaaaatatttatgtttttatgatataggtttttgactttaaatacttaatatctatgaaaattgtgtgaatttttataaaaataggatagagcactttatactttttttcgatgaattgatactaataataaataataatgaacgttcacatttattactaatttcaaacagaagtataaaatattatataaaatcaaaacacatttttacatatattaaaatacattattcagcttcatcactactttttgaggaatgtttttctatttcatcttcctcttcaacatttattttgattttttcttcgttatttgattcttcaatcgaaagtaattcttgttcaacttgtttttgatgtcgatgatgatgtctgtgatgtcttttctttttgtcttgtttatctgagagcaaaaatcctgaaaaagaataaataaacgctccgaaacataatgaaattgttccgaaaatttggagcaatgtccattgtgtatcgccatatattaagtgtgaaatgataagggttggaacaaaccttagttgtgctaatattatacccgaaatcattgatatctttttagtgatagataaattaactaattggaaaatttcaccaatgatcgatccaacgacaataaataaccaggtttgggatgtaagtatcttccccatgtttatccatgcgcctggttcgagataaagtgagaaaaatgtaattggaatacaggcaatgaaatatcgccatgctaaaaatgttaataatgaaatgcttctttcactcccttcgattatgttcatggattttttgagtgaaacagatgaaaaggtttggaaaataattgaaataaattgtaacaaaaattgtccaaatgatggcattttgtctgtagaccattggaacttagcagaaattaaaatagtacctacaattacaaatgaaactgatacaacaaaataaagtgtaattttttcttttaaaaatatggcagcaaaaagaccttgccaaacaacacctgatactttgaatataacagtgaagtctacatctgaaacaaatataccaagattattggagcacatcatgattccataagtcattgaagagaagataagatgccaaataatttcttttggtggaattagccatcttgttgatttagggaaacctaaattaacccatgcagcaagtaatccttctggaattgatagaatcatttgtaataaagttaggaacaaaggaaaaggagcaaaagaaaatagctccttattaaatactgggaaaattgaagttaatgtccattgtataacaattaaaatgacaatggttgctgtggatctacaatcagccattacataagaggacgtttattatatggaatacgttaagcaaaagacgtttaaattaaaaaatctattttattcgaaacaaagattcttcaatctgtaaactttgcatactctttagtccatttacgggcagtttcttccgcttctgctttgtttttaatccaatgatttgcaacatttgtatcaagtggatcttcagggtttggatcagaaagtagtgattgaactgataataaaactgttgatatttttaatacaggagtccacttatttttcaaaatatctaagcaaattcgtccaattttgtcaacatttggatgatatatttttgtaagaaacctaacctttggtggagtgataggatatccatctggcaagaaaacttctaatttaaataatccgtcttcatatggagaatttacaggtccaagaattcttgcttcaaaatatcgattgttgtctggatatggttttgcagtaattccacttggcggtgatgttgctaattcttttatttctcgggcaatcctcacatcactgttcatcagaaccaatgtgtcactttttgcttatggcttttgcaaaactttaaaaaaagcataaaagttggtgaaagaaatgtttcctacaaagatcatagccataagactgaacgcccagtgtattatttatttttagattctttttcatttgttattaatttttgattatcttatggacaaattccaaatatttcataacattcatcatccttaaactaattttttaggaatattcacaaattgttagttgccttaaacaaaaaagaaaaaatcacgttgaagaagttttcaaaaagtgacttcggatcaaatgacacttttaaaagtgacaaaaagaaatgtcagccgaagggactgtcaccgtgaaaatcgctcttattggtagtacaatggttggtaagacctcacttatggttaagtattgcaaaggcacatttagtgaagactacattgccacactaggtgtccaatttctagagcgtaccatcaaagttaagaacactccagttaaccttgtcatctgggatattggtggtcaaaagaactttatggacatgcttaacatttgctgtgaaggagctcatgccatgattttcatgtttgatttagccaatatcaaatccttaacagcacttcgagattggtacaaagcagcataccaatgcaaccaaacagcacgcgtctttttagtcggcaataagttcgataaatacttcgagctccccgaacaagaaagaattgccattacaaacaaagcaaagaagttcgcagcggctattggggcacccctggtttattgttctaacactcattcaattaacgttaagaaactgttccaaattgtaattggttccgttttcggactgaacttaaaagtggaaaaggtcgaggacccaagcaagccagtcataattttctaaaaaaaataatttttttcgaaattttatcaaaaaaaaaatatgttctatataaatatattcatcaaaattattcggattcttcttcactaaaatcattgtaccaaggagtattggatgttaaaaagcccatcatttgatggatcttttcgagccacctctcacctttgatcttgtattcatcaagttccgatagtttttcttcatattcgttggactcaagtaccaacaattcaaggatttcagccatgggtttgcctaaatatgtagtttcattggcttcatcaatgagtttatctataataagagctttctctataatagattgtgcatcttttggaatttgatctcttgtatatgcaattcctggtggaaaatctttgggatcaatatgtgcaaaattttgtatattaccaatgacattcgtcattgcctgaagttggtcctgaaacatagtctgtaaaagctgaacatgatctctcagcttgcgttggttttccatatatttgaacaaacatagttaaataattgaattaattttaattcgtcacatctttttttctcaaattgaaaattgtcaattagtactggtcgagcaaaaaaatggaagaaaagcttcagtacttcacagacatttgtaatttagcagattacaaattaatgaaaactcttattgatgatacaaaagatgatccaaagccagttgtcaaaaaagagaaaaagaattctgataaaaaacaaccaaaagcagtaaacaaacaagaggaaattgacccagaagcaggaccatctgctccaaaggaaaaaggaaaaattgaagttgcaaaagaaaattataaaaaattaagaaaagaagcaactcaaagaagcaaagctgaaaacaaaaacgcagaaacaaagagaaatgaaaaaggtgggaatgaaaataaaaagagtcaaaaacttgataaaccttttaataaaaaattcgaaaagccaaacaaaaaattcaacaagccaaacaaaggaaaaggaaacaagcgcaagtaaatggtttgagtttaaattattcaataaaatttcataatgatatttataaacttttttcaatgaaaaaaaatgaacaccttgcttgtaatagtaaaagaacaaattctttttcacgtgaaatttgtttgttctgcggattaccaagaagaagtatttaagcggataaatggtcggataaaatgcaacctccacctcccgtagcagttttgcgagggcataaatcctctgtcacttcattgtgtttcatccctgatcgccttatttctgcttccagcggatgtgaactttttatttgggacattcaatccagaagaattatatcaactcttcataaatcagaggaaaatgatgatgggtttcttcgtgcagtagccaatgataaaacaatctatgttaattccagacttggccgaattttttcatatgatatgaatggtcagctcatcaaagaaattagtacaggaatcacagcaggttttgccgggtgtcgacttcaaggcacagatctcttatttgcagatgcatttaatgggcgtgtttatgtatatgatacaaatcaaggtacacattttcctattcttgattataaaaaccatgggatgattatggatatttctgttttcaacgaatattttagcctcgctcttgaagattccacagttgttgtttatgattcacgaaatacagccgaaccagtttggtcacatgaaatgaagctcaaagatccaattatatcattagctactgtgaatgaaaacaaatgtgttgtaggaagtagtcaaaaagaagtttatgaagttacgccaacaggaaaaagcgttttctacgagatgccgcatgcgggcgttgatgacattgccatacgatgcgatgggagaatttgggcgactgctggatgggatggaagagttcgattgttcgatgcgaagaaaaagataccattggcagtgttaaagcaccatagaggaggaatacacaccgttgcgtttgctcaagatggtttgctcgcaagtggaggtgatgatagaggtatagcaatttggtcactctatagaaagtaaaattacttaatattgtaagaagtaaaagaacccaaaacaacaaatttgaatcgtttcacatgagattggaaaacaactataaaaactttaacatgtttaaaaattagtaagcatctacagatgaatatatattcccaaaataaagatttcaatacatatctaagcatctgaatatacccgtgttgttcaatatctcattgaagatgaacattcattgaatttgcaaatttaagcattaaaagatcaaagtattaaacggtcgttcgatggaaattagaatactttatttgtagaccgtttgtagtttaacatgcaatgatataacggtcgtttgaaagatggaagataaagaataaaaaacacattaacaaagtagaaaattatttaaaaatgatatgatcgtttaggagttcctttctaaagaggcaaatcaacatcagttccggtgattttcatcttcaaatattgataaataaaatcactataaataagtgtttgtaaaattcctgtaatccaaacaaccttaggtgttgatccagtgtctgaggcaactttatagatccaattcaaaagatagaacaatcggtaaatgccaaggaagaaaatgtattcaaggttgataacatcaagtttgaaggaccttttaagtaaaagcaattgtgggaaaatggcaaagctttctacccatagggaaaaagtatgtaggaaactttcgaatgattttctaggcattgaaattaaagaaaaaggaatacaaataacaatgataaaaattatgcgaaatgtatcatgccttttttcatatgttctagataactttgtgagcattaaaataacaattaatgcttctgaaaatatgtaaaatattttgaagaaaatgttgtaaaaaggtgggtaaaagaagtactggttgatataccttgttgcgaatacgattaaataaagaatatgtgttttaagtgaaacgccattacaagttcgtttagaaatcattttatacaaaaggatgcaaactgatattaaatgggaaaagtctgctaagtaacggaaaatgttccattctagaaccatttttgttaatagtaatctaacaaacctagtcaattgttgtcagacaaaacggttgaaatccttaagttaaaaaaaaatcaaaattataatataaaagttcatcagatttttttatatattaaagaaatctcataacaatatgaattaaaatgaaaatttattcgaaaaaagtattaaaataagaaattaatgaaaataaaaacgcatataaacatgatcaaactaaacaaccaaaagaaaaacgattattttttataaagtttttatttaaattttcaatatttttgttttaaaagtatagatattcatattcactatgaattattatatccattgatcattatctttatcaatatattctttgaaatcaccgccaacgtattcagtttgatctttattatcatcatttgatgaaaaagattttcctgattttgtaactaaattttgattattagcttttttaacaacaaaaacaacaattccaataatcaaaagaacaattataattgcaccgcatattataccaattaatacatttgttggaatagtttttgcattattgatctcgctttccacaataattgtgtaaaatctggtgtaaatattatactgtgaagtgtattgataaattgtataattataatagatgacttgtgaatgcgtaaaggtataacttgtttcaatatatgtatttattaatgtgttcgataagtatgtgttaacaataaatgtttgcgtaacagaataaaaattaattaatgaaaatgaaattgaaatacttggaaataacgaatttgtaaattcattggattgagtaaatatatttgaattagtaaatatatttgaattagtgaatgtattagattgagttaatgtattggatttagtaaatttgtttgaattggtaaatgtgttggattgagtaaatgtattacttcctgtaaatgtatttgaatatgtattacttcctgtaaatgtatttgattgagtaaatgtatttgaaaatgtatcacttctagtaaatgtaagtgttgaccataaatatatatcacattctgaaagcattttatgtgaaacattaagagttccaaatgtcgcgttttgatataaatatgatgtcataacatatttcgttaaaatatcagaaaatgcatttgaacttatgtatgttggtgatgtaataccttcgtaataaatacagttaagtttttgacatgaacaaaatgcattatccccaatcgttgttacattttcgccaataataactgtgactaaattactacatgataaaaatgcagaacttccaatcgttgtaactgaatttggaattgtaatatttgttaatgatgaacaatattgaaatgtataatcacaaattcgtactaaattttctgatatattaatagtaattaaatcggaacatgattcaaatccataagatccaatcgttgtaactgaatttggaataataatatttgttaatgatgaacatgatcgaaatgctgatttattaattgtttctaaattttcattaagatgaactgttactaaattacgacatgataaaaatgcagaacttccaataattgtaattgatgaataaagtttaattgaaattattgtttcccattgataaaaagcattagattctatctcagaaataccttcattaatgataatatgtttcacttgttctttatatgtttttctatttgaatattcactagaattattaataattaaagtttgcgtatctgaatcaaatgtttcatgagtttcaataaaaaagagaataaataaaaatgaaataattttataattaattttataacttttattcgttttattgaaataataatgaaataatttaataaaaaataatagaattaaaatattattatataaaaaattaaagataatacaaaagattaacttgaaatattcaaaaatgttcataaaattaaatgaaaaatagttttgtttcgcaaagaatctaacatccatgattttttggtgtgacatgtttgttaaaagagttgatttattaaaagatagtggaatattgatgtttatttgtatgaaagaagaaataaaatgtatgatgttcaaatattttgaaaagagaaaatttatgaaatttttaacatgggataacatgaaatcttctatatggggcaaattttttccttgaaatagacctgatttaatgtttttgtatgaatgagaaatatatttggacattctgatcgcgtatgaccgagcacgttaaagtatcgccatgcacagtagaaaatttctgtgtatcttaacaaaagtgttatcgggttttgcaggaacagaaaaggaagcacatacataaaattaacgtgctttttcggcctgcctgttttttatcgtatttaactaaccgctacaactcagaagcgtgatgcatcatatacaataaaatgaagtttccaatcattttttgctcatctatttataaaaaatggactaaattttatcattttcatgtttattaaggaaattaacatttaagtactcaaatcatcatatttaagagaatgatttcatttttgtgatattagaaattaaatataattataatttttctttcaaggatagatcatacaaaacatatattttctcatttataattaaattctcagacatttgttattctacaaaataaattacgtaattaagcacgtacacagatcaaaaacataaaataaaatctttttcgatacaaaatttatagaacaaaaattccttttcttgataatatcataagcacacaaaggattattaaacaaacaaaaattgatatatagcctgttgtattacgagattcacatgcaatccaacgcgcttgcaattcaagcggaacattataatatattctttgtggatttttttcaacagatttacggaaaatacgacttacaaaatgtgatattactatcgcaactaatgcgcttaatgctaaatatggtaataattgtgttgatgtgatttgagtagtaaaccatctcatattctttctggcaaaaaaggctaaaactgatccagcataagcacatacatgccaggtagcaacaataccccatgcaattgcatttagtgttggatttaaagttcttaaaagtctattttcgagattttgtccatcataaaaatgtcgaactgtaaaatattcaatgcattctcgacatgcaaacatatcattaataattccataaacattaccaactagaacagtaattccaatgattctgattgattccttcgatgaaaaaagtgaaagcaaagcgagtataaaagctaatccagcagctcctaaaacagcagaatattttctattgaaaagagaatgcttaatttgaaccattaaatccaatttttttttggcattttttagatgtcattttactcccatcaaatttaaatgtacataataaaccgaatcttatcaaaattcaacgcaaaattcggttttaattacatcaatctttgatgtataaattgattttgttttatggaaccaaaaataataatcgacttatatacaaagctttcttcaagcaatcaagagtggataacagagatatctgataaatttgttatgattgtacaaaatccaaataatattccatctctaattacagctttttttcaaactgaaaacgaatttgttaaaaaaggcattttattagggcttgaaaaatgtattacgatttcaatttcaagttttgatgttaatcaaataatttatctttctcatcatcttttagagatattaaaaggagaaattgggtcaacaattaccattgacattttatccttaattttatccaattaccatgaccctattttagaaattgaaaattatttgaaaaattcagacaaattaactagccattattttacattattttccaaatactcatcacataatcatcatattccattagaaatcatccttaataaaattcatatcggaattgaatctaatgaaatcaaaacacaaatttcttctttttgtttattagcactttcatatccaatacataaatccattgatattcttattacatatactgcacaaattcgaaatatattcgaaaaactttttttaccagatacagattatctacaaattttattatttcttaaagttattaaatatttcaaagttacacaaattgatgttattgaaatattttgtccaatttccgaaataatactaaatttaaaaacattaaatttaacaaatacacaaattcttatatttattgattatatcaatgaacgaataacagaaacgaacattgaatcaacagatttattatatatattcgatgtatttattgagttatgtattaaaaatatattcatttgaagtagatgaaccaatacaatcaattgatttctttgtatatatattacggaaaattccatttgaagaaagtaaaataatttgttttaataaattaaaatatttattaacaaataatgaaataatatattataaatttacatatttcactttactttcttcatttgtaattgtttatggcgattttgatgaatttgttcaattattttcacaatgtttattaatgaataattccaaagttttcatattcgcattagaatgttttaatgaaatatatcaatttatatcgaaatcgatttgtaaaaattcggaatttctttttaatatatcaataaatgcatttcaaacattacataattacatacaaattattggcgattttttatcgaatgttatcattttttcagatgaaatatctatagatatatataataacattaaaatgattatatttacatatttaagaaatggaattaattccgaagttttgatatcattacgaattatcgaagtattaatcgagaaaattcaactcgaaaattattcggatatatttcaaataataattttacatttaacgaataatgatacaaatattagatcttatagttattgtttaattacttcatttgttttaaaatttcctaaacaatttcaagaatatattccaatgatatttgagataattaaaaatgaaaatgatatcgaaataattggacaaatttgttacttctttggtattatatcaatagtttacaaaaatgaaataaaagatttcattcaacaaaacattaatttaattattgaacaatgtaataatgaagttaatgaagaatatgcaataaattcattatcattaatattccattcatataaatcaaaagaattaattccaattttatcatatttctatataaatatatttaaaaaacataacataaattcaacaattttcattttatcttcattagaattaactttaaatgtttttgaagaatataaagaaattacaatttttaatgaaattatcaatgatattaacataaatatcgaaatagttgatgaaaaccttcaaattatttatattgatataataaatttattatataaatataataataattcgacatatcaatcaaatgttataatgaaattattaaaacaaattatgaatgaatatagtcaagacaaaaatgaaatgttaaatacaattcgaagatattttaagttaaatttaattgataatgaaataacaataattttaattaacaatttttgtaattatttaaattgttcaattaaattcatcagaaaatattcattaaaattattatataatataatgaatttaatggataatgaacaaattaattttattatcaaatattcaattgattcattacaaaataatataaacacaaaacaatcattaaaaatcattaaaaaaattcttcaaataaattgtaaattgttaccaatcgatataatatttccattaatcattaaaaaacttcaacaaaatattaaaactaaaacattaaataacattatattaattttaattatcatccaaaacaatatccaaataatttcagcagaagaattctttaacattatattaccttatatatataattgtacaaatccacaaatatttgaatttgttctttcatattatgaaaataatccaaacaacaaaacatttttcgttggcttatccataaaattactttcgttacatttttctcagcaaatgttaccaattctaattaaatgttatgaaataatacaaaatgaaacaagtaaacataacgaaccaatgacatttatacaccaatatgtatccgatcaagaaacactcgaaacatttatgaagacattcaattacatttgtttaataacgaaaacaaataactacaaacaaattaaattgtaaaaatgattaataacgaaaacaaataactacaaacaaattaaattgtaaaaatgtttaataacgaaaacaaataactacaaacaaattaaattgtaaaaatgattaataacgaaaacaaataactacaaacaaattaaattgtaaaaatgattaataacgaaaacaaataactacaaacaaattaaattgtaaaaatgtttaataacgaaaacaaataactacaaacaaattaaattgtaaaaatgtttaataacgaaaacaaataactacaaacaaattaaattgtaaaaatgtttaataacgaaaacaaataactacaaacaaattaaattgtaaaaatgattaataacgaaaacgcaaaacaaataactacaaacaaatttaattataaaaatggttaatttccattcggatttgtttcgatttcagtttcataaattccaaaatttgtttcttctcttcattcttcggcatcatcaaagtcagcacgcataacataacgcatatcatcgtcattggcagcttcgtcctccacttcctgaacattccctttactttatacgacaacacatacaacacaaacaatatcaaaaacatcatcaacaaatacatttgtcttcttcgcattacatcgatacattcaagagctttctccgatgcaattgttacattccgtacgtcttcttgtaacttatcgattgcttccattaccatttcatcatttgcgttattaattatattaacaatgtaattaatttcattaccttcttcgatattttcattgttattcggtatataaaacgacttaacttcaatcgacgtcgttattaaattacttaactgctgcgcgatcgatgccacaattcgacttcgtccaacgctgttaatgatagtgttcgctttggagagaaagaaccgaagtttccggcgatgaaatttctgtatcttttggagataactttgaagatgtggagaaaacgcttggctcgacgagtccatgaagcagagtatcagctgcgcgtagtccgacaacgaaattaagatatcttcgagatcaaaattcagccgacttcggtcaggaataagtccgggagtgtcaatgagggtaacaagtgacgggcgttggcatcgtggaaggcatatctctgttttgatgtgattttgataattttgaatatctttgattttgcgtaatatgcgaaacttgtcaactgtggactggccatcgagtgtggagtcgtatgcgcctgatgtgatgaacgtgatcgaagaggtttcgatcgaaactgaaacattttggatctccttctgatagtaccagttgatgaaactcgacttcccggtggagtggtccccgatcaggaggatgaacgtatgctgcggaggttcagatattggcttcgacatatttttgttgacccatttgtttttggctatatcgttcaagccgagccttcgctcactgtatatccgtgcgatgctttggatgatggactcgttggcttgtggctcaactgttaattccattgcgaccaaataacatttgaaaccatttccgaacaaactttctcaaatttttatgatcaataaacggtcgttttgtgtatttgcaaattaaagaaattgtttaaattcgatactaaaaactggtttacgtccttaaactcatgaaaattaaaacaaaagtaaaatttgcgcttttttgaggtttggcaaattttgggcaatgactaattttaatcaaattagtgcattttttaaattaatatcgttgaaagcaaatgccttcgtgtgagtatggtcggttgaaactttatataaaattattataacaatatgttattttagaaatcattttgaaattaattcaatgcttggaaacagaaaaagagaactctttacaaacctgaattattgtgaagcccaaaattgcattgccggcgtgcgtttcgagttcacagtaccaatattgaaatttgttataatcaaaaatacttatgctcttaattttggtgaattttgggaatggcctgaaaaatctgccttggcacaatatcatcactgtcaattttataataatagatttggttctgaaggatcagctataactttttttcactggatgaacagaccacatgttggagattgtttcttttcaggttccaatggcaaatcacaaagtgatatctatgtttatgttaaggatagcattgggaggagattacaaaaataccctcttttcgaaatttcgactgtacaatctttcgaaattcgatctgatttcgaccatactttttctggaattttggattatttcctatatagtaatgttgcatattagatgtgtttattttctaaactattatcctttatcattttcattaaaaattttgagaaaaagtgaaaatatatgaaaaaatcaacttagtcgataataaatcgagtgcaactttttatataaagtggcggtggtctttatttatttatgaataaaaatatatgatttattatttaaaaaaatgtgattgttaaataaaaatattttttgcatggatttttatgaatgattgaaattttggtgaagtgaaaaaactaatgtgaagtgattttttctttatttattagatatatttatttttttttaaactattatcttgtatcatttttattgaaatttttgagaaaaagtgaaaatacataaaaaaaaaacgacttctccaacattcatgaaaatccaactttttatatgaagtggaactggtctttatttatatgtggataaaaatatattattttattttttgaaaatatttgattattttttgaaaatattttttatataaatttttatatctgatcaatattctggtgaagtgaagaaagccgataggaaaatgtttttttccaccttgttttatatcatattttctcattaatatatgagaacatttagtcaatattaaagtccatactatgaacttactacaatctttgattaaaaattgatttccttaaatttaatatttttcttaaagaaatgagaattatttatgtttaataattctttcttagatttattactcacttatttattacaaaatattttttctttaaataaatacactataaaacttcagttataattttcaagataattaaacggtaaaataacttttggcgtttacatttgtataacatatattcgaaagaagagaaatggtgtcatattgaattataatcacaaaatattttgtgagagatagattaggtccaaatgttcggtcactacttagtcgtgcggaggtgcctccattggctgacttgagaaaaatggtttgcaacatactccgagggctgtgagcgattgtgaattttggtgatctaacagacttagtcatgaaacatataaatatgcgccttcaacttgatgtcagtgcttcatataatgcttagcgagatctgttctctacataataaagaagtcaattaaaaatattattatatattaacaaaatgatcctctttgaaatcttcaacaaatggatcttcagcaatgttcgacatttgattaggaactgaaaatccttctgtcgtattattgtcattcgtttcaacacttatcgcgttttcttcatttttggttttgtttcgttgatgattaagaaatataacaacaattattataattagaataataactattattacacaaacaataatgataataataacagtattcgtttgtttctcattatcatttccttcattttgattgaaaatagtaaagaaatctgaataataacttaaatatgtcgaatattgaataatcgtataattataatataaatattctgtgacaaaatatgtaatagatgaagataacattgaaatgatatatgtgtttgataaaaatgaataatttgaaattgtttgtataaatgatatcgtatatttcaatgttaatgaatatgaaaatgttgtgaaatattcaaatgaattctctattataaatgaattagacttactaaatgaatttgacttagaaaatgtatttgattgtgaatatgtatttgatttagtaaatgtatttgtgaatgtatttgattcagtgaatgtatatgttgaaaagcactctggaactgtttcatatgtcacatcaaatttaccaaatgttttactttgatatgtgtttaataccatgatttcaactgtaacataaataaaagcatttgcatcaattgtgggctcattttcaccataaaagtaaacacatgtgagactattacaagaattaaatgcgaaaatttcgattttatttacattttttccaatgtaaacagtggttaaacaggtacatgatgagaataaaccctctgaaattgttgtgactttgcttgaaattgaaaatgatttaagtttagtgcatctgcataatgcatattctccaaaactttcaatgttatcacaatttgtaatctcttctaaattcgaataataaaatgaaatatctcgaatataagtaactgttgatgggattttatatgtatttccttctttagctgctggataataataaatagttttaacatttttatcataaagaacatcatcatcatttaaattacaaaaatacggattgttttcagacactttataaaacttaacattcggacatgatataaaaacagcattaccaaatgaacttactgatgctgggaaagtgatattctgtaattgaccgcactgctcaaatgcacgacttccaaatgattgaacattttctccaattataactgattctaaatttaaacatcgaaaaaatgcactatatccaatcgatgttacagaatcaccaattataactgaaactaaagaagtccaatgggaaaatgcattatctgatattgctgtaactccactttcaattataagatttaacgttatgttttggtaataagatctttcatcaaattcacttgaagtagtgatggtaagtgttgatgtttctgtagaaaatgtttcacttgtatgaatgaaaaaaataatgaatattaaaggaaggaatttgttttttattgttttaatatgttttattaatttatcaaataaatttattgatatgtgtttcattttgttgaaaaataatttggtgacaaaaaaagtgagtaaaattactagaaaaatattaaataaaaaagaaaatacattgaatatatattcgttattcactgtagaaaagaaataatggacattaaaaacatgagaaattttttttgtcttttgatttttaagaaataaaatattcactggagttaatacatgagatgacataataggacttagttgatgtgtaattagaaatactaatggtttgttggtattaatatgaattaaagattttgatgaaaaatgttcattttttgtaatatttattgaatagaggctgaagccagtcaccgataaatcattcatatcgaaaatattacatgaacaaaatttgagttgcagcaaaaggatctggtaaatcatgcctcaggaactaaatttgtatagtttacatgttcaacaaatttcaattctaaaactatcaaagttttggaggtaaataatgagaaacttaatgtgctttgttagtaacaaattgttacttaaaatgtgttactgttcagtaaggcgctgggttaagctcagggaaaacctgattttgaagccaaaaaaaaaaataaaaaaaaaaactacaaaggttggtaaaagttgaaataagaattttgtgtttgaatggtttacaatatataattgttaggtttatctccaaaaattgccaatattatccaattgtatcttaattcattggaatattttattattaaagtcactctgcatcatcaaaagtatgaagagaacgtttatctaatttaataactttacttgatttaattttcaattgaaaattatgtaatatttagtcggaaccactttgttttggttttattatcaaaacaaaatcaaaaaaaaagataccaacaagagttctcaaattagcattgtgatgccgccatttaagatcacatcatcaatatggattccatatcggccttttcactgagcttcttgttcacaaatgtggcacacttatcagaggtcgaatggacaaagccttgtttgtgtcaaactgactttttcttaactcggacttgaaaacttgccatgcaaaattgtgtaaatcattcaattgcaaatttcataaccaaaacataaatttcttgttataaagctataatatattaacgaaaaatataacctaaaactaaaataaatatgttttaaaaaattttacattttggtttcttatttgtcactacacgaacgacaaggttcacgtttacaaagggagttcacttttataaccgtaaatacaaaatcattttattgctgtaaatgtttcgtgctcctccattacgtgtgaatggatacagactaatgttctgtcagtcacacacaaggaactcgtacgtatacacggcaacaaagccaccatcaccgaaaaagttttcattgaaattcattttcgttacaaaagaaaatatagaaaggattgagaaagaatgtcaaatacagtcagaaatacaacatccttatattatgccaatattagaacaattccaacacgataattttagagttcttgtgatgccaaaagctattggtgaaactttgattaatacaagagatagattcaatgtctcgatacgctttatcgcgattgttatgtttagaactgctacagctcttgcagcattacatagaaataatattcttcacggagatataaaaccagctaacattgttatagagaactcagacagtgaagatccagtaccaaaaatcattgattttggacatgccgtaaaattagaagataatgaatcttgtcattgtcacttaatgacatgtgtttattcatctccagagcttcttaataaccagccacattcatatccatctgatgtgttctcatatggattaacattttattatctcgttacacaaaataaccttttgcatttaaaggaaattgcagaaatgtatcaggaggctatgaaaataaagcctgattatagtgatcctctttggtcaaagtatccagatttgaaagatctgatacaaaaaacaatcgaatttgacccaaagaaaagaattactgcggaagaaataatggaacatccgttcttcgagaaagtgctcgggtgggattggatcaacaacgagcgaaaatctatttactcgaagtcaaacgttttcttggatatcgaagagaaagaattcgatgactgcctcggagtataaatatttttaatatagagaataaaaaacgatttatttaaaattctttttttatttaagtaaactaatcaaaattgataagtttacacactatcgttaaagtaatttgcaatcaaatattttcttatcgactaaaataaactgaaattctaaacaagttaaagtattacatagttttaatatattggaaaaaaaataatttgatgatttcatggaattgcaaaagtgacagaattgattactgtaaaatcattaaatggtttatttttataagaggtttaccagaaactgaaccgcattcacaaatatgaaagaaacgataaatttgtattcaaacctatcatcataaaatggatgcacttctacaaaatatacaggctttatcaaagaaacaaaggcttataccagcagaagaaataatttcaagggttttatgtgattttgaagaagaatttaataagtcaacaaaatttaatttcgaatctgcagaaaaggcattattctcattattttatgcaaatacgggatgccttagtcaaggttgttcaattcaaattggtaaatgtttactttatctttattcaaatcaatcattaaaattgtggaatcttttttcaacagtaacaaataagcccacagtttctggtgtatatgcaattgggtctattattagaaaaattggagaacattcgagatctatgattccaggattactcaaagtcttaatttcatcaaaaatcaatgcaactccaatcatatatgctttaggttcatgcgctttgaaagcgcccatagaaactcaacaatttgccgataaaatttttagtatttgtcaatctgcttttacaactaaaacaccagaagaaacagcacaactttttgcaacagaaacaattcgctatcttattctaactaatttaattccaataagaaaagttcaacttttcatacttgaaattatcaatacaaatcttgatatttttgtacaagaagaaatccttaatatttgtgcactttgtgcatatcacccattaagtaagttacaaaattctcaaaatcaaaatagtgattggtcattaaaaaaagaaaacaaaagcctaacaccagaaaactttcagcaaacctttgaatttctcaccatatctaaaaagcattttcctcaaattcttgggcattttttggattatatgccaccagaactaatttacgataacatttcggttttattcaaatttgttcgaagcattcaaatttcagaagtcagtcaattaatggcacttttcggtaaagatgtcagaagtgaacttttccatgaaatatcattagaacagccaccatctgttgaacaacaacatttattgcgtttattatcatatgatgtaacatctgatcaagaaatagcgggattgtcattacaattagtttcgtctaaatcaccaacatcacatttatgtggtgcttcatttttttccttattaccagaaaagaatcgccaatcagcaatacattatttacaaatggctacattatatttagcagtaccaccagaagataatgaaaatcttgaagacgatttacatggaatggcattaattacttcgcatattattggctctgcgacacaacggaacaaacttattgagttagtttcacaaaacttgaagatttttttaaatcgagcaattgaatgcaaaaatatatattcatccgaatattactctatttatttaatattaacagtattaccatctgaatatgtcaatcaaactaaaattgacgagtcattaatgttattaataaattatatcaaaaataataaaatggataacacaaatcgtaaaattgatttgttaataacaattgttcgatatgttacatcatttttagcttcacatccaaacacaaaattaattgaacaatttttaatattaatatcacaaaacaaaatattacaaacacatacaacagcactttgcgcaatgatcgcatcaacagaagcttcaattgcttcaaagatatataaaaactttttgtttccgacattacttgattcattaccaacacgtaattatataatctcaaaaattaagtctccaatgttaccagctagtgaaacattacatcgtgtaattactacttttaacaaacatgatattatatattcgaaagtttcgatttcatatttctcacaacatgcgattgaattttatccgaatttaatactttcattaactgataatgaagtcgaaaatgttattaatcatttaattaattgtacaactaatttaattgttacacatttattaatattaacattacttaaaaacattgaaacgcaaagattatttccgaataatcttcatatgtttttattgccaatgttaattaatgatgaaaatgatatattacaaatgcaaattacttcggaatgtatatcagtttggtgtacattaaatcaaaatgttataaatgaagttataaattatttcatgaaatataaatgtattgggaaatgtttatgtttttcatcaatattttcttatattaatttatcgaacagttatataatatctatgattcatgacttaaatgaaatgtctaaatcaacaattactaatagttatgcacaatttgcattatctaatgcatataatcatttatcatttcgaattgatgaattacatcttttagatattcaatttacgtttttattatcattattaaacacgccaaatttattagcgccatataatttatataatatgtcattatcatttaatatgttattaccaattatatctgcagaaatatcaacatctccttcattaaatactataaagttaatcattcaatcattttgttgtatacaaattccttatagtaaacaaattatgtttcatgtattacgtggcgtatttgctttcatacgtgattattctaatttaacattaatcgaatttcctaatgaattaggaagttctatttcattacaaatttctgcttgtggagcgttttcggatatgttaaaagttaagaataatattaaagaagattatttcgaattaattccgaatttatttgttttattacaaaaaagaaatgatgaaagaattgttgatttaatacaaacaattgcacataaattttctattcaagaatttattaattcagaacaattaatttcttggattaatatcatcaaaaatgttttatcaaatggttctttgttaccgaatttacaaatcgaagcttcacttcaagtgaaaagagtttgttcgaagatatcttcaatgattattaaagttatatctaaaacgaatcctttaatgaatgaatgtttagatgatttaattacatctgaaactcgagcattagaaattcaagatgaaaatatatcaaaatcagcttataaattcttcattaaaattattacattatttaaagataagaaaatgcaaaacggagttttattacttgaattatatgaacctcaatttgcattaacagtacgaaatggatttttaattaatttcgaaatatccgatgagtttttatatgaatatttatgtttccaaatgaataatttcttaaatcgaacaaatgatttcattaatttaattgaagtttattttaatggaattaaagatattaaagttaaaacagatttttattataaaattattataaatttatgtgatatagcacaaaataatataaaaatttatgaaaaattccaaaatattttccaaacatttgaaaatgatttcgaacaattcattaatgaaacaatgatattatttaaacaaaaccctccaaaccctgtacaatatacaatatttaaatcatcgaaacaaagttattatggaaaattattaaattcttttgtttggattaaaactataaatcaaaaagttattaacattgagtttttgattaatgaaattaaagaagaaaacgaaaattggagaatatcaattgctattaattgtatcacaacaattttacaatattccacaaataaagaaataattccaatgaacgtattatatgaaattacggaaataattaaaaagaaaattataatttcaaatgaaattaatgaaattcttccgaaatttttgaaatatatttcgacgttaaacatcgaaattaattcgaatctttggaataatttaatggaattaactttaaataattcgttttcttatgaaataattggaaaattaataagaaaaaatccgccaaaagaatattcaaaagaaatatgtgaaaaagttttcgatttaaatgaatcaaatccaaaagcattatcactattaacaattctaattaatgttcaatgggaatatgaactttcatctttgtttaaatctaattttaacgacgaatttaagttaaaacttttggaacgaattctaaaactttcggaaatttcaattcaaaataatcggcaggaaattttcgatttcatttttagactatttaagaaaggaggaatgaattgtttagctcaaatattattagaaaaccctaaaattggttatgagattttgtgttttgataagttgaggataatttgtttgttatgtgagaaaaatatacaaaattcttctgttttcttgaattttttatgtttggcaattgttttatgtgatttcgaaaacgatttattaaaagttatcataaaatgtgctataaaatgtataattgtacatggaaatgattcacatttcggttcaatgattattgaatctgcaattaaactgattaagaaaataacttcgaaaaatgaaatcgttgtgaaagaaatattcttcgaaattactcaaagagaacaacaaacgttaatacatctcttggaaaatttcgtcgataaaaataaaagaaaacaaaatgtgcttcatttgaaacaattctcaagcgagaatttaaagaggaaaaatgatgacacaagtgatgacgaagaatgggaaacactcgaaattgtatagtaatatgatattttaataaaaaagtaaaattatgttttttctaatctaatgttattctgatgaatcattgttatgaacaaaatgaacttttatagaagaattccacaatcggatttttatataaccggtaatattaacatagagatataactatatgtcacatgtctttaagtgagtttttttcaattacgtaaccatttaattggacaatttttctcatatggcacgtttcacattttttatttgaaccgaatggatggcagccaacatcattcaagtcttataagacattaaggataaagatggcgaaacagcactttttcattgtagtgaagtatcatacaattttattaattaatgctgatgttaataaaagaaataaagattgagaaacaccaattttcaatagcttcgattgcgataatgctaaagcatatgttggtgcaggtgctgatgttaattcacgaaacaacaatggagaaaatgtaatatttaatcgcaaaattattaattgattatggtattgatgttaatgtaatgaataatgagggaaattatgcaataaataataaaaaaagtaaaattgctaaattattaatttatgctggaaataatgagaaatcgatatcaaaatacaaaaacgaccatgtttttgtgtaaaatttaagtaataagttcttttgttttaatgatttaaatgctttgtatacaaaaacaagtcgaaaaattcaatagtttacatacataaatgggaagctttttgagagaagtgtaatctagtcaaaaagcagagcaacggttttttctttctttgggtttgtaacctcctgtgaaggcaatttgaaaacctgcctcgaatacttctcttatgttttcgttggttaatgaagagcattcaatgtaggcaagagccccaattatgtttttgaattcttcgccttgagatgttgaaattttaattgaaacatttgattcttcttccctaagatcgctttttagcccaactaaaacatatggtttgccagggtaatgttgttctatgtttggaatatatgtggttcgaattttttggaatgattttggtgacacaagtgaaaaacaaatcataaaaacatctgtgttcgggtatacaagcctctgtaattttaggtattcatctttaccacatgtatcttctaaatttaaataaaaatgatgacctttaaagcagaaaggagcagaaaaaccaccaaaaattttggggcataatccgcaggaaaaacaccatcgcgtgtgtaagttactaaaagacttgtcttaccacctcctacgaatgtgaatttgacactattgtggtccatttgcggttttttaacgtgccccggtatggagtacgttaacacaaatggacccaatccttctttccaaatgttctaatatatacgaaagaattatgtcttctccattaggagaaggtatcacaacgcactattctacttttcaaggggtcccattttttcaactaattcgaaataaattagaaagtaattcttattcatcaccaaatgaatggatcaatgatgtcagaacttcgttcaatatggaggcaaggaatcttggaactgaaagtgaactatctcttttaattttgactttacttcaaatgataaatgaagatgctgaatcaattttaccaaaggaacatagagacacgagtggcgaacttcagaaaataattgaaagccttgcaaatttagcaaaagaattaccaaataatctcaaagaatttaaagcaatgcaaaaactgaaagaggaaacaatacctgtcatcaaaaagataaaggataaggaagaagtagaaaattatgatccaaataaaatatatcaagaaatttcagaattgaaatcagattctgatctccaaaatattgctgatattttgacaaaatacgaaactaattacacacaccacaaaagcgtcatcgagatcgacttgtcattatgtagtccaactacacttaaattgattcataattatatcgtatcgaaaaataaagaataaaagtaaataaaaatttgtttctctcaatgtttcacactgtgtaaatacgtgaaaagcgataacatgatattttttattgatgaaatccataaaatatattaagttaaatcattaatgagcgattgtaatgttcatttagttcataatattattattcatagcaaaatatcaaatcagataacgaaaatatttcattgagcttcaagtaataaaaactgaaattatttaatgcaaaacaatctttgtttgattgaaccttttagaaacatcttgtgaagtgcgaatatttatatttggaaccaaatatgaatcaagtaatatttgttattatgcatggtaattaatatatttcaagtgcattaagagtgaattcattatatacaataaattttagttgtcattaataagtttaaaattaaagtgattgatgaatcgaaactgaataaacaaagaattcgaatacaatattaataaggatcaaaaatatcaaatccattggtcatcatctttttgaacaagacttttgacctcgttgttgacatgttctgtttgttctgcttcgtaatttattgatacgtttgatatatgagttggtgcatctgttgttgaatatgttttctttttgtgctttttcttaattaaaaatattataattccgataattacaaaaacaattacaactgtacaacatacaatgctaatgagaacatttgttttcattggattttgttcatcattatcattttgatagtttaatattgtgaagaaattactataaatttgggaataagtagaataaatgatattgacgtattcataatgaacaaatttcgtattagaatatgtaaatgaagaattgatgtgggaaatagttaacgaattcgtaatatatgatttataaatagaagctgttatcgtaatcgacataatatttgttaaaatgaatgaatgcgttaaagacgaataatgcgaatttgtatttgttagagaaaaaacattcgaatttgtaaatgtatttgatttagtaaatatatttgattgagtaaatgtatttgatttagtaaatgtatttgacttagtaaatgtatttgacctagaaaatgcattcgatttagaatatgtacttgatatagaaaatgtatttgatttagtaaatgtatttgatttagtaaatgtatatgatttagtaaaaacatttgatttagtaaaaacatttgattcagtaaatgtatttgatttagtaaaaacatttgatttagtgaaaacatttgatttagtaaatgtattggatttagtaaatgtatttgtgaatgtatttgtaaatgtatttgtaaatgtatttgaattagtaaatgtaagtgttggaagaatgcattcgtcaattgttcctttcgttatctttaattctccaaatccttcacttgtatatgtttcattgaccataacatattctgttggaacatcttgaaaacaatcacttccaaatgctggtgaagtttcgccataaaaataaatacatttcagtgatgtacaatacgcaaatgcttgatttccaatattttcaacactttcgccaatgataatcgtttctaattcataacagaatgaaaaagcacttgattgaatatctataacagtgtttggaattatgaaattcgtaaatacacaacttgagaatgcagaactttttatcgtatttaaacttttcccaattgaaattgttattaaatttgtacataaattaaatgcatctgattcaattgaagtgactgaatctggaatgctgaatgtttccctgagatttccaataggataaataatgagtttcgtaatcaatttatcatataaaactccatcgttttcataattactataatatgaattatcttctgcaattttaataatttgaagactagtacaataaataaatggatttgttgatattgaagaaattgtacttgaaattgtaacatctttaagattaatacagttttgaaacatcatagatccaattgtttgaacactttcacaaaaaattacactttcaagtttatcacatccattaaatacatctccaccaactgttgtaagaggacttttaattgttacatattttaatgcagtgttttgaaatgcacttgatccaatacttgtaataccttctccaaatgaaacttcttctaaattagaacacataaaaaatgcataaaatccaattgaagtgactgagtctgcaatctctgctgtaagcaatgatgtccattcataaaaagcggaatctgggatttctgttattccacttgaaatgataatatattttgtattactttgataatcatttgtaaattcatttggatccgttatagttaatgttgatgtatctgtatcaaaagtttgtatcgaatgagaaaaaaacaaaataaacaatatgaaaacaaatttgatgtttgctttcttatcgattctatcacttaatttagatattatataagaatctattattttgatgtaacaaataaatttctcgataataatagaatttaaaatcaaatgaagtttgaaattatttgatataaattggaaaagatctttcaaatatgaaaaaaggtaatgtaaaaatttgcatttaagtttgagacataacaaaaatatttgattataagttggaatcaatttcaatataaaaacaaatgttgtattaaaaagaattgatacgctcagaatatatgtaacaactataagagcgctcaaaaatccaaaatcattttcaaatttttttgagaaaatgttaaattcgaaaatttgatttttgttgttaatataatcttctgtggttgttaattttctattagggataaatatcatatgtagagcacacaaaaaacatgtgaattttattttgaaatgcttgaagaaagccttcagcatctgttgtaaattgataaattgtcagaaaaaacgatttttcattcaaatccagatccagaacggccataaaatcatacaaaaatttgctttgagatataatcgtttttgcctgcacagaaaaagtgttttaaccaatttatttcaatggatgttacattttagtatctgtttgttcttgttgtcccttcagaaacaattttccttcttccgcctctctttcggtacacaccttctttctccttcaagctcagagtgtatctactcacgtaataaaattctataacatctttcacgcatttaagaggcaaatgtttcgcaatgatgtgaaacttctttggatgttgcatatacttcgtaacaaacttttctttctcttcttcgctccatgaaattcgattcttaaactcattatgtgcagcttctggatcttcgacaaatccatttgtattgtaaaaacaattcgttcgttttcgaaccatggtcataaattgtggttggtcaggggctgtatacttcataacttcttctaaattgttcgatttagttcgaccttttggaaattcgggtggccaattttcatggcaatcatcaacacgagtggaatattcgtcaatagctttggagccacggagccaattcttctgaatctcaacgtaaatttgtgctaatgattgctttttttcttcgataatctccttattgagcatttggacaaaaaaaagtggggtaacgagatcataatactctcgcgtcttttgtctgtaagttggaatatccataatttgcgaatacttcgaggtatcttgtgtatttattaaggtcaatttttctgattcgatttttttttctttgttttcggaaataacaccatcaataacagagtcacaaagaattaaattgtgatactcacgaataccattaattgttgttgtgggtattaatcttttggatgaattatcataaaaatcgcgttggtgttgaagcgacaataactctgcttgagcaaatttaatttcttgctcaacattagctttttgttcttgaatttctttattggatggtaatgttggaaaaggtgctgcaacaggtttcattttttgagtacctggagtgtgaacaaaagtagaaacaggtctcatgggatgaatacgtcttacaattggatgttgaagtggggtagatggtttattcggtattaaccatggtgaattattttgatcgacaggtaaattgcggtttgtattttcgtttgaatttaaaaagattggctgtggaattggctgggaaaaattcatgtgtgagtgaaaatttattctggcaatttttattatgtaacaaaaaaaggcggcacgaatattaacacagaaaaagttgatcctgaccaattgaaaatttgttgtaaaaagttttttgttcaccaacttttacaaatataagtatcttcatcatataaatcatatattaaacacaataaatcaaacaaattataataaaacttcttaatcatatttaaacagttttaatatatattatgattaagttaaagaaatatttgtatattaatcaggaatagtaaacattcgataaaccaatgaaaacaaacggttttatatacgttaaatgtaaatggaggaatttatacaatgcaaatatgagggtgaaagaaatcaaattggaacaatgaatgggaaaggagaatttactttttccaatggtacacgttatgttggcgaatttttagatggtcaatttcatggacaaggcgttctttattatcctggaagaggctgttacaaagctcaatgggatcacgggaaagttatagatggccaaatgttttttgaagatggtcttgaatattctgataaagattggaagtattgttctagcgaagatcgccgtttctaccctgaaataacaaatggtcttcacccagcaggagaaagttatattacaccaactcaacaagaagctacataatattaaattttcacacaattcaataaatttttattcatgcttccgccacaattttctttaaagattcaacgtgattaataaaatgtgtcaatgcgacattttctgtttcacttacaatttgtgtatcaccttgtggcaaccccattaagaaatgttccaaatacttagagaacgagtacatatttgttaatttacttgatagcaaagtaaaactaattaatggtgtcatttcatctgcttgaggtatcgcattaaattcaagattaaacatacacctaaggatatccatcatagaagaaatatattttaatgcttccattggtaattcgacgaattcagcatctcttaattcagcctcagcaaactcgaaaagtgacggatttgaaaaaaaccgttttaacttatcggccgatggatcaatgcaaacagactttgtcaattcatggtttacaactgccaaattattatcgaatggaacaaattgaggatgttcttcgatgaaatcttttaatggaatcatttgcatcacccaagtatgaaaatgtatgataacaccagaaattgtcattttcgctatcggctgaataaagttttgaattttttgaatggactcttggaaaaagttgatgaaaacggttttatctgacattatatgtttacgttttgctttaattgtttgagtaattgaaggatctgattgcaagaacaagtttaataaagctgaatataaaacagaataagactgatctgccttttgtttgtatgatttaatttgattatcaagttcatgacaaacacgttcgatttgagtcaaaagataatcgttttcattaattataattcgaatgttatcaatttcttcttcgaaagaatccaataacatatattgctccttatctttaagcaatgatagtttcgagaaaagatgatttaaataagtgtaagtcttaaagtcatgcttcaatcttgtttgcttctcgtaatatttcatgaattgcaagaactcatccggcgcgttattgtttgggattatatggctgagtaacctgaacaatgtatttgcggcagaagaaacgttactattatctttacgattatcattttcatttttattattaacatttatattaaatatacttaagtcatcaactttgaacctaaagaactcataattaaactcgcgattcattggaacccgaatttgatgtatcgataattcgggcgcaacaactaaactcgcaagtaaacagatatcactcattgtgaatatcatatttaatgagttcgatgataataactttagcatttcattggtatcgggctcatttaattcatttgattcgtctttattaatcggcccaaataattcatcaagtaatttatcaaatgaaattgcttttaaagcttcgatatcattctcactcatgttacggagtttcgcttgcgctggatgtagtatgagacgaaaatgttgcgcaagttgttgtaatgttcgcgctggtcctgtcggactcatgtcgagttgataactcggcggtaatatacaatatgctttcggcaatgagatcgcaggcgctaatatgcagtcgatgaataacatctcaacgcgattaagacgttgatttgagccgttcgctaagtcggcaaaactacggattaataatttgacatcttttggaaatatgttcgagtttaataacatgttggaaaccatctccttgacataactattaagtttagtgagattacttgtgttttcgcgaacaacacgaagaattgtatcgccaattgaaacctttaaaaattgctgtatgtcggaggaaaagataaagttcttaaaacagtcaaataaccaatgctcgcggatgtttgagaacgtggatgtggaagatttggaaacttccatcaaaaaatgaatgtaagctctacgaagttctgtcgtccaacaatgaccaaataatgcaggtaatgtagagctagctaaaaattctcgtggtttgacattagatggtaaaaaaggatagttttgtaaaaataatgaatcttgcgcttgtgaaagaagttgaggaagagaagaaaagttcttgtatatggactttaaaaaattatcaacatcaggtccaaaatcacaaacttcagaagcaccggatttgacacaaaatccttccgatttaacaaaaggaagttgaataatgtctttgatgttttgagtattagcacggagacaaaagccagagcgaagtgtagcaagagatcgctgctcttgagttactttcattttctcaagaagatgttcgcgtgcatttttgatttcttttttttggaaagataatactgctttgagctcacggcattgtttatgataaaaattcattgttttgttgtttttcattttttaaatgaaatgtgatttgaaaaataataaaattcaaaatttcctttttatgaatttgcttaaaagatgattttattttaccagattaattgtttttaaagtatagaaaagaaacaaaaaattaataaatatgctaacaatttattagatatgttcagatgaaattataaactatttttgtttcgaaataattagtgccttgagcgcactaacttcgaaatcgaacattttttcaacatgtcctatcattcgatcgcttgtatataatttgccagaccacatcgaacttaatgtaacaattacatcatatggaatgtatagtatgtcgcatgattgtaggtattcgacaattttttttcttaatttaaattctgtattatatgcatctaaaagttgactaataaaatccttcattttactttctgaagcagagagtaaaggagttgagttatctagagaatctatactttcttttaataaattcagaacagtttccaaagaatcaataatttgtggaagttcattaataagttctttatactttttttgaccttcgtgaaggatattatcttgcaaaccattaaagtcgcataattcaccccaatccgaaatttcaaatgactgaacatgttgaatccaaattatttgattcaatgctttttgcatcactccttttgaagcatcatctattacatgattccatcgtgactttaaacttttatattctccaagaaacttttcaaccattggatcttcaatgcgtcactttttatatccagataaaatgaccgttaatttaaaaatataaatttttcatcaaaagtatcattaaagtattactttgtcatctttttgtttaatttttaaaattatttctaattgtcaaaattttaaataaaacaaataaaaatttttatcattaatatcattttctttctgttcaaataagtaaactaagttccatacagccttaaaattttaagttaaaaaacacaaataaatattttttgcttttatatatttttaattaattccgttttctatcaaaaaacataaaaactcataattatgacataaaacacatttctttcctgatttttctataacaaaaatttttcgaatttatcatcatgtttaaagatatcattgcgataaaattaaacgctgttttatcagcacctttaaacgatgaatgattttttcgtttccattttcaacagcatttttaactgtattgtatgcattattaatgtatatacatttacattatcacgagtaaatatttaaaacatttaaccgaagaaaaaaatgctacataatcaatgaatgtaacatatgaacatatttcatcttattctgtgaagatatttcattctgattaactgcagaaaaacaatttgtttgctggaaataagttttccatattcatttcgaaattttttatcaacctttgcttcatttttatttccaatagaatacaattaaagtatccttttcttaattttattaaaaaaaattgaaatatcttactttgttttaacaaataatattgtttaacacaaaaaaattttcgaaaattatttattaaattacacaacaattatatttggaaattaacccaaacttcgtttatgtatacatacatagacataattatacgtttcttacatctcataaaatattttttatttcaaaattaatatcattatttataaatgatatatatcaactcaaattgcaaattgacttatcttttccatttttgttattagtttgctttggttcttcttttccctcaagaacatgaagaattttagttgccatagctgcaaacgcttcgtgaacattagtgccattgatcggtgatgcctcatagaagatgagtccctcgcgcttgctgagttcagcgccttcgctagttgaaattttcctatcgttttcaagatcgcattttgatccaattagcatgatgacagctttactgtctgcatagcgacgaacttcttgaataaaaaagggaaccttttggaatgtatcttcattcgtaatgtcatagagaataattgcacccattgcatcttgataataacttggtggttgttcgcgaaaatctgctgaacccataacatcatagatctggaaagttaacgtctttccttcaatctcatatgtttttgtggcttgaccatttggcaagaaatatggtccttgatctggaaaaacactatcgatcaagcggaatataaagcatgttctgccagtggtaaattcacctgagagtataactttgatatcatattttgattccattttattgaggtgatgtgaaaatttttccccaaactggccattcaaaaagttcaccgcccgataattggaatgtgaaaatttcgtgtgtaaaaacaaaaacgatcagattacattgaatcttttttcaaaaagttataattatggtgttcgataagtattcaaaaaaaccgtattcaattgattgcgggcggaaattttgggatgaatctcatccaaagatgggtataaaacataagttttaagtagaaatggaaccctcaatatgagtgtttgttggtcataattcaaatttacaagaagcttacatattggaaatttgtgaattctttatttcaagattcaaagcttgtttaatggataacaacatatttttcatacaagtcattgtttgtaagacatcggtgaaagcttgtttaataatgatgaatggatccctaaatttggctgagcattgtgcagccacttttgttgtaaacttgcgtgaagttgacttttttttgaaacgattaaaaagcacacaaattcctttttgaagatgaattgcaaaagaataatttggaaataaacatatacacaagacaaaaaatgcttaggagttcttattgaagacactattttcattttaagcaaaaaaaattttgaataaattaattcaaaaaaaaaaaagacatcaaatcgaaagatgatatatctcctctcctttttaagcaaccacagtacttcttcttttgaactttgttatgaactaaatatgaaacaacatcttcaacttcctgaacaaaattcgaaattgttccgatagaaagtagtaccactccaaaggctcgaagcttctctcattttgcgaaatgtcacagtcacctgactctgatttgaatgcgcgtgcaaaatttatataaccgcttcttgtttttggcgccgaatttcgtttgaatgatttatttggcaatgttcagtcaatttccaactgaattttcgccaaaaacgaaaccatttttttgttaccagcgccgagtgtttattttccaacaactaattatagaatttacgtccgatatccttcttaaaaaccaaattactttcgtttttattaagtacacattcgagttttaatgcttaagttaacttttggcaccatatcgtcagagctttttgtgaacattgaatcactcacaaaaataaacgtttttccaaaatgtcggttcaacaccaaagcgaagcttaccttccacccttagaccctgcatacttctcgaacacgaaactcaccggtttcgatatatcggcaatgcgcgttccggatataccacctaatgaagaattgaaatcgcatgtcaccgtttcacggataaatcgttgccgtctcacgaaaataccaaagggccttaacttctatagcaacatccaaactattgacttcattgacaaccaattaacgcaattcccagactcatttttcctctccttcaccaacttgcgctacttaaacttaacagggaacaaaatccaaaagatcgatgtcaagcttccagaaacacttgtgtcaattgatgtatcgtataatccaaatttcaatatttcatcgctcttcgcccaaaacttaccaaacctcaaatacctcaaagcaatttcatgtgaccttagtgagctcccttcgcaagtaccacaacttgcacagtcattgacaaatattatgctcgatggaaataatttcaccgaatttccacaagttctttcacagtatccattgcttgaagagattggtctttttggtaatagaataagtacatttccagaaattgattttccacaacaattcaaatcaattaatttgtcatataatctatttgaacaatttgacgtaaagtcgaagttatgtacacactctatcaacttatcgggtaattcacttaaagaatttcctatgtcattatttgacattactgatcttcggtcaatattcatatcacgtaatgaaatatcaggggaattaaagatcgaacttccaacaagtcttaagacatttgacttatcacataaccatattaccaaattatcgaagaagttcttatgttcgatgggaacgttaactatgttaaatgtatcgtacaacgatatagagaacgttaaggactgtattccagaagggcataaactagtgaaattatatataaataataaccaactgaaaacgttaccaaaatcattacttaatggcaaagtattagaagaattaaatatttctaataataaaatcaaagaattacccgaatttgaactgccccaattacgaacgttaaacatttcctttaatgaaatctcttcaattcctgactgcttccagaattgtttaatgttatccgatattaatatatcgtttaataaattgaaggaattaccacaatcaatgcaaaactgcaggaaaacgtttaagttcattggcacatgtaatgaatttgaaagtataccgaaacaaatattttcattttctaagttacaaacgttagttatgagtggcaacaaattgaattcattaccatcgggcatcacttcattattctttatgaaggcacttgacttatcgaataatcattttatcgaaataccgaaagtattaagtaaagtgcccaagttaaagacattatcactttcgcataatgcaattgaaagtattcctaatgactttgagtttccagaagcattaaattatttagatttatcatataataaaatcaagtcattaccgaacttagagttaagtcaattaaattgtttatcacttgattgtaatgaattaaatgacattaacatcgaaggaattacaaattgtaagttcttatcattaaataagaatccgatacaaaattcattaattaaattattaccacaaattatgacattagatgaattacaaaagttggaatatttgggtaataataataaagaacgaattcctccattaacatttaatataatggatgatacacatttttcatatgggaataagtttagtgttggatattcttcaacgatgggaacaaggccgaacatggaagattcaattactattaaacaattggatgataataattatatcttcgcaatgctcgatggacattctggtaattcatcttcaacgatagcttccaattgtttagtttatgagttatcgaaaatttcaaattcaaataatatcgttgaagaccttaaattggcaatcgaaaatgttaataatgttttgggattgttaaaggttaatgatggaactactttagcaagtgcttatattcataataatacgtgttatgttataggtattggagattcaagagtaattagaattaagaagaatggttatgaaagaattacaaaggataataaaccattacaaagagatgaattaagaagattacaagataaaggtttgactgtgaatagtgaaggtagaattaatcgtaagttggccgtatcaagatcactaggtgatttctggatttcagattctggaatgttcgttaagcccgaaattaaatctttcgaaattgaagatgatgacgtcgctttaatcattgcttgtgatggaatttgggatgtaatagaagatgaatatgctgctaatattgtccgtgaagcgaaatctgcaacagatgccgcaaatactttgaagaattacgctttttcattacaaagcaaagataatattacttcattgatcgttaagtttaatccatctgaaaatgagtctggatttttttatcgaaatgaggttgaaatattacctccgcatgtagatgatgagaaagaagatggagaagaaatgagcttcccatcacttcctgctgcaggaaatagaagaagaagaagataaataatctcatcaactattgatgtacaaacatcaaatttcaatacattcaatttaaatttcacccctacaataaattgaatattgtacgttaaaatgcattttttttttcttttttcatggaaaacgaaattgatttcgattgggaattttctgctcctcattgggtaaactttgagaaaggtaaagaatctccagtggatgataattggttcgagacaccagaagcatattatttggaaaatattagatattaccgaaaaagatcaactctaccaacaagactaactaaagcaatcagagaagagtacggaaatggaaaagagaatattgatcaaaataatttagagaaatctagaataattaaaaaggaaagaaaatcaattgaaaagccaaaaacacaaaaacaaaaaatttacacaccagaattccaaacgttcatgcgttttagaggatttcaaccttggtgatatcaaatatttatttgatacattttttagttcattttattgttaaacattatcatttatattgtttgtttttcaacaatttgttcatgcgttaataataaagtgtgaagacaaactgaatttaggaaatgtttatttcaatatttatatatttcctcttttatccttgagaatcttttaattttattatgtcgtcacatttatgatgttgaattttgtctgcaaataatcgaataatttctgcatttttcttttctgatgctatcataagcgctgttttatatgtttataagtaattccaaatgttatatgaaatttcatattttttcaaaatattttaaataaaacaaaaaaatatttttagcatcgatatcaatattctcttgttcaagaagcaatttaactatttcagtgtgaccattccaagatgctctaataagtgctgtcagaaataatttaaataatttccaaataatattttgaaatagaaaattattaaaataaattttaaataaaacaaataaatattttttgcattaatatcaattccttcttgttcaagaagtaatttaactattcctttatgacctctttcagatgcccatataaatgctgtattaaatattttaaataatttccaaatattattttgaaatatcataaaattattaaaataaatttcaaataaaacaaataaatacttttagcattaatatcaatattctcttgttcaagaagtaatttaactatttctgtataaccattttgagatgcatacataagtgctgttccaaataatataaataatttccaaatattattttgaaataagaaattattaaaataaattttaaataaaacaaataaatatctttagcattaatatcaattcctttttgttcaataagtaatttaactatttctgtacgatcatttttagatgctaacataagtgccgtatcatataatttaaataatttccaaatattattttgaaatattaaattattaaaataaatttcatttttagcattaatatcaattccttcttttttaagaagtaatttaactatttctgtataaccactttttgaagcatttgttagtgctaaaaatatttaaaaaaaaatttaaaaatttttatgaaacaataaaatattttaataaaaatctaatgaaataagcaaacaatcttgctaaaatcaatgtatctattgttaattaaatagttataaagttccacatttccagaaaaacccgaaattttcaaaaaatcaataggaatatgattactttcgagaaaatattgagtaatatataaattccctgttatgattgaagcaatgagaatattttcatttattttcaattcttctttaagtaaaaatgataaaagttcataattatcatgtaaaacacattttgttcctaattcttctaaattcttaatttcttttaacttattatcataaaaatatttaaagatatcatttcgatgaaattctattgctgcttcatatgcatctttaaatgttgaatgattttgttcacataaatgaattatttcttcatttccacctgcaactgcatatttacctgttttatctaattttgctccattcataagtaaatatttaaaacatttaattgaagaaaaaaatgctgcataatcaattaatgtaacattttttatgattaataaatgaatatctttcataaagtgatggtattattgtttgattaaaatcaaagtttgtttctgatgatatttcttgaagtttttctatttcatcattccgaattattttcgcaatttcattctgatttattccttctttaacatatttctgatgaagttcccaattattcgctttaagtttttcaaggtttttggagaaatattcagaaaattgatagcgatagtttaaaacgaaatttgctttaaaatgtgaaaaaaataaatttttcatatttttagtaatcgatgagttaattaaacctttttctatcaaatttccgataagataattagattcttgtgagttatttttcagaaggaattgagaaaagatgtcaattattgaaacttgatttttattttcatcttgttcaattaaattcaaaaactcaataattatatctatatttttcagtcttgttacaaacaaagtgtaaatgaaacggcagatgatcaagttgaatgaatacgttcgtgaattatcataaaattcgcgtaatgaagaaacagatgtatcaagattgtttgtatttatgttataaattatttctgtaagtgcaattaagtctggcaaggaatttatctttgatgtgctcattccactgctattaaataacactgaaaaaaattttaatggtcatgtgatatgaatttttatataaaattatcataaataaaaacatagaatgaacttcatgatgtaatccattcacatatttaattttatttggaatacttaaattttcattattcattaaaactttattatctttctgccatcccaaaggcagctcatcatttatctcatatacttgaagtttttcattaaaaaatatttcattattcaaccaaaacgcatccatcttgcccaaatctttatgtgaatggattgggaacaatttatagcggccaaatgaaaattgttcaatttcaggagatgtaataaatttttatcatttattatattcattttccattctagatcatatccattcgagtctaataaaaaacatatctgctaaaattattattagaaaaaatatgatatattaaattagatcgaataaaaaatcggtttgggtggtaaattctcatctacttgatattttaattatacattctctagtctttggtaaatattaaaaaaaaaaaaaactaaaataattcattacagaattatcaggaagaacgattattggaataagttttctttctttaatttgttttagtttgaataaattgaaacaattaacatagcgatggcattaaaaatatggttttctttttgaaaaagtgctgagcaaatttgataactttttttgctgccccaatcagagtattccctttaaaaattatatggtctttaaacatgaatgtttataattttctataataaaaaaaatgatcattcaccaatttcctatagaaagtttataatttcatttcacacatgaaaatacacaaccatttacatatttaataatttttctatttattaaaattacacatagaggcatattcccaattttatatcgaatcaaaaaacgtcttgcgaagaattacaacaacttccatcactacattttcagtcaacaaaagttttttgctttgtatatcaagagtagatgttacagccaaacacttttgtgaaggatgtatttaagagctgctgtagccttgttcgtatatgataaaaaaaatatctaattttcatattaatatatggttatcttccataaaatcttgagcaaatggatcttcttcaataatcattggtttgtcatttaatgaaaagttttctgatgttcctgctgtaggaacaataatttcactattttctttacttgatttattttgcttatgtctacgtataataataaacattatcaatataccacaaattattattattatcactgcaattggaatacttattgcaatagcaatgttcgttttgctattatctccatcattttgtgcaaaaagtgtgaaataattagaataaaaaacaaaatatttggaataaattataacagtgtatttataatatatagaatcgacataaacgtaactgagaccggaatatttcatttgagtctttgatatatatgagtaaagaattattgtttgagtaaatgaaatagaatgaatcgaaacaaaagtatgtgataaactgttgtcatattgattaaatgtatttgatttatttgttgtacttgatttagaaaaagtattcgattcagtaaataatgaatttgatttagaaaaagtattcgattcagtaaatgaatttgacttagtgaaaacattcgattcagtaaatgaatttgatttagaaaaagtattggatttagtaaatgatttggttggctctggaattggtattttgatacttgcaatttcaccaatgtttcctgcattatctacagccgcaacgtgtacatagtttccgttttgtatttgttcttttgttaatttgataaaattattttttgtttgagataataattcacttgaggtagaactattatttggagttattttatatttatacattttgattcctgaagatacttcaacttcaacctcagccgttgaagcgattaaatcatcattattccttgagtatgcttcaactttatatttatacaatgatccaacatcagttcctttgatcataactgtatattcttcttcattataagaaatattaactactggtggctcaaaatcttgtgctgaatgatcctcaataaaattatcataagtcctttgctttaaataaaatattgtatttgcaataatttgaccttctattggcattgaattacttaaacctgattgaatcactgccgtattattatttgttgttaagtaataaccatgaagaagtccgaattcgtctctttctgtattaccgaataatgcccaaacatctcctgtagatgcaccagatgcagatatagaattcaaatatatagttgatccttttgaaccaattttatatgggtagttcataagtaatccatcttgtataacttttgcattgttcgtaatatatcccacataagatggttttccgccattaacagttgaatcagctcctgatactttaattccaaaaaggtcccgaattgcaagcaggctttgagcattacttttgatataaaaattatcatcaatggaatcatatccagtaaatacaccataccctttttttatatattcagcaataacatttgtggctgttgttgtaagaatattataaccagaactatacttcgctgaaccaaagaaaatcacatcatagtcatatatgaaatttggttctactgaaatattagattcaaaatcatttattgaaattggtgtgacataaattacttgttcgcctgttcttggatcaactccatttggattgaagattgtggtgctgttttttgttgacatagtgccaccttctaatatagccttaagggcagctgatgaaggcaacgaatactgtgtaaaatcattaccaaatgtgaaattaactaaagatgtgttatagtcgcctgtatataaatttgtttgaccattgtaaccatcaatttgacttgggtaaacatttaaaacatttataaaagtcccttttatataagtgctaatttgtccccagttggtccattcattattgagattacctttgctttgaaaaactttgtaatacacattactctctgacagattcgtccaagaaagatatgttcctcctctgttatatgcatatgatgaattacaagttgccctagatgtaaatgtaagtggttctgagagtgcatgaacaaggaaaaagagagtcataaaaaccattgaagcaaccttcaaaccaaatcatttttgaatgagcgatcgaattttcatagcaacggttctgaattgaatgttgtccaaaagtgtttgaatcggcagttatcttatcgttgataacggctttttttctttacctatttataagaataaaacataggtggagaaaattaaaataccgacagtcaatacttttttgactacatgggctatactgtaaattgattactccaagtctcaaaaaaattctgatggacaatattgatatattataacaaatttgttgattatttttgttatgtaaattgacagaacgggcgacaagtacgtttattttttacattttttgacaaaatgaaaatatctttccttttaaagatattatttagatatcattataatatttatatatagaatatgtgttggacattttaatatatgttgtgaataaattcgattcaatatttttgttgagttataattataattaaaaaaatattttacagctcacaatattatatattttacacatatcgttattgaaataacaattttcaacttttatgttacgattccttgtatatgaattttttctacatacattgtatgcaaattatgaatttaaatttgctaagagatgtgtgggccaattttattgtcgcctgtttcaaatttacaaataaatgagttttctccgatacgtaaatcggaaatcttacagtgccggccatcaacggacagctttaaagccaaaaagacgatcaaatcttttttttagttaaaaagtggacaattttttgcttccaatgttctaattttcgtggcaggcactgtaaaaaaaatgttcatagctatgtaagtatattcccatatatatggtaaaggtttgataattttcatcgagaattttttttataagttagagtgttttttgtttttcatgaaatatctccatgtatataataaattttaaaatttcttgttgatccggaaaataatactacttgaactttaagtttattatgttgtttccgaaaaaaggataaaaaataaattaatacaaaattattgattaatcaatataatatataaaccaaattattgtaataatttcctatcttgttctttattaatatgaatatttaatgaataattaatttctaattcttgtaataaatctttatatatcttttggatatattcttgattatgtaaattttataaatgttgttgtttaatggtagaaattaaaatattattatatttagaaaaagatgttttattgaatataatttcattattaaataaattatttatcgtagtacatatttaataaagttttacatcatttgtgtttgtaatagaactgttaaaataaatatcgattgtaattattcacttgatgtaattccattaatttcaaaaataggttcttcaataactttttgtttattaaatctaatattaaaatttgatgttcgcaatgataatgaaaagaattattcaaaattcgtattattattagatatatcattaataaattctaataaagtaaaatcacttatcaaatcgtttaactaaaaatattcgattttgaataccatgtctttgatataaatcattattttgataattttgatcataatttgatataaagaataaatatttaaatatttcaggaaatacattcataaatatattttcatctttaatttcagtattatctaataacttcaaaaaaatcatttttaagtaacttactgtttctttgcttgaacatttcaaatttctgttgtttactcgcaatcgatggtaaattatccatcctatctatcaaacaaacagaatctatttcatatcttatttgtttttattgcttttagttgttactttgctattattcatacttaccaaacaacagattttcaaacaattcattttaaattttatcaaaatatcatttatttatcttgaacattatcccaataaacaaaatacacacacttttttatgtttcgatcctgatctatatttaaaatatcattaacttatctaaaagaaaaaagaatttttttcccaaaaaaaaattattagcaaatcaatttttattctttttgctttcttttttgcttgttcatatcaagaatttaacaacgggactcttattatttctaattctgtagatttcacacaagattacaaagcagaaactataaatttaattgttaatgaagtaacttcgataccatcaagtgttttcaataattgggatatcttaaaatatgctgaaataagtggatctgtaacaattcatacttcggtgacttcgattgacgttaatccttttgtggaatgtgcgaaccttttatatgtgaatgtctctaaagataaccaatatttttcaaatttagcaaatgatggaattccttcatagatatttgaatattaataaggtttgcaatttccttagttgctgtcgaaatatttcggaagttgacctcatttaggcaatcaacaaatggagttattagcagagctaaatcaaattatatttgacttgaccgaaaaaaatttcaaagaatcagctcaacaaacaataaaattattcgatttaaatttcccatattcttttaattttgtaatatgtaattttgtttattctgcatttttcgctcaaaagagtggaagcaattcgtacttaaactttttagatttgattagaattaaggaagaagaaatagacaaaaattatcccaatatcattaaaatttttgcatattatatattacaaattgcaataatgaaacaaattatttaattgatgaagatgttatcaatcatatgattatacgcacattatttcgatcataggaaaagtctcaagaacaatatcgtcttactgatcaagcagaaaataattttattgaaaattatgatgaactcttagcaaatgattggtaacttcacaaaaaatatgttaaagaaggagttaatccaaatgaaattgcgaaaataattcgaaattatgaaatcgaaaaacttcaagaaatatcatcacaagaaaacttcgattttaatcaaaaaattaatccatcactttatgaaaggtgttcatttatctatgaaaatgttacattaattgattatgcagcatttttttctgcagtaaaatgttttagatatttacttatgaatggtgcaaatatcgaaaaaacaggtaaatatgcagttgcaggtggaaatgaagaaattattcatttatgtgaacaaaatcatgcatcattttaccaagcatgtgaaactgcaattaaattccatcgcaatgatatctttaaatatatttatgaaaataaattagaagcagatttaaatgaaagtattattgatggattaatgtgtatatgtgttgattacgaaaattataaaattctttcgtatttagaagagaaaggatatgcaattaaagcttccattattaatgaacagcaaaaattggaaatgtatatcttgttaaaatgtttcttctaaataatcaaatcccaaatgatattttagtgtcttcttcaaaatcaggaaatattgaattatttaaatatattcttgagaaaggaattgatgttaatgctaaagatatttatttgttttatttaaaatttattttaataattttatttttaaaaataatatttaaaaaatattttcattattccgaacagcacttacattagcatctgaaaatggttatatagaaatcgttaaattacttcttgaacaagaaggaattgatattaatgctaaagatatttatttaatttaattggaatttatcacaataattttggatttcaaagtaataaattggaattattttaattatttcgaggtgcacttatgtatgcatctcaaaaaggtcaattagaaatagttaaattacttcttgagcaaaaaggaattaacattaatgataaaggtatttatttgttttattttatatttattttaataatttggtatatctatacaatatttatgaattttttatattatttcaaacagcatttataattgcagctgaaaatggttatatagaaatcgttaaattacttcttgaacaagaaggaattgatgttaatgctgaagatattcatttgttatatttcaagttaattttaatgattttggattccaatataatatttggaaataatttataatatttcaaactgtacttatgatagcatctgagaaaggaattatggaaaaagttaaaatgattgaagagaaagagaaatagatacagggtgttctaattcggaataacatctcagtaaatcaaaatttttaatatgcatataatatttcgaatgataaaaggttcaacgtcttttttgcacgttaatctgatttgttttattatgtgttttatcaaagacgaaacgacgtcattgttatccaaagagaacatattaatggattcaaaaaataaaaaaaaaattcattcttatgcttatcaaaaaataatgagtgattataaatgaggaattttttcacaacatggtttttatttaaaaaaaaattgattttataaggttgataaaattactgtacttcacttcacaacacaaatttttcactgaaaaatatttttgacaattttaactttttgatgatattctataatttattttttattttttgattggctcacaataatttctatggattacttttagtcagcggctagtttggaacgttaaaaaaattttcttttctcaaacatcaaaatgggaaaagataaaacaaagaaacaaaaaggaaagaaaaatgacatttttattcctttcaaggtcagttccattcctgacaaaatgcccttagattcagcaaagattgatgagatttttatccaattaatgaatgatcaagatttgaacatcgaaaaacgaaaaccacttcttcaaaagcctgctgagtttaagtggaatcttatcaaggcacaacaaaaaacagatgctgaaactcctgatccagaatatctattaaataagttaagatcagaagtcaccaacaaaatccttgaaaacattcaagtcaatctcaaatctggtcgtatttcatggtgcatgagatttattgagcaagatgggcacaaagaattactgaatataatatctaaaattatggttgatattaaacttaaatccaattatgatcctgttatccttactaatgctctcctatgtgttagacacatatgtaacattagtgatggaagtaaagcaatggcactacaaatctcattcttaccaacacttgttcattcttatctaccacaatcacccaaaaccattgaaattgtactccaaattcttttagctttcttgtatagtggcgagaatgaccgcaaatcctcgaaaataattgttcaagagctccaagttgatgactggtcacttttctctcaatttcttgacaaaacctccaatctggcgaacgttatgcttgccttccttaacggtctctggtattccacaaaagataatccaagaattcattatgaattacttttcaagtttaagaaatctgatttctttagcacccttaaagccatccatcctacgttagatgtaacaatttcacttgaagaagaaatgaaatatcttaattcgatattcccacaaaaacaacttaatatttttgaccccaaaattatcattagtgaaatatgccacctaagcaagccttctcctttaatattatgtatcttaatatcacttatcgaaattacacaatttaacattaaagcatttcgtgatctttctgtatacatttataatctcttggcgatactaagagttaaatttcaatctggagaagaaatgccattatcatatgcatcattttatgcgactcgatgtaaaaagccaattacattgaacataacaccaaagagtccaacttcgaattacattggggaaaccacaatgttttatccaatgtcagaacttacaaatatttcatttttagaattaattgaatcgaacatgaatgaaaaagaagaaattaaaggcaacgaaaacatttattcatccataatcaaagacttcgagatcaaattaaaagatgcaatgacgcaaatggaatctataaaatcaatgtaccagtacatgaaagagaaaaaagatcaagaagaaagaaaagcaaaaaacataaagaaagaattcgatgaatataaagttaaatatcagaaaatcgaaccttatatcacattattgcaaggtaatccgtcaaacctagtacctaagccaataagtaactccgaagccaccgaaaaagataaagaaatcaaaagactaaaaacagatataattatgaaaaaagcggagttaacgttcttcaaagatatgcaattaacaacaaaagaaaaagagctcaaggaaaggctaagacaaaaggatgcagagatagaacggctgactgtacaatttgcagatacgaaaacaaaactaagcgaaaaagaaaaggactacaaaaacttaaagaaagcactgggtatcgataaggcacttccttctgagttagaaatgttattaaaggaaattgagaaaaaagatgatatcattaagcaattaaaaggaaaatcaaaaaataacataaacattgactcggaagtgtatcaggacctaaaactaaagatagaacaacaagaacatgaaatattaaatctcaaaaaaattaacgaaaatttgagaaacaaattgacaggaaataacgctgatggtattgaaaaagacagaattcaattgggaaatttgggaaaaaccgcttcacaaccgcagctaaaagtgactttaagcgagggaaattcacccaaatgctcaaagaaagttgaaaaaataaaagaaaaagaagaaaacaatgctcctcttcctcctcctcctccgccaccaccaccacctccgccagttcctcctaaatctagtgttcctaagaaaaagaatcttccaccaccaaagaaattaaagccaatattttgggcaagaattccagatgatttatcacaagaaacagtttggattaatgttgatgatagtaaagtcgatatcaatgaagatgaaatctgcgaattatttgctcaaacagaacctgttgcaaaagtagcgacacaagttgctgcagcgccgaaagttgttgaattattggatccaaatagaagcaaaaccatttcaattatgttgtcaagaatcaaaaaacctattccagaaattgttaaacaaatcaaaacactttctggaactttcacagaagatgaagcaacagcacttcgtaagaacaaaccaacaccagaagaaatccaaatgttgcaatcttattcaggagaaacttcacagcttgataaaccagagcaactattcgatgggttatcgcagatacctcttatggagcaacatatcgagtttatttatcttaaaactgtatttgaaacccaaatgtatgaaatcgaatcaccacttggtacactaatggaaggccttaagttaattaagaattcatcttcaattcgtaagttatttacaattatattacgaattggtaatttcgttaatggtggaacacctcgtggaggtgcgtatggctttaagattgatttccttaataagctaaatgatgttcgaacgcaaaggcgtcaatacacacttttgaattatttagcagacaaaatcaacgttgatgaaatgtcaagtgaaatgcaaccgctgaaaatctgcctgacgatcgatttggattcaattcgccaaagttatcaaaaagttaaagagtccattcaatccattcaaaaagttatgtttgaagcagaaaagaaagcaataaacggctgccttcttttccctcaatatcaaaaatttatggaagggcaacgaactaatcgcatctcatttgttggtgagaagctaaagaaagtgaatatgaagtattccaaagtatcgaaattatatggcgaagattcgaattcaatgaaaatgtcggaatttataggactattcgtaaagttaacagaagacttagtgagggcaaaagatttcaacattcgagcgcgcgaaatggaacagaaaatgaaagcgcgcggcgcaattggacatccgacaatgggcggaggcgacacgcagcgcggagtgctcgacgagctgatgaggaaactcgcgtccggaacgccgcagctgaggaaggtgaatgcgcccgcaaggccgcagcccgaagagaaagtggcgaacgaactcgagctcgcgcggtcaaaggtgtttgggaagaagagtaaatataaataaatatttgttttgttttatcaatgaaataattaaaagttagtaactctataaacttttgacttcttcatgttcattatctatgatgacgagaataaattgtggacatgcggaagtgtaactctataaacttttggcttcttcatgttcattatctatgatgacgagaataaattgtggacatgcggaagtgtaactctataaacttttggcttcttatttttaaatattttaaaatatacctttaaacattttttaaatatcagtaatataacgtatacatttattcccgaattttattaaattattcattttttcttatttgttttcataaatatatatttaaagatatcatttcaatgaaattaaattgatgtacgcatctgcattacgaaatgagaaataatttcttcatttccaccatttataagcaaatatttgaaacatttacataaccaatgaatggaacgtaagtacatgataattatgtgtcttttataaatgcatctgctttgaaacgatttaataatttccaaaaaaaaatctcgtaaaatgggtcaaacaaatttttcattggtacttaagctccacatattttggatggtaatggttctaatgcctttaaatgaaataattttgttggtgtaaagcaaccgtttatttgaatggcaaatcaaaaaagtgactttgttataaaaattgaataaggacacagatgcatctaaacctgaacccaaaaaaccattttctggtatattttctggtgaaggaaataccttttttgtccaacttctgatgaaagaaagcattccaccagaccctacacaatgtatggatattttcaaaatacattttggagaaatccaagaaattagtcaaaattgttttatgaccttggaatatagctttactttaggagataaaacaagttctccatcaattttattgtcaaatacatctgaatttaacccaagtataattgttcccttcacgcgagcacagatgtgggaatgccaagaccacgaacaagtatttactgagtgtaagtatgatgttctggcaaatgatttattaggttcattccttccttcacaaaatcgagccaaattcgagttgactctaattgaatctcttttagaaatcttcccatcttgcgtcgctttttacttcatgaattcaggtaaacttcttcgaactcaaagtgttcgtgatattttaaatgatcaaaatatcccgcgatccgacaaattcttttatttttccatcaatgtccgtatccagcgggtaggggaagaagaatttgttatcgatactgtcggaatgcgcattttgtcacttcctgatgtccaatatcattttcggttaccaatgagtccgcaagaaattgcgagcaatgcatttagttgtgcgttgtatatttataaaaataacgatcccattagtgatggcgaaacaatcgccggattttcgcaagatgaaaacggaaagttttaccgcgaccctaaaattcgatggaaatgcagaagagaggacgcgctggttcctccaatgagaactgtgatagatgtaaatatgaatgaatatgcagccggcaatcgtatataaaaatgatttacaataaaaattattttagggtttaaaacttaataaatttattttattttgacatcatcaacatgtttcccttccataaaaagcaaaatttttaatgggcatcaaaaaacttaacttaagatcatttgcaaaatcaagtatagaagtttatccaatagacactttaataagaaaatatatggctgattgcaaaaatgtaaattgttactacaattggagaaaataaatttaaaaggtgttcccaatcaaagagtatttgtatacgctgtatgtaatgctattcaaaataacatttaaaaatgtgaaaattcgttatcaaaaatcaagatttatttcttgccttttctgccttttggagctgcttcagccttaggtgcttcttcaacaacttcttccttggcacctgctggtcgaccgtatgcaacgagctttgagtgcttaatcaagcaaacaatcttaccatcggcttcgagttgcttcaaaacttgacgagcaactgtaagagatatcttataacgatctgcaagtttagatggagttatgagcttactgcgtggtactgctttctcaatttcttctgcaacttcggaaaggagcactgtagcccagtccctcttttccttgttggtagtctttgtccacttcttcttaacttgtggcattatgaagaaaggtcagtcagaccataacgatacaggggtaattgtatgggtaaaatatgggtaaaatatggataaaaaattattaaaaaaattgtcaaaaaattattaaaaaaaagtcaggattagatcatctttatttccttaagtctcttttcaacgaaatcccaattaactgcatcccaatatttggcaaaatattcggctttacggttctcgtaatcgatgtaccaagcgtgttcccatgtatcaacacaaagaattgggaaaccacctatctttaactgggttagctgcattagaatattggttaatagaaactgatccgtctttattaactgcaagataacaccaaccacttccaaagattgtagatgctttttgtgtaaattctgatttaaatgattcaattcctttgaagtatttctcgaaaaagttgtttaattgttctgaaacttgaagtttttcacctgaaagacattgccaaaaagaaactatggttataatgttgtgctacattattaaagattggtccactagaagtttgaataatttcttcaatggttttcccgtcaaactcacttcctgggacgtttttattagcaaaatcaacataagcttgatgatgtttcgtgacatgaatttcaagttgatgtttagttaagaatcctgggattccattttgaagataagggactggagcgatgctgaacatgaaagtgatgtgacaaatcaacgataaaattgaattttattcaagtcaaacgctgaaaacacaaaattgtgagaaattttcaatcattattttatttcaagtcctccttttcaatatgaatagggggggccttattcttttgtaacatttcggatcgcaatttttgaaaaaatatcattgtccggtgataaattcaatttccctatctgatttcgaaattgaacattttttgaggataacaaaatgttgatcaaaagaatcgaaactcaagaaaaaacaaaccaatgaattttcatattatttcagattaaaattttttttcacataactttaattgtttacacttttaaaaataagcttttaatcaaaagaaccatgtaaatcgtgactataaagaggattttagtaaactcatttcctgcctaagttggccatttttatgactgaatttaaatgcatattcggtcacttactttttgcgtgaattcttagtaacctccaaaataatgtcaaaaaagtttcgtaaacggttttagaacatggaaatgttttcaaaggaagacataaacgccgcaaagaactacaagtacaatggcgttgatgacagtattttgataaaactattttataggagattttggaattggcttattgaatttttccctctatcccttgcacctaatcttatcacatttattgggtttcttttcgaagttgtttcttttattgtttccttggtttatagcgaatgcttgacagtaccacttccatcatgggtctgcattttcaatggtgtatgcctttgtatataccaaactcttgacaaccttgatggaaagcaagcaaggcgtacaggttcttcgtctgctcttggacaattctttgatcatggttgtgatgcaataacaggggtttccgaactaattaaggctgcagcctcattcaaccttggatgtggaaaggaaacattttactttgtgtttttgatgggcgttggcttcttccttacatcatatgaagagtatgtaacacatgcattttatcttggatacatcaatggaccagatgaaggacttacactcatttgggttgctcatattcttgttggattcttcccatctcttcgccaatatgttcaatcgaaatatgtcttcatattgttcttcatgggcgttggtctcacagttggaatgattctcttcaatgtcatcaaaaaatcccttacatcaaatgacaaatctgtaatgaaacgtgcattaatatcaattttaccatgcttaatctcagttaaaattttcttatcgcttgcatcatcgccaagcacaccctataaaaacccattcttcacaatgagcgctggatatgtccttcaatatggatctcaaatcataattgtttcgttccttacaaagagaggacctcttagaacgttcccattgacaatgattgtcctttgggctgttgcattggctgcactgtttctcccaagagttgcatctttagaacatttgtgggagggatattatgttctagttgtattgataatggttacttttgatattagagtcattcgcgggcttagcaaaggccttgaaatccctgttttcactctaaagaagaaacaataaagaaaatttttgtcgatcacatatgtattcaaattttcaattaagtgcgatcgcacaagtcaaaatcacgaaatttgtcattgatcatttgaataaggcccccctattcatattgaaaaggaggacttgaaataaaataatgattgaaaatttctcacaattttgtgttttcagcgtttgacttgaataaaattcaattttatcgttgatttgtcacatcactttcatgttcagcatcgctccaatcccttatcttcaaaatggaatcccaggattcttaactaaacatcaacttgaaattcatgtcactaaacatcatcaagcttatgttgattttgctaataaaaacgtcccaggaagtgagtttgacgggaaaaccattgaagaaattattcaaacttctagtggaccaatctttaataatgtagcacaacattataaccatagtttcttttggcaatgtctttcaggtgaaaaacttcaagtttcagaacaattaaacaactttttcgagaaatacttcaaaggaattgaatcatttaaatcagaatttacacaaaaagcatctacaatctttggaagtggttggtgttatcttgcagttaataaagacggatcagtttctattaaccaatattctaatgcagctaacccagttaaagatggtggtttcccaattctttgtgttgatacatgggaacacgcttggtacatcgattacgagaaccgtaaagccgaatattttgccaaatattgggatgcagttaattgggatttcgttgaaaagagacttaaggaaataaagatgatctaatcctgacttctttttttaataattttttgacaatttttttaataattttttatccatattttacccatacaattacccctgtatcgttatggtctgactgacctttcttcataatgccacaagttaagaagaagtggacaaagactaccaacaaggaaaagagggactgggctacagtgctccttttttaatttttgctatattttaaatatgtctttgtggtaatttttgtaaattcatgatcaacggtgacgatacaatatacataaaagtgcaattttgtgtgatttattcaaaatgatcgttttgtttaaaatcaaaaagtgaattagaataacatcaatcaagaaaaacgtttaactcaaaaatccatccttgcataatattattccaaggattttgggaagctaatatttctttgaaatttcaaaaaaataaaatcttaaatcgtaagttcttgataaaatttttatctcacattaaaaaatagacaacaataagagcattcaacaaaaaggatagatttgttcgttataaatacaaaaatacagatggaatcattgtttacttttcgtctttcccagaaggacagaagcgatttttatgttgttgtaaaatattatttatgcttcaaataaaaaattaaataagatgaataaactcgagcattaatgtattgaattttatgagaaattatgaagacattaactaatatattttatcttgtttcatctcatttcagaaatatgatataacacaaaatcaaatcatatattatcataaatattcacatgtaaatttttattattacataaaatattaacataaaatatgaatataatgatttcacaaaaacaaaacaaaatgtttttagataaatacttatctcaatgttattggttttatataaaaattatttgtaccaaatgtcattgatgtaattctggaatgcttgcatggagaaattgttcattcaatttttttttagatttttatgcacacctaataataaaaaaaggtagtaaaggtatcctatcaagtatgaatttcttgttaagatcaaagatgctaatacaattgctgcattatttgaaataatttccaattaacattttggaatatcaaataaaacatttaaatcttatcatttagcattggcatcaattccttccatgtcaaattgtaagataaacaattttaatggaatctaatagtgagttcctttttatgaccaataatttgtttatgaataaatattaaataggaataataactcatagaataccggtctggtttacatcgatttcatttaagttatacctgagcaaaaataaattcttattcattgaatataacctgataatctatagatgccaaaaatcttttactatgaaaatgcaaaacttcatatttttatgatatataattaaaattttagcgttattcaacattttaattctcaagaaataatttttctctaatttttgcacattattaaagaaagaaaaattttgcataaactatttacatatttgaccattccaagtttctcaatgccacattattcgctaactcattaaacgatggtaattttccatcgtcctcctttttatgcaatgacttatacgtttccaccgtcagcacttcctgcacgatggaaattgtaatgttaaacatcaacaaaagcgcgaatgccacccaaagcgatgtgtacgagaatccgacgtaagggctcatatctgtttgtaatgttgttgcgtcataaacttcttttattgaatcaccgtgcattacgcagaacaaaaatgaagcgcattgtaaaggtgaagcgaatgcatcatttagatgaccaaagaaacacattccgaatgcccaaaacccaaaaaagaatggaatgcaaccaacaaggaactgcataactttcacagttgatgataacaacacatgtataattagatttgttgacttgtttaatttcagataacgtatcaatgtaaagctgtgaaaaagtgttgaaattgcaattacataaagaaatggagaaacttctttagtgacatcttgtccaacctgaatatataatgttgaagaagctattgataccgaatgtgtgaccaatgtaaatatgtcccatttatcaaatttcttcttaaatatttctttccatggaatatttatatccattgaacgatgtttcgaatatttataaagtgaaattgtattctttattaaaattaataatgtgatgacatttaatacaataataagaaatggtaatgaataatagagatagaaaatggcattgccttcatatacttcgggattttcttggattcttgaatgttcaatgtcaagaaagatcgtatcggtggtgaggtcacgagtgaatgtgcctttgatggaaagcgtcatacggtaatcatacgtgtctttattgacttgaatgtgataatctgctataacttcaacactggaaaaaacatcaaggcttttacaaatttgatcaataataagatcaatatcttctctaacaagttgaagtttaaaggattcagcgccttgaaaagcaacctctatctccgctgatgaaagtgagtcaacggtaaaagaaactggaaatgattgatgaaaagtaaaaaagcgtgaacataactcagtaaaaataaacttgaaatcacctataaagtataattgaccaacaccaattggaataccatcaggttgttctggaaaatcgagttcgcctaaaaaataatcagaaattgcatttgaaaaatcttgagtaaaaactactctagattcttggtgaaatacggcaagaaaagcatatagaataaatattgcaacgtctaaaaagcagacccaaggaattttataatgatatttccaattatcaactaacttatgtggctttaattgaggaacttggtcgccatgatatgaagcaacaaattttacatctgcaagtttggtttcatcgaatccagcaagcgtaattttccgaaagtttgtcatcttcaattcgaacaaacatagtcaaaagatatttgttttttatttgttgcaacaaccagtagaatcagttttttgtgcttgaggtggagttactgttttagatgataattttcctgtttctgctctgtcataaactaatttagcggctcgattaaatgcttctgttacattatcaccaccacgtgcagatgtttcaatgtacgtaagttggtgagatgcagcaaatgtttgtgcttctgataatgatactactctttgtgatgataaatcaagtttgttaccaatcattgttattgcagcatttggatcacataacgcatgaacatcattaagccaaaggcttaaattatcaaatgactttctatcagtgatatcatatactaaaattacgccaacagcatgacgaaagtatgactttgcaattgatctaaatttttcttgtccagctgtatcccaaatttgtaatttaattggttgtccatcaatttcaagaactgttgacatatattctacaccaatcgtagaaacattttctgctgaaaactgatcatcaatcagacgcttcaatatagatgtttttccaacaccactagaaccaataacaataaacttaaagctatgtttgtattcgactcctatcatttttttgagtgtcttgtcaattcaattcaatccaaaattgggcacatttaattttggggcatcccgttaaaaccactcaaaaccctttgcgtgaaaagacgatatggaaacaacagaattctattgaaaatcacatcattttttgtaaaggcttttgtttgttctctttgggttcattaatgttgtcatttcacttaataactttgtgaattcttcattatttttggtatatgctataattctttttgtagttttgaatattgaattcaatacatttattaatgtttgatactttgttaacattagtaccaaagtcccagatgcatcattaatagtattctacttcttttcctcatggaaaatatccattagtttcaattataagttcgtttatacaaattcagaattttcctttttctttcgcaagtcgaagacaaattgaacacacttataaaataagtggacattaataaatttttgtttttgatgaagttttttgacaaatatttattttgttgaaatatcaagatatcttaaatcgattgattatatttttatatttttaacccgaaagttgaattcacaaaatgaatggaagtattaaataatttatatttgaatctctacatattaatttgatgaatatgtttttacctttttaaaaattgacaaactttgtttagtatcatttcacaagtcaacggtttgtacggtttggccgttcctttcttctcagagccatgaagtacacctacaaatctaatggtgctccagtccttaaggcttgcactccaactgaacgcgtccacttcaagccaatgttcgaaacaggccgtgctatcaatggaatgaaggtatcaaaggcccttgcatatctcgaagcagttatcgagcacaagcgtgctgttccattcttccgctacaacgaaggtattccacaccatgcacaaggtaaggaatggggctgcccatcctcaagatggccagaaaagtctgccaagttattcatcaaacttatcaagaatgcattggcaggtgctgctcaaaagccagaaatcaacgttgacaacttatacattgttcacgttcaatgcaattatgcaagaatgtatcgttatcgccgtatccaccaagcacacggacgtgttaagtgctatgcttcaccaccaactaatgttcaaatcgttcttgctgaaaagaaggctccagttaaagcagctaaataaacacaatcaagatttgaattctcattttcaaacaagcaacaacagttggaactcgcttgcgcttccagtttcctaaaatcattgatacttgaaaattattgatactaataattgttgaaaaatcttatttgacttttacgtcatattaacttttgtgaacaagttgcctttagctgttaaggaacatcttctttgttaagtaaagattccggagatacataaaaaacattagaatttttacaaaagtgacaatttcatatgtcttcatattctcgctccatcacaaggttcagtccagatgggcgattatttcaaatagaacatgcgcacgcagctgtaaaacgcggtacaaccgttgttgccacacaatccaaagatatgattgtaattgctatagaaaaatcagcagtagctaagcttcaagatccaagcaccttcaggaaagttgttcctcttgatgatcacatcatgtgcgcatttgcaggtcttcatgcagatgctcgagttcttgttggcaaagcacaaatcgaatgtcaaagccacagacttacataccaagacccaattacagttgaacgaattgctcgttatattgctacggtccaacttcgatatacccaatctggtggtgttcgaccatttggcgttgctacattagtttgtgggtttgattcaactcaacaaccgcacatctacgaaactcttccatctggtggttataccgagtggaaagcgcgtacaatcggaagacacgatcaaacagttatggaatatctcgaaaagcattacaaagatgaaagcagcgatgacgaagcgatgaaactcgctgtgggatctctattagaggttgtggaaaacggagctaagaatcttgaggtagctgtaatgaaacgcggagagacaatgaaacttttggaagaaagcgagttgaatgagatcattagtacaatcaacaaatgattagaaatttttgtttttggtgtaagttgcaggaaaataatttatgtttattgttttcaacttcaactcgaagcgcgttttaaattattgaaacaataagcgaccagtttcttcatcatcttttttctctataattaatttcaatatttcaaaacattttgttcgaagaatgataaaatttcaaagctattgaattgctgttttataataagtatttcatttgctgttttattgatttcaaacactttctcggcataaaaatatttctatgaaattcaattactgcttcatatgcatatttcaatgtttccgcatgcaattgcatatttactgtattatatacatttgcaccattcttaagtaaatatttaaaacattttgctgatccaaaaaatgctgcataatcaattaatgtaacattttctttaacaaatgaaaatatttcataaagtgatggtttaattgtttgattaaaaacaaaatttgtttgcaatgatatttcttgaagtttttctacttcatcatttcgaattattttcgcaatttcatttgtctatttccttctttaattaatttcttatgaagtttacaattatcttttgatagttcatcataatttacaaaagacatgtaataatagctctggttgttttttgcaatgtttggttcaagaaaattatgttcaatcatagcttcaagaagataagatgattcatatgtatgaattttaagaaatcgtccaaatacgtcaaattttgttcttcaatgtttggaatgagttcatcataaaatattggattatctcttctaaacatgattcttgtgcttttaattcgttcacataatgaaaaaagatataaaacaaattaattaatattttatcatttttttctttttcaaatttgtaataaatatttcaaatttttatttgagcaacaaaagatgagtataataaaatggaaacaagaaaattaaatatacattgtgttatataatcgtcaaataattttattgatgattgagcttgttttcattattttcttggaggaacctttctttgatatgaggcaccccaatataacttcacagacaatttaaacggtcaatttaacctaaatcaaagatctttataaagcttcaagattttcatataatggaatatttattttagttatattgaaacattgatgcaattttattatatcattaatagaaataaaaatatttatatttgaagttacaaaaattgaatgcgaaacgatatgtaatttgatcggcaaaaagtgggtgatgtcatttgacattagttcacatgatttcagtcggtggcgattacacaagttatggtcactctattgatgaaataaatgcaaacgaacaagagaagcaactcggcattgaccttgctccaacaattactcaaaatcttcaatcaacgaagataaaagataaacttaatggtgttaaatcccttcttagtgtcatgtctaaaggtgatgatgtcaaagagtttttccctcttgttgttcaagaaatcacatctgaagatgaaactcttcgtcatttatcatatgtatatcttgttcaatatgccgaagctgatcctgattctgctcttatgtctgtcaatactttccagcgatcacttagtgatgaagatccaattgttcgtgcaatgtcattaaaaatcttatcttcaattcgttcacccgaaatcattgaaattgttctagatgccgttcaaacatgttcacgagatgcatcaccatatgtacgtaaagctgcagcccttgccttaatcaaaatctatgaaacagattctgattgtcttgatgacattcttgttattctccaaaaactccttaacgacacatctgtaattacaatcagtggagctctttatgcactatcaatcatcaaacctgattatgatgaattagtccatccaatctttcgtacgctctgtaatgttattaacaaacttgatccatggggccaaacgattgcattacacatccttcaacgatatgcccgacgtaattttaagcgaccaaccgccaccgatgaatggttaattggcgatgatgtcgaagaagaagagattgatcccgatcttactcttttacttaagtgtgtcaaaccactgttaagttcgatcacaccatctgtcacattagcagcctgttcattaatattttattgtgcccctccatatatgttacaattaattgttaaaccgatgatccgtttgacgtataataattcctcgatatcatatgccgccttattatcgatctcatcgttcatcgcagacaatgctgaaatctttgttccacatattcgtcatttctttattacatttgaagatattccaccgataaaaatcttaaagttacaaatcttatcacaactttcacgtccatctaactcagatatcttattaaaggaattagcacttcatatccatagtcctgacaaagaagttgcatcagcagcagtcaaagctattggccgtaccgcatccaatgcaggcgactcaagtattaattgtatcaatgtcatcgttaagttattatcatcaccttcaatcactgtcatctcgcaagcagtgaaaatgttatgtatcttattacgtccattacccaaacaaatgaacgacaatgaagtcgacaactttaattctaatgaactaatggattcaacagaagttatttcagtccttaacaagttacttagtgtctttaacaaaatcaatgatgcggaaactaaagcagcgttagtatcattaatcggagacaagtcaatattaatacctttacaagcgcatgaagtattacgtcaattaactataacatttacacaacttgaaacgccagtaaagatgcaaacggtgaacttagcagcgaaacttttatgtgttcgacctaatgaagttagtgatttaacacgttatgtatttactctcggatattatgataacgatatcgacatcagagatcgatcgcgtctattacaccaattattaacagcgcctcaaaacaatacatttatgaacaacgtgcgccaaaagagtttcgaatttttgttccccaaaaagccaattgtgatttgggaaggagacataatgaaggcatccgaaatagaagtcggttcgttcagtcaaatgttcggtaaaaacatcgcaaagaacgctctcgtacagcagtgggcggacccgtcgaagctgccgccatcgtcggtaagggacgaaaagataatcgagaacgacgatgaaaacgcactcaaaatcgagcaggataatgaggacgacttggaaatgttcttcgggccaagaaaggaaaagaacgcaatacaggtgcagaagctggacgaggacttcttgaacatgaccgaggacacaaaggaaagcgtccagaataagtcggacgacttcttcgacttatgaagaaataaacgaaaagtcaaattatttttggagtgaaattatttgcgcactcataacactgtaaatgtgttttgggcaattcgacattactttgacagtatcttaatgtcgcgtccgattgtaaaattcctgtacgttaaggagttctcaattttctgaagtttattgcaagggaatttttaatttcaagtatatctcattatgcatagtgctttaaaaaaattgacaaaatttctccataacctcatataaagaactattatatggtatatatgaaattcttcattatattatacagcggtaaaaaatgcggatattttattaattttacaccataaccactaaaatcgtctaataaaaaaaatttacctatagttataaaactaatgaacattgtatcaaattaaagaataaatatgaattttattaattttaaaatataattacattttttcaaatgtgtattgagataatcaaaaaataagaaaatactaaataaaaatcattgatacttcaaaatagtgagtctttttaaagagttaataagatttcacattatagaaaatcgttttgtgtttgatatatttcgcgaattaacaagtaaaggaaaagtttagttgattttatttgtcagacattaataaaaagtaaagtggagagagatatgaaatgagagtgaatatcgggccgatagggacatctattattttgatttttttcaatgcattcggatttttctaaaatgacgtttcggctatcaaaaagcgagaataacggttttttgagaaggcgcagaataggaaatgcaaacgagttgggaagatctcaccaacgacgaagatgtggacaccaacccaaacatgcagtcattattaccatcatcactaagagatgtgtgggaagacccagactcacaaacaaatttttatgttaacacgaatccttcatttattagtcaaaatagaagcttcggttacgtaggttctgcaccaattcataacaatttcgtccaaaatcaaatgagattccaaggagagattcaagatgaaaataattctattttaaaccaaagctatcaggtggaattccatcctagtaggtctgcatggttttatgctcctcaaaaatgcaaaatagagatcggagattatgtcttaacagaagcagatcgtggatatgatattggaaaagttatcaatattaaaaaaagaccaccaacaatggatttaaggtctaccaaaatgattgtaagaattgcacataaagatgaaattgataaattaccacaaaaagcagaaagtgagaaatgtgcactcgaaatgtgtcgtgcaaaagcagcagagcttggactgcccatgaatataacaggcgctgaatttcaatttgatgggaaaaaattgaccttttattacacatcttcaacctatatcgattttagagttttggttcgtactcttttcaaggtatatggtacaagaatatggatgtgttgtacgtcagaattgataaaataaagttagatataaactgcatcatttgatgaaaatttttgaacaaacaaatacagatgtaaagtatcgaaaattgaatttgaacggttagtgtcaaatccaacacaatttttacggcaaaacaacagaatctctcaaaaagtggaccgaagttcacgaagttttgtgaacactaataaacataacaaaaaattattagaagatatatttattttattgaagtgtgaccccaattccaaattcataattgcgagagctaagatgagatactgatgataaagtgagtcttatgttaggagtaattctgcgaatatacacagatgaaacagaaccactggatgtaaatgaggctgaaagatttgacatctgaaattctctttcgaatccaaatacaaaatttgatgaaagttgaagaggaaccatttggagttgaattccagctatggtacgtccaatagtcttttgccctgataacaccatagcaattctatcttttgattcaatcttagcacatgcgccaagaacaattttgcttaaatctatgtctgtagcgaactcgaaacatgtttcagaatccacaaagtcatgataaaacccagtaccaattctaatgtttttatattttgttgctatttcaaaatcaagttttcctgtagaagaaccatttgtatgaaaagcagtgtcgagtgaacataatctgtttgtatttgaaaattctatattaattgatggtgaaaatgtttcggaaattgatccactgaaagttacagaagatggatgaaatggaactgttaaactaacctcaggtaaccaaagaccgctaaaaattgctctaaatggcatttccatatagtttccaataaaaagaatttgataattccctgggtattcctgttcgttaaactgtcttgcatgcgctttgtcgtaagttctaggttttatattgacactatttacaatgttgaagtttggatttactgggtacaaatgtgtgaaattgaaaccagagaacgaactaacaagacctactgaattgacatcactgaatatatctttgtatttacttgacctagtttctaatacgttttggttaggtttggcttgtgcgctccccatttattgtttcaggttctttgtttggaccaacatgcaatcctataacgataaaaaatcgttcaaaaaattgcagtcttcattcaaaaaattcgtagagctaaagaaattaatgcaaaaatgcggttgaagaagattagcgttaaaatagacatgaattagtttaaaataaatatgttcaaacataaatttggataaaaaatacattaacaatataagatgacaaccataaggtaattgtttataaacaatagagtttaattgagaaataatttttctatttctattttaattaagatttgttgttgttctcttcctgacgcttgatgctcttgttgtcgttctaatgttgcgtctttgtgtttctgctcgatcaactgaattctcacgaggtctacgcacaggatttctcgtagatgtggtgaaaggttctctttcgagcagtagtgttctgtttttctgtcttgaatttatttgtgttgattgtaatgtttgtgtacgagcccgcccagatgttgttctttcctgtgtcttcttcctagtactaagcatttcttctgtttgctttaggtcagcttttaatgcatttaatgcagaaatgagatttgcatttctatgtggtggatattcaggatttgtttctttcctcgaagtttttcggggtgtttcagctcttcgtacaggtttaacccttgatgtttgttcttctgtctttttagttcgaagattattatcatcgacttttttctgtcgtgttcttattttaggttctacacctgtacgtaaaggagtttcttcatcatgccgtacccttgtttttggttttaattgtgcagcttttggttcttgaggaagcgcttttttggggagcgtttcgacatcagaatttgacggcggtttggcgggtgtttgatgctgttcttttgtccaatcgtattggagatcatatataaacccttctcgaatgaaaaggtctctgaacaatttttttagttcagtataattaggggcctcagtgaacttaaggtttcgtacaattttgaaatactgaacaaactcatcaggaaatccttcacaaagttcctcaaacgtggttttagctttgacagaacatatgcgttcgtatttttgcttttggtcttttgcaggaagacccatccatggaagagagcctctaaggaaatatagccaaacaaaaccaagagattccaaatcatctcgccttgattgctcttttccttgtagagcgttaacagatgcgtatctagctgttccagtaagtgattttccttcacaatatggaatgtgtgtatgtgtatgttgatcccgatattttttagccagaccaaagtcaattataaacacttgcgatgagttacgaccaacacccattacaaaattgtctggtttgatatctctatggataaaatttttttggtgtatatattctacacatgatatcatttgatctgctaacattagaactgtttttaaagagaacttgtggtggcatgctgaaaataaatcttctaatgatttacctaataaatctataaccataatattatgcgttttgttactgccataccaatgtagacgtggaattccagtaccaccagaaaaaactgaatataattttgactcatatgataattgtggaactttggcttttacactttctaattttacagcaaaatttcgatgtaagcgggtattttctgctatgtaaatttcaccgaaacttccggctcctattctttttataagcctgtaataagaaccaactactttttccatttgactttacttggaaaaattaaacgttttcttttggaccaacaaaatttattaaatatttattcagaataagtattattgattttgtgtgttgttttgatcattagtgaaatgataataacatttggagatatttttaatattaaaaataattttgaagataattcatattatagtaattatgaaaacgatggagttttatatgataaattgattacgaaactcattatttatccacttggaaatctcagggaaacattcagcattccagattcagtcacttcaattgaatcagatgcatttaatttatgtacaaatttaataacaatttcaattgggaaaagtttaaatacgataaaaaagttctgcattctcaagttgtgtatttacgaatttcataattccaaacactgttatagatattcaatcaagtgctttttcattctgttatgaattagaaacgattatcattggcgaaagtgttgaaaatattggaaatcaagcatttgtgtattgtacatcactgaaatgtatttatttttatggcgaaacttcaccatcaattggcagtgattgttttcaagatgttccaacagaatatgttatggtcaatgaaacatacacaagtgaaagatttggagaattaaagataacgaaaggaacaattgactaatgtcttcctccaacacttacatttacactatcaaatatatttactaaatcaaatgatttttctttaacaaatacgaattcattaactatttttcatatcaattctttttttgtatattttaatacgatatttgttcattatgaaaacgtttatatcatttattctacttattcccaaatttgggaattactagtaatttctttacaatattaaactatcaaaatgatgatgatgaacaaaatcgaacgacaacgtgtgttctctttagtattttcttacgttttgtcgtaattgtttttataattatcggaattataatatttttaattaaaataaacatacaaattaatcaatagctgtaccaactgtttcaataaattacgaagtaacagaagaacaaacggaacatgtcaacagatttcgaaatcataaatcttgtttataaagataataatcactggatttgatgatttctatataaatgtttctacggatacattttataaacaaagaatcttcatttaaaaatttttaatatatttttgattatataataaatatcactagacatatttttttttttgttaaagtttttgaacgtgttcaatagctataaacttgtttcaccaaaaacgttttgcattactgacatatcatcattaatgttctaaccatggttagaagtcacttagtacaaaatgattgataccacacaaataaatgcgtactatgttcccatctcagtacataaaatttttatataaaaaatattttatactctttttcctttttagttgtgagcaacttttctttgggaaataactcttttgacttatgttattacaaatagtaataatattttattttgggggtgcctaaaagcaatttttttctcgaaaattatttgaattttgtaaagtttattgtcaaccgtttgttttcggagcctaaaaaattggatttgcttttcttttttttcattgtatcccttatagttttcttgacatttctatttttgaagttcattatattcaagctaatacagaaaaaaacaaataatcttttcccaaatgattacttattcaactcatcatttttcaataattcgattcaaatagtgcaaggatcaggggaaatcggatcaattagtgtaaagaatgctcagctaaaaattaatccacgaggattttataattcgtcaatttcattaattgatattaaagttgattccttaaatctaaccctgaataaaacgcatcacaaaaagcaggttaaacacaaaacattcaatagattattgctgaataagtttttaacagattttgcacttatcttaacaaagtccattcgaatcacaatacaagatatttccattaccacaaacaagttttctttttctaccaaatcttttaaatgtaatttgactcgtggtgatgagtgtgttaattttcaattattattctctcattttatcagtcctttacaaaaaccacttatttacattccagagttccaagtatgcaccaaaatcataaacattaccaaattatggaacatacgaaatcttctcaaaatattcattaaacaattcgaaatctttactccttcaatcaacatcaaatataacttagggaaagtcaattctaccatttcagatctttcgattaatttggcaaaagaagatactgccattattcaattccatatttctccatttgaattatcacttccattattagacttagcgacgacaagttttgaagtaaatatttcttctttacaatgtgttaatggtgaaatacacaccaaagaaatagaaattacacgtaacacaattcccatggttgcaattccatctcttgtagcaacacgacgtttgtgtacgcttggtaacattaaggttcatttgtttattacattcataatcgacttggcacttttaaaacggttcctcacaaaaccgaaagcaaaaacagcaaaaccgaaaagtgcctttaccatcacatcaccacttgcgattattgatttttcattttctgatcagcatcaaattctttttaccctaaagcaagtttcattatgtaacaaagtcattgaatccaaaaatttaataatcgatccaatcatcattgataatccaattaatttttgtaatagctcaagtgtcacaattgactttgcacgaccgaactttagtattcaagcacgtcgagccgaatttaagttaacaaataaatatgcgcaaaaaagttacattcaagaaatctttaatttactttcatggttatccaaacaaatccatggcgatgaatcagcttatagacatttgcaaccaccgacacgtcgtaagtttagttttaagattcataaagttatagttacattagaagaaccgattttaaccaatttaatttcccgctcaaatgaatccaaaagaattgcacacgaaggactacaacttcggcaatacaaagcaatccaaatgatcaatggtaagaactccaatttttcgcaagaagaatttgataaagaatccaacaaaatgttatttgaaatctttaagaacataataaaatcaataccaaaagatccaaattcgaatttacttgtaattgtttcgactgattttaatttgatcattgatggaccttcaataccgaatcatgaagcaggcgagaaaatcattaatgaaattgttcctgaaatgacttatgaagatatcggccgaatatttggaggtaagttaactttatcttctcgatttttatgttgtaataattataggcttggtgatatacttaagattgaaggacttaatagtaatggttacttcttcaacgtaaaaagaaaaggtttaattagaagtgatttctttcatttcttaattacttgtgatcatggtcaaaatgaattccatatccctggaatttcaacacgatctgtatgtatagtagaaacaaacattaaatgctccaaaacaatcattaattattcgcctttattaagccaattaaaacaagacctaaaattgggaactataaacttcagaaaaaggaaatttaacttcaaaaagttgcggtttttcgataactgcagattaaggctaaggggcaaatgtaattttacctcagaaagctttattgttacttataaaactaaacaacagccttaccaaaagctcccattcttaaaaatcgaaataccttcgctttcattgaatttcgatggaaaaggatttaatattaatacaaatgatttatggattaggattctaaacaaaggaagctatcaacaattggctactttaccttcttcgaacattaagttaagagttgtttcggtaaatccaaataatgcatctggtgtacatccagtgtttttccctttggattcctcaagaatgaatgatcctttatatgatccatttgaaaaatatagaacacatacttttcatttagattttaacattaatttcgcagtgaaatttgcgaacgttaacattgaataccttccgctactttttgaaaactttatgacgagttcgctcttacaaattttcgttaagcctgcttattatgttgcaaggcctcatccttatcctaccttttcttatatttctttaaatgcaacattaccttatattagcattagtgttccaagtaaatcattagatttaaaaatttctggagatccattaaaattacaactttcgacaaatgatccgaaaacgttttctctcaaaagcaaactaacgaaagtcgaagcgttaattaaagaacaagtttatattgatttatcgttaactaattttgaaataatcaaagatatattcaccgaaatttcgataaataacttaaaggccgaaatttcatcacagattttacaatacttaagcgaatggaagtcagatcttagtttaccatcatcatcatcatcaagaagtaagatcaaacatgaaaaattaccaaaattcaaatcagagtcacaaatcatgaattacttccaaaatccttcatttgtacttaacattaaatcaggtttagccaaaatgcacttaatccaaaacaaagaaattttgtttttaataaatggactacgttattccttaatgaaaagcaaaaagcaaactaaacttcattgggtttgctttaacatggcaaggctattcactataggcgaatatcctttaatcaagttcgagggaggcgacatcaagacgacgagtgtcatcagtcagagtttaattctgttcaaactcaacgcctttgaaattaacctcaaaccggtcgattttgaattctttattcctgaattttctaagtatagaaataattcagagtcaaatcaaaacgagggtgccccaagtaagcaaccgttgcaacgccatcaaaaagttacggttgacgttaaggctgctgtacttcgacttatccaaaacgaatcttatgtattagtgttttcccaaatcaataatgtgtcaggagaaatgagtaagcttcctgactcatccagcgcgatcaatcttatcatatcttctatcttaattcggaatgatcatggaacagatgatttcaaagttatccttgaaaagtcacaaaagacaactaacccattccttaaggtatgtatacaacaagccccacgtattatgaaggcacctgtatttgaaaaggtcgaattcgtattttctccatttatactcagactttcattagtgttcatcaaagaccttatcaaggtatttccatccaacgatgaccttaaattacttctatatttcgaggataacgaagatgaagctccaccatcagaagaaatatcgcttaaacagcccgaagttgttgtaggcgacagctatttcttccgcgagtttgcattcgttccattttctgcgctaatcagcgtcaagcgtaagaatcacggaatgttctccgagttcagagatcgaccattcgactataaaggaatacatctgtacgacacattcggcacgccggaccgactttcgaacttcgtgaagaagcatctgatttgggcgataattaaggcaataccgcacgcattgctcagaaagaaaaagagccaaggatcaaacgccggacaggatacggacaaggaaacaaactaaatcatttaaatacggttattctaataaaatttttggtctttcaaaatgtataatatgaattagagtcagaaaattgatttaaacattttttgaaaaaatgtatcataaatgcctacaaaagcaaggaacgtgcttggtattcgataaaaaatattgattttcttcaaaatgatagtgacgaattaattaacaatcaaaaatttaaattaaatgtatttttaaaaattccaaagacaaaaatcatatttatcttccattaaattattatattaataaaaattttgattttctaatatttttttcgtgaaaccttctgcttgcaccacattatgttttttcattttgtatttaaaataacaaataaaaaagttaaatttcttcttgagataaaatatattagaaatttgtactaaaaattaatagctgcataaccaaaagaatcattattttcattgtttaactttattaatatttattacttgatgtaattttcattttgttcatcgcaaatattattcttatgttttttatagtagtaaatattttttataaaaattatccaattaatttacatttattctctaaaaattacgtgttgcttttctgttcgcgactttgcaataaagaagtcaattactgtttgccagtcgtattgtatcagcaaatccttaaacatatcgggcgatatcatttctctaaagtacggaatataaatagtgaacttaatcaaatggttacagaacgccattttcgcggaattaattttcggcttttcatccaacagcaattgcctaaactgcaacaagtcggagaaaccctcttttttatattcgcccattgtcgttactatacccaaaatgaacaatgctaaatcacttccatcttttggcaacaactcaggcaaatatatcaattccttcacacattttatcactccgcgaattttctcagggtcattttcacataaaaatatgaagacacaagccgcatactcataatcaaaagataatcgcttaggatgaaacctataaatgttatcgaaaagcattagcctcaaaagtgtattcgaaaatttctcaacgccaaaataatcaaataaagttttccaccaaataaatattcgtttcgcttggaaaggcattgaagctgtaggctgagctaagaaatgtatatcttctaatagcttagaactgacagcttctaatgaaggaggaggaaatttcatgttgatcatataacatggatcatcaactaataatttccattttcgactggagttcatatagatgatagtgatatagttaaataacatattatatattttaccattcggatatttaacttttaataccttaacaccactcaaaggaatatcaaaaaataaccaaaaaaataccgaagtccataaaaaagaatatttttgtattaagaatatggcagaatctatgtcaggagattcatgcaataaataaagaaactcaatgcacatataaaatggtggcaattgctcaagattttgatatgtaatgtttcgatcacgatatgtagaatcaatagtggcttgtgaaaaacaataaaaaaaatgtcctatgcgctcattagcagttttacaccaacttaaaaatttatctttggcttgtttataaccaattttaaaccatggctcaaatgtcaaatataaaaacaatgtataaagcttctcaaatgtagcatatgaagtagagctctcaaggtaatttaataactcagttaaaaactcataataattatcttgaatacttaatatgatataaaagtcaagaatgttatcaacaaaaaagtctgctaatatgattagttcattggtgcttccttgttggagcttctcaatgaaaagattaacaagttttcctgtaaatgcaggatatgtttgaacaaccatttgaaggttattgaaatcaatttcttcaggtaatgctgttagaaattcgatagcttgctcaagtgagtcgaaaaaaccaatagataacttttcgatccattttcgaataattatcgaactgatcatataagctgaataaatagtaaaaccacactcatatgaatgttcttttggatgaccatcaaatatttttttaataatattcccaataacatcagaaggtggcaaggaatagatttgactaagtttggctggcaaaaaacacgatgctaaataaccggacgaaagagttggatttgacaaaaaggaatgaagggcaaaaacaaaaaattctttgtaaaaacgaactgtacatgcgtcatcataaattttagtttggagatatatcatggaaaaaatatgaatatgaatgtgatttgaaaattgagcaaaatgtcctttaacacctttggaaaaaagtgcaaatggcaagtgcccttgtgataattgtgcttctttgaaaaaattttggaatgctggtgttgctaatgcaaattgttgaacttttaaaaaatcatctcttgcaaaatatctggctgacgcaataagtatactaaagaggtgagattctgatagcttcttaagagcaccttttaaaatttcatttgtttcagataataaaactgcagtcaaagcaatacaagcactcttggccgcttcttcgctgccaacatttgcagaattaaaaagatcatctccaaattgtgttattaatcgaattgttccaagaacatgttctttattttctaaatctatatttaaaaatagattttgtgggttgccttttacagtgttataaagacatttaagaaaatattttgttggttggtaatcttttccacataattctgtcatataaattcctaatttgataattgttggttcatctaaactttcatgaagaacttttatatattcttctcctgaaaccctttgattccagcattttttgatgaactcttccatatgttcctggtttacaattttgaaaggtatctcatttttcaatcctgtaaagtattgtaatataattaagacacttcacaatgatccaaaaccgctcaaaaatgaaaatcaaactttctaatgaaatattagaaacaaatacttaattgcagaaaaatggcattgctggtttgatgatatatacataaaaatatagtttttcagggcttattatcaatatactaatatcaatgtattgctattattattattattctatttgatcaggctaattgatgatttatttacattaaattgcttttttagaaagcttcactcaattttttccatctcggaatacatgtaacattttatgttacattaaaaaatttcactcacaatattgttgttgtcattttcaaacttgtttttattagccttttatatatttgcacataataattactgattatttgtcataataataaaagatattcgaaaagcagaaatattgaatatgatttttccataaagtaacaaaagttaatatatgaatagctattattatcgatttaattttgtttttcgaaaagatattttttgtctgggaagcgacggcttccgaccatcccttctttcaaaaaaacaatttttgtgagtaaccggatttcggtgatacgcgcgcgatcattcaatttgtatcaacagtttaacctctacgatgaaatatcgacttttcgcacgaaagcttacatcgtacttaagttaaaacaccgataatttcaaatctagaagttaaaagaggatttgtattcaatatgatcgtacctaatcagcctcattcaaaaagtgattttgaccgcccaggtccaacacaaatcctactgaaaatattaaatacaacaattaaaaattgagatacgaacaataactacacacaaaatttgatgaggatcggagaagaagaagaatctgatatccatatggagcatcaagatttgtttaataaacatgaacaaaaaaatgaaggtcctatcccattcaaaagtttcttttctgaacttggtgatcaatcaaaaaatgtacataatttattttatgaaatccgtatttttgtcatgggattaatgatgataatttctgggacagggcttgttcaacctgattcgaattgtaagacaataacaatgttattctttagattcattcattttatgtctttttctacagattctatgcttgagatgaacaaaattcatatattagttatgttaattatattagttgttaatgtattatcaggcattatcacccttatattgctaatgcaatataaaaatcaaatgactcttaataaatacttaagcaccacatggattgtaatgcatcgctgcatcatcttatttccatcactcatcattggcaagtattttggattttattttaacaagcttacatatgatcaaaatttaacaagctatgttcctacacttgcccttatattcatttctttagttgcctggttatggtctataggtcttagttcatatgtttataacttcaatgtcacaagcaaacgaatatattctgattcatcacgcctacatcgatccaatgcctttttcgaagtatttcttacattttatccacttctaaattcgatgtacattgatgttatgaaatccttttttggcttagctaattcatatatcagttttcccatctttaacttcatcatctttcttatctgcactatcatcatcattaagaacacaccatttatcgttccatccaccaattggcgctttatacatttaattttcaccacatttttattatcatttttaccgataatatcaaattatttacccaatgcattaggcttttcattaattcttctactaatctttaatccattatttctctttttatcacgtataatcttttttaagtataattccagcacagaaacaaatcaatcggatgaactttgtaacttttcacgtcttccagaagatacagatgaatcacccaccaataaatatccattaatttcaatcaccaaacaagacataaccattttgatctatttaatctgcggcctaatatttatggtatatttaaatgctttaacagcgcaacgaatgccagagaccaccgcattacccgattatttacatgagaagttttccatagctaaatcattacgtgaatccaaatattatggtaattatcaaatctcaaacatagcatgtatcatcaatggcattacattaatatctttcttcttcacagcacgtgattcatttaatgtccgacgaatcgtaataatatatgcgacattatgttacattcgagcagtctctttcttcttgacgacaatgccagccccttgtacaggtacaacgaaatgtccatgcagtgaacataaggcattgactgacttgaagcatgcaaacccattcatgatcgcgttctcgtggctgttcggactcggaatgtttctgacgcatccgcaatgtggcgatttagtaatatccggacatacaatgttcttatggctatccactttagggatattggatgtcattagaattaagattccaacgccattcaaacaattgatgtcagcgtcgtgggtaatgttcattatggtttcgttgttgttcatcataatctcgagaaatcattactcaatcgatgtatggttcggatttatattcccacaaatgttttggatgctatataaggcaggtcagaactctttgaaatttaagcccggtaataatgactcttgtttgctagagctgttacgatggatagaatatagaaagttccaattgatcgatgacgaagaacaaaacaacgaagaaaacgtacaaatttatgaggaaccgacaatgtaacgtatagaattgttttggaaagttcaatactgtatcgtggtattgaatttttgatcgtctgtttgaagaaggtgtatcaattgagtaatatataaataaaattattctgttctttaatatttcgttggaattacgattacaattattggtgaccattcatctgtaacgacaaagtatgtgtaacatgtattttttagcgaatgtattgaatatagaaatttctgatgagtcaaaacaatttccgattgttgttgacctactgaatgggaatcctatttgcttatcataaaaagttaaatcatttagaggaaaatcttcaaatgatagcttgaaaaactgaaaaaaactactaaaaactaaccatcataaatcctttatgaattaaatatggtttttttttaaacagcatttatgggttatatagaatagaaattcattgtatacatcatctgcaagaagaaaaataaaccaatgattgacccacaacaacttttaaaaaagttaattttaataacatatgactcatataatgctttagaaaacgaagtacaatttctagtataaatttttatttatgaaaaaaaaattatgaatatcatttttatttgctatatttctattattctctttgtcttttgtatcgtaacttacatattgattgataaataaccgtcgatattatcggccataatagctatttattcttggcattttttgaaaaaccaaaacgattaaattttttcacaaatgcaaaaattgacacttccaaagcaatgtgataaagaataaaacaacttgacatttgcaattttttggatagtactacatagttacgatcgaaaattttgaaaatattattagtgttcattgataatgcaatgtttacactaaattctcattaaaaaaaaaaacagcgcacgtttaatttcgttgacgctttgatgtttaaacggttttgatcggtaaattgaagaaaaaaatgaaatcaaaaatcattcacttaacaagagaggctctatatcaacttcttgcgcttttactagcaataacgtattatttcctttctaagatagaatttgatttttcaaatatatttttcaatggttttgatttacacaatatatatcaagaaattaaagggctaaacattttgaatgacttcattttatacatttcagccataatcgtcaatgtttctattcgatttttagttgacgatgcatttacatccacattattatcgcctcttatctttttagacaagaactttactgattttcttcatacaaaatcaagtgtatttgttttaatgtctatatttttatcaattcccttttctattgaattatcattttatcgaagaaaccatctgagctttttaattccatttttcttctcaattatcatctgcagcttttccataaagtcaaaaactccatcagttatgccatatatctttcttggaattaatttaataaaattcatgtttggtccaacgcccacagtacctcacaaaacattacttcttttatcacagctatttattactttaatatttttctctataattcccagatttctttcacgattacacgaacgcattctttgtgatggcattgatattgccaatgacatagtcacacgcaaacgaattgggcttctctttgattactatgcgtatggagataacatccgtctgttttttgtgatgttattatttgttttaatatcaataaacaataaacattcgcacgttgcgtcgtttgtgtacgcagctgttgcatcacttgtttgcccacaatgtacaaatggtgtacgaacacaggaaataattatattccatttgaaggcgtacatgtttttggcactgtgcgtacaattagcggaaacaagaagcaaaagagaaatagtggcaatgtgtgtgatggcattagtggaaagtaacccacgaattggagaagtggaaaggaaaatattctaatgagtgtataaataaaattgatttttgtgtcaaccagctcacctcatgtttttttgttcattacaaagtttttttctcattttttctcttctttttttctttttacatctctttttcttttgtttttttcctaatttttcttatttaatttttttctttttcaaatgattaacctaatgacatgtttacctcataaatttaatattaattgaatcaattatacctcatgaaatcccgacacaatgtgtcattttttttttttttttggaataccttcaatttattcaatgtctttaatcgatagtttgtgtatcttttaatagctattagctaatggacaatttataaatatttttcaaaatagtttactatgcacacctcaaagggggaaacggtttatttcccctttttacccataattttcaatacattataatcgtcatcaataattgtctcctttttttaaatgtcatcttccccttctactccttttgaagcacagaacgagcgaaagatattggagataactaaaacattagaaaagtaaatgaaatataaaatttatttgagaaaatatgtcacctgtgtaaaatatataatcatgtaaattacaaagtttttgtttgttcatttgaatttcaaattttatgattttgcatggtatcgggtttcgacagagacaaaaatgatatcaatttaaaaaattgataattttatgtaaggtgataaattaccgaatttaaatgatttttattagatgccttgaaaaattagtattattattaacatatttgtttataaatttggatgcatctaaaaagcaccttagataattcatctttttctgaaaaatggccctaaggattttcctcatacgaagaaactaaaaaatatagggatctttaaaagtaaaacaagtccattcacaaaaaatcctaagattcaatccatcaaaatgtttaaaacaaataggaatggattttttctttaaaattaaattttaaaacaatcgcctcaatttatgataaaaataatattacaaatatgtaaaacatagattttttgattaaagcattatttaaattttatgtaaaaaaatcaattatgacaaatttcggaggacaattatatgtattctatgtcagttgatggtacagttacaagacttgaaattgttgaaaatggaggcattgaagaactttatcaaatgttcttgggttcaattaagaaagaaaatggttttatagttgtttatagcttggaatatcgctcatctttcatggatgctaaaagacgttgcagtgatattttgaaaatccaaaatcgtgttaatgtgccaataatcatatgtgctaatttttctgatacccaagataagagacgtgttattaccagacgagaaggcgaggaacttgcggtaatattcaatgcaaaatactttgaaacttcagcaaggttaaacactggcatcactgaaacattttctgaaatggtcagaatgctgagagagatggtgcctgttgagacaaaacaaaacattgaaacggagcaaacctcggaaaaaaagaattgcattgtgtattaaaagatttatgtttagaattttaggtaaattcttctttgatgcctaacaaagcacattaacaattgcaaatatgttactgagtgatttaaaaaaaatttaagcttgggaactcatcaaatttttaaggcaaaatttcatcatccatcgatctacatttgttttacacgaataaaaattagagtagctgagtgtcggcatttgttttatacaaataaaaattagagtagctgagtgttacatttgttttatacaaataaaaataagggtagctgagtgtcggcatttgttttatacaaataaaaattagagtagctgagtgttacatttgttttatacaaataaaaattagagtagctgagtgttgacatatatttttaaatttctctaaataaaaacatatatagtaacatctaaatcatatagatatattaatccaactttacactattaatttcataattcacattttttattctttgccatttcctctaacagatctgcaacttcaacaagtgacttcattacgtacgttggtttgtctctttcttctgccctttccgcgtcctcgacagtgtccacaccggtcagcacaagcactgaccttgctccatgacgcgccgcaaacgcaacgtctgtcactatgcggtcgccgaccatcatcacatcatccttagagacgcagagagtgttgagcactgtttcgaacattgcgtcttccggtttaccaatgacaatagcgcgtttatgcgacgcggcttcgaatgttcgaaccatagagccgctgccaggaatgaggacattgtgcggcattgggaaattaggatctggattagtaccaataagtggacaattataacgcttgatgatgttcatgccacgtgcgatctcttcaaatgtacatgtgtctgatttggaaactacaacagcatcaactggaatgatatcagaatctgtttcaacattgtgaacttcaacaccatgaagacctagctcttccataagacctggaaaacctgaaacaaagactttggtgatgttatgtgaatttaaatatttggctgtcgcaaatcctgatgaaaaaatatcatcaacagtaaaaccttctaatcctatgttttccataaatgatagatacttggaacgggtttttgaactattatttgttactaaaacaagacgaattccaagtttacgaatacggttaagtgaatcaatagcaccttttattggagtaccatctatccaaataactccatcaccatcaagaagtaaaacttttggaggattcattgtgttttatgtgaataaaattaattgaaacagagtttgtgaattttgttgaataccgacatttgaaatgaaaaatcagacatggaaaaatggaaaaaactaacgaatttttataaatatttagaaaaaacagaacaggaacttacagacaaaatttacaatgttcaaatagaagttaaaaatatgcaagaaattttggataaaatctcaccaaatcctgtttctgaaccaaaagaagaagctcgacctcaaagatttcaaaatcgcaaagtgtttcgtggatttgattacaaagtaacaccacaagttgcacaaagatcattggatccttacaatgaatttcttgatgctttagaggaatataaaaaaataccgaatacaaatcgtagccagttgtcacttagatttgctaaacgtgttatggacttttctagaatgacacctgctcatatgcaccaaagattaattccatgcatcaaaagacttgacaaagaactcgataaaatattaaactatgacacagaaaaaccaaatttaaggtttagagcaaaatatacaacagaaaaagcaattcaaacggttcatcaatatgaagatctgataaaagaacttggacttcttcggaaaacaagcgtaatatcatgtgaaatggagctaagtaatactaaaaatactgaagagaaacctaaaaaagtaaaaacagattctcaatatgaagtcattgcaaacttcacaccgagacaactaaactctttgtacgcacttcgtggtaacgcacgtagatcattggttgatgcatcaattaaggaaaaggcgcaaaacgtttttttcggtttttttgatgaagttaaaaatgatatatatgaaagcgatgaactcgtaattgatgtacttcgtgctgcgcaaagatcattcattatactttctaatgatcagcgttcatatgctattgttcaaggaagataaaatttcgataaatgtttttgttcgtaatttttattatttaatgattggtttcacgttgtattaattaaacaagaaatatgaaatttggatcaaaacaaaaaatcattacaacgatgcacataaagtatttaaaatgtggatgtaaaccatttaatattcattttactctttacaacgaatattccttatttcatcgacatcaagaaattgaatgcagatgaataatctttgttggttgaaaagtaaacttctctaacaattccttcttcaatgtttgttgctctaaccagtttttgtatttgatcgttatcattgccaccataatttggtgtatgaggcggtggtggaggcggtggcggtggacgtgatggaggtgaccttggtggattaaagttaccggatagaatacattctatagctgcatcaaggtttcctccacaaatttcaagagctttagccgcatcttcaggagagaatcccatgttaaccaacgcattaatgttaggatcacgtggttttgcagcagatggaggtggaactttgctgggtgattttgagttttgatttgtttttcgcttgttttcttttggtaaaggtagtaacactctaacagcaataaagtcgccttctttcatatgtagagatgaaataatgacatcatctgataattcatagcttcgaagatataacttaatttcgaaatctcctttaacaccaagttcccttcgaactctgaattttgtttgttcgactggttcatttccaattggtagatcaaaattttctcctgtcgctttcttgaatgtgattgttgacattttattaacagatttttgaccgtttaaaatccacgaacaataattattgcacttttttataaatgatgaaacaaagagataaaacaaaaatgaacaattgggaaacaattcagtatattcaaaaaataatattttcattaaataaagaaaatattgtccaatcaactctttcaatatttgatatatttgataataattaccagtattcattgaacttacttattagtcaaatcatttattcatcatttgtagcaggtatgaatgatttagaagtctatatgaatttcattatagaaataaaaaaatttgaggataaaaaacaaattcaaagtaaagtacataaagtttttttacaaatgattttaaatatacattctcaagaatcaaattattttcttgagagaatgattcaagaaaatttatgcgaatcaaaattagttgaacaggcaagagaagagccatattttatacattacatgtccaaaaaatttctagaaaaaaaagaatatttgaaacgaaatatagtaaacattgaaaaactttcaaagaatgattgggaaattcataagaaacttattaaagaaggacataatcctaatgaaatttcgaaaataattcgaaatgatgaaatagaaaaacttcaagaaatgtcatcacaaagtgatttcaattttaacaaatgcattgcacaatcactttatgaaaaatattcttttataaatgtaaagagggttaaattaattgattatgcagcattttttggttcagttaaatgttttaaatatttacttatgaatggtgctaaagtaaataacacaggtaaatatgcagttgcaggtggaaatattgaaatcattcatttatgtgagcaaaatcattcaacatttgaaggcgcatgtgaagctgcaattatgtttcatcgaaatgatatctttaaatatttttatgataagaaattaaaaaagaaaaaaataaatttagaagaattaggaaaactttgtatttcatctcataattatgaaatttttatatttttacaaaaagaagggatgataatttgtgaaaacattattaatgaagcagcaagaattggaaacatatttatcattaaacattttcttgaaagtaatcaaattccgaaagatatattaatattttcatcagagtcaggaaatattgaacttgttaaatatattttaatacaagaaggaattgatattaatgctaaaaatgaaatttatttaaataattttatatttgaaaataatatttggaaattaattaaattactttatacagcacttattttagcatcttcaaatggttatatagaaatagtaaaattacttcttgaacaagaaggaattgatattaatgctaaagatattatttattttaataattttatatttcaaaacgacatacggaaattatttaaattatttgaaacagcacttatgtatgcatctagaaatggtcatacagaaacagttaaattacttcttgaacaagaaggaattgatattaatgctaaaaatatttatatgttttgtttaaaatttattttaataattttggatttcgaaataatatttggaaattatttaaattatttaatatagcacttattttagcatctagaaatggtcatacagaaatagttaaattacttcttgaacaaaaaggaattgatattaatgctaaagatattatttattttaataatttgatatttcaaaataatatttggaaattgtttaaattatttaaagccgctctaatgtttgcttctgaaaatggtcacattagaaatagtaaagatattacttgaacaagaaggaattgatataaatgctaaagatgtttatgtataaagcttaatgtttatccaatttttttttggattttaatattatatttgaaaattatataaagtacagcatacatgtatgcaaaaaaaaaatgaatttaccgaaataattaaaatgtttcgtaaaaaagaaggaatacaagatgagataacagatgaagcaaatgatcaaatggaattctttccattttggtaaagaattgttatcattctaaaaccttattgaacaaatccattcaaagtagaaaaagaaaaaaatttaatcctaagtagatcttgccatatagcatgacaattatatatatatatttttacatgttataaatttcctaaaacatttttcattaatccgtttaaatcagatttcaatgtaaaatatttcatatttgtacaaaagatgcaatttaacgaaaacatcacatttaaaatgagctttttttaaaaccttcaaatggattggatcaactccatttctcgtttttttttagatctccaaatcaggatcctgattctagtggaaagcaaatattattgccatcaataacaattactattacgtttgatacaaatataacatatagtagttataaaatcattaacatgtcatttaagttaatgatagcgaaaaacatatagtcctgatgaataacatacagattagttttagatcaatatattttgagatcataatcgattttaaaaattatggacaacttttattaaatattgaatttcttaaaaaggacattttaacctcaatctgctttgctttcacagtaacataacctgttcacaacaatgaagtaagatttaccttttgaaaagaatttgtttctgatgttaacatatgttcaagaaaaggagaaatttccaaactcagagatatgcttgactcaaatgatagtcacccgcgaaagatagcggctaataaagttgtttcattaatgagcggtggtatcccatcattcaaatagtttgttccaatcttgaaaaaatcaaagattctcgagcgaaagcagctgccatatggatgcttgatgagtacaacaccatcataaagaacgttgatgttttattagaatcatttcaagatgaatccagaagttaaattaaaaattttaacagcttgagtcaaagtttatgtacgtaatcccgaacaatcgcacgaccaactttaatttgctcagtcagcgcaatgccatatgcagaatgatttactggcggttattatcgaccgttgaaaattcgttatcggcgctgaccgttaacttcatgatcagaaagtgccaaaacacatgatccagcaattttagaatgggaagtatttccggtgtattacatgtaaccacagctaattctgctcgacgtatcaaatatttacttgatgaagattccataattggtcacctgtaaacttattagaagatctcctaataatcttcatgattttggtatagcttttaataaaaattgggcgggcattacattaaaagaatgaccatattttccagaatcttttaattttgtgttcgatgtggccgtttaggtcttaaagagaccgtttaaaataacggagaacgttaagtgttaatagttgaccgttaaaaatgaaaacaataaaaatcaaaatgattacaaaaatattttttgtataagatatgtcaataaatcttgtaaaaaaatcctggcttcttgttgaaattcaaggaatcatccaacttgaattctttctaatggaattaagatatcttaattaagaagaaaaagaaatttaaaaataaaatttctcattttgaaggaaatgttttttttctccatgaacacccaaagtgttctctttttaaattttaaaatgatcatttttaactgtgaaaaattgagttgagatatataatgcgaattctgcaaaacaagggccattataaaatatctctcagtatataagatgagccgagaaacaagataaattacatccatgcttcaaaaagtattcacttcaaaaaagtcattcaatttctatcgtcattcgcttttgatagtgaatattcaattcatttcatttgacagctctgaaaaagtaaaactgcagtttcagatgaaggaagaaacagtccggaaaatccaagaagtactcctatggcgtcgtccagctgctttagctattctttttgttcttactgaaataacattttatttggtttatgcaatgaaacttgattttggtgcgactttaatgttgattttaattagatacaacataattaaaatagtaatgggatcactagataaagttctgtttgctccacttccagaagataaacctgatcaaccaaatagaatccgaacaaatgatgaagttaaggaaatcacagataaagttaaagaaaaaattgctgtagtaaccaattggcttgatgattacatgaaaaatccgaccaatcaaaaacatttcattttctttagtatcgcatttatagcctttgcccttttcacaatgatggggtcatactgggtttgctttatagtaatacactcatgtcttatcattcctggactttatttatcatcttttcttcaaaatttaatccataaggatcaaaacaaaggcaatgtaagcaaagatgaaaaggttaaaaccgaataaatcattaaccttatgtaattttttttcttcaacaaatttatcttttaatgaaacttagtttacatataaatcattgattccaatgaaaaggaaaacaattgtattgttaagcataaatgctaaaatgtatccaaacatttctgaaccaggaaaagaattttggtgaagtaattcgaaaaaacgttaatttctgaaactttaaataactcattgaaaatattccgatgaaaagccgatcaaaattccgggtaaagcgcaataaaatcagtctggatggcaaagtcgatcaaatacaccagcaaaacaatatcaaatctaactgtaagcaatccttcattttatcaaattggtgcattacctcaaaatcaaacgattaaaagtaaagttcatcgagttatcccaagtataaatacaaaacctgaagaaaccacaccaccgccaccagagagtaacattcttattgttgattccaaatattcacctccaccattgattaacattgataaattttcaaaagaaccttttgatggttctaaatcttttaagcgtggacgtaacgtgccaaagtttagcacatttctagaagacgataattcagttttaactgaatttttatttgaaccaattccaaaaaatcgatatcctcatgttcatatatcagaacataataatgattcaaatcatagttttacaatagttccaccaaatgttccaccagctaaaatcgtgaaggcgaaaagttcacaaagaaaacccaaaatcaataaagtacagcaatcacaaataaatacatatgctcctcctggacaaatctcaaacttctcaaacatggacatgcaaatgatggcgcatttcttcggcatgagcacatctgaactgaagcgcgcaatatcgaacaaaaatgcacgcgttgctgctacgaatggatacatgcctggcttcatgccacagaatcattttatgggaccaatgtagtattgtgtgaaaaatgattcgatgtaataaatatacaaaaaaatgttttttgttatgtaattgttaaaacaatccaactattaaatgatcttttattcataaattgcttttgttttgaaaaatcatatgtaaaaaacatcgaacgacatgtgatgtgaaatatagctcaacacttccttaaaaaaataaattcgttctatcatgataacattagtaccaacatttgatccaaaacttcaaaaccaaacaaaattatctgaaatcagtgatgaagaattcaacaaaggtattattccaaccaagtccacaaccaaagatcgaatcatacaagttatattatttattttaggttttggttggcttcgttttcttcttcttataggtgttactattctttatgccattttagttattccgtctgttatttttcataaatttcccttcattctcaactttggtattaatctatcacgtgtatatttccgtgttgccttctttttacttggtctttcatggcttacatttaaagggaagcttgatcccaaagccaaatgtattcttttcaatcatcaaacagtacttgatggtccacttatctacatactcaaaccctttacagtccttggtatggcggagcttaagaaggcctttttgattggtaatattctcacagctaatggcacagtatttgttgatcgttccaagcacgaaggcgcatcgcagaaaatcacagagtacttagagagcgacacgcagcgcccaatggttcttgcacctgagggcaagacaacgaagggacaattcctcctccagttccgcactggttcattcattgcacatgcgccaatacaatgcgcaacaattcgctaccgacagttcttcgcgtacggaggcgcaggcatcgtgtgggcagtcggcggattcaaagaatggctgtggcgaatactgtgtctcccaatgttcactgtcgaaatcgaattcttaccgctgatggatggcgaggaattcttgaagaaaacgccacaagaaaaagcactcgaatgcaatttgttgatggcaaacaaactcggcgtgagggcaacgaatagatcgtcacgaaatatgttcaagaataagaaagagtaaacatgaaacttttaaactttttaagcgtgaaattataaaaatgataatttatatgatattgtttccttcattcgctgttaagtttttatacagcttcttgtgttttttattgattcttgaatagcatttgtatattcttcttcttgtggtgttttaatttggaaacaattatttttggtgaaaatgtagcagaaatttacgattcagcattttctttatgctcatcattaaaaaatattacaaattaaatggtagttatgcatttgcgattcgttataatttaacaatattaacacttggctctggtttaacagctattggtgattctgcatttggaagttgtgagaatcttcaatgtaattatttttatggatatttatcaccagaattgatgtaaatgcaatttttttatgttacaatacaggttataatattatttaacatatcaaagtaatacatttgaaaatatgcctgttgtcagtgaatataataaaggaatctgcaaaccaatttcaacattttctttttctcaatcaaatacattctcacataggaaaaactttttctatgtcaaatacatgtagtcaatcaaattcattttcttaatcaaattctttttctgtatcacaacataatgacttaactaaatctttttcatatttattaacatacattttatcaaagaagataagtttattgaacaaatataattatactcaaatattttaaacagcacttatgaaggcatctgaaaatggctttttaccaatagttgaaggacttcttgataatgaaaatattgatattaatgttatagataatgttaatttaaataacacgatgctatttggaaataattttaattgtttaacacagctctttcccttacattaaaaaattcatataccaacatcgcggatttaattggtaagaaatctcctgcgaaatgtatttgttattaataaaaaactattgataattatatagaaatgttatgaaattgaaaacatctttttcttttctctaatattttctttttagtatacatgagatttttagtttataaaattgactttttttggcggttttccattttatttttttcaaatgggagtaaatcaaagtcagattcacacagagagatatgaaagaaacttcgaaatattaataagccttgaacaaattatttttgatttaaatgaagataatattattatatcagtagaaaattctttgaaatattatcctgaagattttccatatacatttaattttattatatgtcgaattttatacgcatattttaaatcaaaaaataattataaaataatatttaaatatttgagtgaattagaaatgaaagaaaaagattttttaaataataaaattactgaaatttttgttcaatttcttttatctatatatgaacaagaagcaaattatcttcttgaaaaaatgattgaaaataaaataattgaatcaaaaattattaaaaataaaatcaggctttattttatgcattatatttctaaaaaatcattatataaacttcataaattccgattttttaaatatataattgaaaattacaatgagctttcaaagaatgattttaaactacataaaaaattaattaaaaaaggaattaatccaaatgaaatatcaaaaacaattccacgtgatgaaatagaaaaacttcaagaaatattatcacaaacaaattttgattttaaccaagaaattgaaccatcactatatgaaagatttacatttattaatcaagaaaaggttacattaattgattatgcagcattttttggatcagttaaatgttttaaatatttacttatgaatggttcaaaattagaaaatgcaggtaaatatgcagttgcaggtggaaatgaagaaatcattcatttatgtgaacacaatcattcatcatttaaaggtgcatatgaagcagcaattgaatttcatcgaaatgatatttttcattatctttatgaaagtaaaattgaagaaattaataatttagaaaaattaggagaaaaatgtattttttatgataactatgagattctttcatttttattaaaaaaattgttacttaaaatcaatgattcgattattcatcaatcaatagaaacatctaatttatttttagctaaatattttctaaagaaaagtcaacttccaaaaatttgtttgccattttcttttatttttggaaatgtggaacttgtaaaatattttttagaaaaaaaagaagttgatattaatgccaaagatattaatttgttttatttaatatttttctttataatttgaattttcaaaacaatgtttggaattaatatattttatttaatacagcacttatttgggcatctgaaaaaggttatacagaaattgttaaattacttcttgaacaaaaaggaattgatattaatatcaaaaattaatattttttttaatttgatatttgttaaaatgatctaaaaattcaaaataatatttggaaattatttaaattaattcaaacagcacttatgtttgcatcttattatggaaataaaaaaattgttgaattacttcttgaacaagaaggaattgatattaatatcaaagattaatatttttttaatttgatatttgttaaaatgatctaaaaattcaaaataatatttggaaattagataaattatttaatacagcacttatgtttgcatctttatgtggaaataaaaaaattgttgaattacttcttgaacaagaaggaattgatattaatatcaaagattaatatttttttaatttgatatttgttaaaatgatctaaaaattcaaaataatatttggaaattagataaattatttaatacagcgattatgattgtatctttatatggtcacgaaaaagtgttcaaaattcttcttaagcaaaaaggtattaatataaatgataaaaatatttttttatttatattaatgtgtattaaaatattttaaaaacttaaaataatatttggaaattattttgagtttttaatacaattcttatgatagcatcaaaattttgtttgataaaattagttaaattacttcttgaacaaaaaggaattgatattaatgctaaaaatattaatttgctttattttatatttattttaataatttcatatttcaaaataataattggaaattatttaaattatttctgacagcacttattagagcatctgaaaatggtcatatagaaatagttaaaatacttcttaaacaaaatggaattgaaattaatactaaaaatatttatttgttttattaaaattttattataataatttgatatttcaaaataataattggaaattatttaaattatttaaaacagcacttatatttgcatcttggaatggttatccagaaatagttcaattacttcttgaacaaaaaggtattgatattaatgctaaaggttttatgtttgttttatatagattttattttaataatttattgttgaaaaataatatttggaaattattcaaattatttgacacagcacttatgtgggcttcttttaaaggacatatagcaatcataaaaatgcttcttgaacaaaaaggaattgatattaatgctaaaagtatttatttgttttaattaaaatttattttaataatttgatatttcgaaataatatttggaaattatttaaattattcaatacaacatttatgattgcatctttatgtggaaatgtagaattgatcaatctgcttcttggacaaaaagaaattgatataaatgctcaagatatacatttaaatgttttgaaatttttattaacattttgatatttcataaaaatatttggaaattattgaagttatttaaaacagcaataatgaaagtatacgatttaggccatagagatatagttaaattccttcttgaacaagaaggaattgatattaatgcaaaagatatttgtttgttttatttaaaatttattttaacattttgataattcaaaacaatatttggtaattatttcaaatatttataacaatacttataagagcatctgaaaaaggtcacagtgaaatagttaaattacttcttgaacaaaaaggaatcgatattaatgctaaagataatattattgtttatttttattgtttatatgtaaaatctaatgttttaacataatgtttggcaattacttcaattattttttacagcacttatatgggcatcttgtaaaggttatacagaaatagttaaattgcttcttaaacaaaaagggattgatattaatgctaaagattttttttattattaattaaaatcaatatttaaaacattgggttctaaaatatgatttgcattatatttatattgtatcaaacagcacttatttgggcatcatatcaaaatatgaacgaaatagtcatattacttcttgaacaagaaggaatcgatattaatgctcaaaacatattttattttaataatttgataattataaataacacatggaaatattttaaataatttataacagccataatttgtgcatttattaatttccatgcagaaattgttaaattacttttggcacaaaaggaaattatttttaatgttgaaagtaattcttcatataaattgaagattattttccttgtttcagatttcaaataaataattggtatatatttaaaaaaatgaaagcagcatttttgattgcagctatgaatggttacacagaaattattaaattattttttgaaaataaaggaataaatattaacgcaaaagatatttattaattctatttcagatttattcaaatatttcaaattttcaaaataatatttggaaattatataaaaaatttgaaacagcacttatgagagcatctttaggtgaccatatagatatagttaaattacttcttgaacaagaaggaattgatataaatgctaaagatataatttattataataatttaaaatatcaatttattttttggaacttgtttaatttatttagaacagctcttatgaaagcatctaaatataatcgaactgaaattgttaaattacttcttgaacaagaaggaattgatgtaaatactaaagatatttatttactttatttaatctttattttaatgatttaaaatatcattttatcttttggaaatcgtttaattcatttaaaactgcacttatgaaagcttatacttttggacaattagaaacaataaatttacttcaggaaagacaaggaaaagatagttaacattctgcttttaactctatcgataaataaaaatgtatcaaatcaacatatgctctcatgctttttacaacatagtgcttttttatgattaatctttgtgttataacaccactttacaacaatttacattagcttttgaattttaaagatatagcaacttgtaattattttattaatttgaacaaacaaaacgtattgaatgatgaaaccaaagcataaaaacttaaaaatgaactaaattctgattgaaacttcttaattcgaatatccttatagaaaaataatttgaaaaattttcgtaattcatttgcttttaatctccatgaatgataccaaatgttttgatcattagcattaccaaattttatatttcataccaaaacattcatcaattaaaacatttcaacactttatcgatatttatttacataattaattgattcattttacacattttcagcatctatagtctgttctcgcagccttccattgtatcacggtattatcatgcgacgccgttatgatccattcaccggagtaattgaacgcgcagctcattatttggttcgtgtgccccttcagctgctccagctcgagccccgtcgccaagtcccacagtcggcacgtcgcgtcgtccgatgcggtcagcagcttcgagcactgcggcgagaacatcacgcgcgtcacctcgtcgctgtgcccttcgaacgtgaacagttcgtcgccgctttgcgtccacaccttcgcagtgtggtccgcggagcacgtcgcgatgcgccgcccgtccggcgaccagcacgcgtcaagcacagcgtcgcgatggccctcgagcacgcgcgtcgtgcggccgctccggatgtcccatatccgcgcagtgccgtcggtcgatgctgtcaatgcatgctcgcacggccagtcgaagtgagccgtgctgacctcagagctgtgccctataagagaaaagagctcggagccgctccggacgtcccatagtttggcggtggagtcaaatgagctcgtcatgaggatgtggtcgtcgttggtaaactcgacatgcgtgacctcagcaacgtgcccgcgaagtgtgagaagacattgcccactttcgacatcccagatgcgagatgtgcgatctaatgaggcagtggctaaatgttgtgaattatgatcaaaaactacttttactacttccccagtgtgtcctgtgagctcatgaagtgatgtaccactttcaacatcccaaatacgagaagtcttatcattggaacctgtggcaataagattgccaatggggttgttaaacgtgcagcaataaatggaattggtgtgcccagttaaaacatggagttttttgcctgtttcggtttcccagatgatacaagtacgatcgttagaagctgtgataaaaagttcgcccatcttattaaacgcacaatcagtaagcggcatctcatgagctttgtgaactcgcgcaagttcaaatgtattaaaatctatgccttgcatttttataactttctcaatcgatgaaacaagcgccttacggtgttttggtttaagaataggttcacttgccatgatttcgtcagcgagttcttcaacatctgtatcagaagaaattgattgtaaatcaataacactttcagaaaggtcatttccttgttgggtaataatagaaagagagggtggataaaatttgatgttgatttgcttcagtgtttttctcatttgggacttggaggtttttgcggttgaataccgtcactttttgctttatttcgcatctcattaatgaaattcctttatgggaagtcaaaaaacatttttggatttaaaaaaaaaagtatattcttcttttagatgaaaagtaaacataaaaaatattcacattgagtagagatgaagaaaaatttcaaatattttaataaaaataatagaaatagttttaatattttattcattattaatgtttatattatatgtgaaaattaaagttatcttcattgaaatctttcgcaaatggatcttcttcaatattattccttgaatattcaatagtaagatcattcatttctttcgatgtttcttcatcatattcagtttcttcttcttctttatttccttgtttttgattacgaattaagaatataataagaaatacaataacaagaataataattattattccaatcaatactccaataataatataaatatatgtttgatcatcattttgattttcattattttcattaataatataaaaattagaataaaatgtgaaatattgtgaataaataataactgtataatcataatatataaatgttcttgaaatatatataaatgttgaattgatattcgtcataataaatgaattaaaatatgaaatataaatacttaatgtttgtgtaaatgataaaatatatgttaaaataaatgaatgtgttaaatttatatatgatgaaaatgtatttgatttagtaaatttatctgtgaatgtacttgattgtgtaaatgtatttgttttagtaaatgtaagtgttggaggaagacatttctattagtttgttttttgttttcttcttctgctttataatgtgcaaaatataatgattgaatttttttagtgatatttaaatcaattaaattttgttcaatcatttgtgctatcacataataagattcttgtgtattgattccagatatatacttaataaaaattgatattagattaccgatattttgattcatttcttcttcttttttttgaagtgtttttaaaaaatttaagtaagctgaatataagcctttcaggttcaatcaattttggaatgggcatgattgaatgttcggaatttttataatttggggtttcaccgcagccatcaggcatttggtgcgagccttggactcatatcggtttattcaaaatcctatcgtaaaggcgtgtcggagatcacttttcacatcacaatttatactacatacacaaaagtgctactatttaccttgaactgtttgggtcaaccaactttccttattatagttttaattttggaattatttataatgtttcaagtatagcatctccttaagcccacaaaattcttaagctcaaaaagggatttccaaaaaatttgtaaagcggaaaaaacataggggttttttggcattataaatggtcgtatatagaattttgccattttgagcctcaaatatttgtatgtagaaattgtgggcccttataatttcttatagcattacacaaaaatgaatctggaatgtatgatattatattaaaattaagaacaaaaaatatttttcaattcgaagcatgattcattatctgacatataatgtacaaaatatgtaatgtttaaattttggctcaagtaaattgttctcaatcatattttcaagaagatatactgattcttttgttaaatttctaagaagaatattcatgacgaatacatctaacaatttcggtatgatattttttatctcttgcatttttgaaatttcttttataaaacccaaatatgcatcaaattcatttaattttattgtaaaaaatgatatatcattttactaactattatattaaaagataaagaataattgatatcaaataattcaaatattttatttgaagatcgggaaatattttgtttatttaaattaaaaacaatttgtttgatcaataaaattgtttcccatttgttgtgtgctctctgcatttttcctagatgaaagcaaaattattggtttcaaaggaagccatttggaatttgtcccatatgatacaaacgattatttcctaaaagtaattttattatttctatattattatttctaactgctatatgaagcactgtcccaaattattaaaacatattctaaattattaaaatgaatatattttgcattaacatcaattcctttatctaaaagtaattttactatttctatattattgtttctaactgctatatggagtgatgtttcagattattaatacatattacaaattattaaaacatattataaattattaaaacatatataaaataaattcttgttgcattaacatcaattcctttttgtctaaaacatatttcacaatttcaatatttcctgattctgatgcaaaaggtaaaatattttttggaatttgattattttgaaggaaatatttaacgagatacaattttccatttcttgctgattcatttatatcattaacattaacattaattcctttttcttctaaaaatgctaaaatttcataattatcttttttaatacaaaaacttatcaacatttgatgaaaaaatttcattaaaaccgttttacaagatgtaaaaaatcagcagcacttttcggtcagttttaagaaaaaattaattaaaattgattttttttttcaaaatttctccaaaatctctctattattttattttaaatatttttgacaatattttgatgttatttatttcaattgcaaattgcatgataacttcataatattatcatgctattttttaaatttataatatatatactaatgttatttatttaatgcaagagaattatatttaaatataaataataataagaaaaatatatttgaaaacaggtttttcatgttccaactttttaggtcttttctatgctttttgatcgtattttcttcttataaacatttttatctccaaatcaaataataatttactaaaataatatcgtagcatcaattggaattattatgttctttattatatttcaaaatcaattttcatgattttttgattttaaaatgaatagaactcaatattaactgaatataaatcaaaattattaaaaaatttaaatatattatataattttaaaaaatgttatgaagatatttttcaactctttaattaaaagtgaaattgattatttatcataaaaaaaattaaaattaaaataatttgatacctaacaaagagcattaattattatagatattttttgggtttacagattaaaattataaatgtgtatcgatttattaacaaaacaatattttttcagcggcaaccgtttacgaatcatggatttgatcgttttatattcaatttactggagtgcaaccttaataatcaggttcaaaaagtgcccaaccgaaaagtgacgttatcgttcatatcaaatgaatgatgtttgatcgtcttatctgtggcaattgaggagataattggttggatacgttcaaatgcaattcaaattttaactcaaaatccaagctttttgaatagtactttttgactcgcctcacaatttggtaatcgaatcgtaacggtttgaacgtttgcttgttcgctgtaaattttgctcaattttccatatcaaagaagatgacagctatttctctgaggtttatatgtgttcaaaatgatcaaattaaaaataaaaacagtagaaaaaatttgatttggaaattaatcaatgtgaagaaaaagtaaaaaagggaaaatgaagaatttgattaacgtttacgacttagtatccttgataacctgggtaacctggttgtggatagcctggttgaggatagcctggttgaggataacctggttgtggataaactggtggtggtggagcataaactggtggtggtggtggtggtggtggagctgggtaacctgggcggtacattgtatttggataagcgcctggataacctgcattgtatgttgtgtagccaaacctacgccttgatgaggatgatgaggaggatccgaagaatccatagcgtccgtgcttatagcgatactttggtgccattctcgaaaatgacaaaaccgtcgcattctcgaaattttcttttgtgttatttgaaacaaaccccaatttttctatgttttctataaaaccggaaaaaattcattggacgctcatctcaaaaaagccacgaaccgcctgaacaaatatacaaatttctcatttcgcaaaaaggttctcatcaattccgactatataaacgaatcaaagctttaattctttttaaagattattgagtcataaattttaaaacaaaacatttcaaatcactccataaaaaccgtcaagattttggcggttatgggtaaatattttagccttttgaaaaaatttaaaatcaagaaaaccaaataaatttattaatcaaaaccaaatctatagaagatgcgcaatcaaaggaatcggaactttcaaatttttctgtagagttaactttaaagttgtcacgaactggaaattattttcttttaattctatatgtaatttatatttttcttcttcttctttatctttcacaaacgcgaatctttggttatgtctttcaaagatttctttcatttcctgaaatgcctctttcatcactactgcaggaataaataagaaatacgaagaaggatattccgaaatcaacttatgtatcaagaacggcatttcacagaagtctgcgtaagtgaacacgaatattgaagaagacatattcaaaattttcggaaatgaatttggaagtacatctacgaaatcacaaaatgtatatttctttgcgtaatcattttgttcattatttaaagacaatgggaacggataacacaaagactttttacatttgtccactgttaatatcggattcatatttgagttacaaacatcgcaaaacaaattataaacattttcgatgattcgttgcgttggattatccatacattgacatgatacaactcttggaacgtttgtattacatactgaagtttttagaattaaatatgaaaaatatggacatgaaattgttaatgaatttggtaataagaaatcgaaaggaatcatttgtaagtctgcggaagtattaataatcactggatgagaaccagtgtttaatgtatataatgcgcctttattatttttattaaatatatgtgagttattaaatgataaatcatcaggataaacatcataaatgaaatctttaaaatcatcttcgaaaaatgtttgtgaaatattattaatttcatttatatattttgttttcagtttaattttctcttttaaatcgaaacttattaatttaataatataacgaattaaattcggagtaaataaattcgattgtgtattaaatgaaatcgaattcttttgacatatataattaacttgtttgattggatcctttgtgttaattaatgggattttccgtattttacctttcgatggtatataaatataaatgttttggaatattcgttgtataaatattaatccatttaatatcggatgcgcttgaattaaatatttaaatgatgtacatgaaggtatatatgacttacgttgataacgctctttctctgtttgtttctctatgtttccacatatggaacgatttcgattattcatttcttcttgtgtaattttcccttgtttataaagtcgaacatttgtatttattaatgaaagatattccggaatttttaatgaacgagtttcgagatattcatcaatgaaattataatcttctaaaatgtttatgaaagaagggaaacgtaaactttgaagatttaatatatgtttagagaaattaattgaaggttttattaagttgattgaatcgattttaatattttgtaatttatttttgattataattcggatatcattcattatatcaaatattaataaatgttcattaataaattctatttcatatgtgaaaagaattaatgacattctttgtaagatataaaacattaaatttaatgtttttaatgggaaatcatttgatattaaatgacaaccacaaacaaaaaacttaaagaagttattatatgaatattcgaataatttttttgattgttcatttttatttttttgtgtattaactatcgatgaaagtaattgtgaatatataatatataaaggattaaatattaatgatgacatactttcgatattagtgttcaaacgatttatatcttctttttgtatttctaaattaattggccattctgagatatttttatttggcacttcaattaatggttgataaggttctgcatgtaattctggatattctaataataaatctaacatgaataaattcgtacgaataagtttgttaattgattcaacacgttggaaacaaattttcgcggtagcaaatgatgaatatgtcatattaattatttcacctatagtatattttttattttcgattatattacctaaagttttattatcattttctataatttcgatttctccataacaattttttaatgttaaaaataatgaaatacctcttaataaaaatgcattacctaattcttttaatgaagagaaataacatcgttgaatatatacttcggaataaaatatcgatttcttatattgatatcgttctaaataagcaattgctaataatcgtaatgaagctactgaaggatcgaatttatttgctgttaatatcgaaaaatttgtagttaaacttacacgtgttttagggaattgatattgaggaatataattaaacatttcttggaaattattccgttttaaacattcccaagcacgaaaatatgaaataagtcttttcatttgtaatttatctgtattttcataagtgtttaataataatttttctgattgtacaaataaatttaatttacaaaatatgatagctaatgtaacacttgaaactatagttgtaactgagttttgatctggtgaaaagtttccacttttattttgagtttggaaatgatttaaaatttttggagttttaagtgaacctccaacagttgcagctaatgttaatcttcttcttttatttacttgtacgtcatacgatttatgtaataaatacattaatactgatgcagcttctgaataataaccttgttcaatatatatcgaagatactatttgtccgaaatatattgattcttccattgaattctttgcataaaaatattttaatgattgtgtataataaaataatgatcgaataatatcattattccgaaatgatatttgagctatttgtgatgaaaatgataattgtcgaatatctgttaagaaataattatccattacatctgcacaataataatatttattagttttatcaagcatttcaccaaaaaataataacgccgaatgtataaatattattcttttaaatactggaaatccatataataatatataaagtgcttcaaagataaatgaacatgaaagtttaggatttcgttctgagaaattgactgctaatgcaaatgcaatacgaaatgttatataaggtgaataattgtttttaagatattccgaaaataatattttcgaacgccatttttcattacatatttttgagtttttagtttttgttattggtatcgataaaactgaataaattaatggtgaacgtccattaataataaattcataatcacaaatatacattaattcttcaaacgtttcatttaaatcaacaattaattcgggatgattccgtttcttttgtaaatattcaacttcaatatcatcaattgaagtttcgataattttcgatttttcaattttatcgataattgtttctaatatttcttgtgtatgattttcatcattaatcgataatgaataatgtgcttcacgttcgatctttaacatatcagggaataattcgcaaggaatttcattattctttaaactattaatcacatgtaatatcggtaataataatgaataatattctttcggtacatttcgaggtaattgttgtattgataaacgtgattcagtcaatgattgatataaattaaaatatgttccaatgttttcccattttaatttacttttcttttgcttttttttgttctcattttcgataatacgtttttgtaaaattggcttcttcgtatatataatctctgatgtaatacttgtgttcgcactatgtataaacttcggagatgttggaatttcacatcgaatagataatatccatttctcaaattgtattggagacatttgattcgatccgtcttcaaataaatatgtgactgtttgtggtggctctggtaatgcgactggttcatatcgtggcgctgctgttacatcttcaaggacatcaccgatttcttcattagctatttctaatgttaatattggtgcacgttgttgtactgttccaagatctgcaaagaaatcatcagagaaatcatcctcgtcatcatcactatcatcttctggtattaaatttaatacttcttcgactttaggattgaaattactaaattttgtaatcgcggattgtaaaaaaggatgtcgtggaaactctataacaatgtctttacataatgaataaactagattttgtaacgtatagttggggaaaaaattggaaatcggtaatggatttggattctttaaaaagtcttcaatgctacaaacaagttgatagatggcgcattgtttgtcattgtcatcaattagcgcataatgaattaatgaaagaactcgcgaatcaagatctttcgaaatatatttcgtaagatttgcgtttttcttttctttgtaaaattttattaagtcaatttgagctaataaaatgtctgggagatctggatttgtaagataatgaataatggtattatatgctgcttgattattctgatcttcgacaaatgtcgttaatgcttttgataattcagtgggtactatgttttcaggtattaaacagatgttgtttgggtttggtggtgtttcaaaatcttctaacatatttgaaattgaagatatatttgataaaatttcattaaatgaagttacccttccaagatcttgttcaagttcttttggcacagtaaatgaagatggtgttactttggttgttaaaattaattctgaattatcatcatctgacattgaagaaaaaaaatcagataaatcatctcctgaatcaaagtcagttttaagacccagcaacactgtgtttcttgacattacattcatggctggttcttaaaatggacttttagtttgcaagaattttgacttttcaatcgacaacgatagaataggtttttcttttttggtggatgcctttcaattttaaagtttggcgaaaagacctttgggctttttcttggtataaaatatttcattaaattagtgccttatgagtgaatcccatgattttgataaaatgtttgtcaccaatataggaacttttcaaaaaagaataggaaatcattcgaaaaaaacatatcctcggtttttgcattttacttataataaatttcaaatattttaataaaaacaatagaaatagttttaatattttattcattagtaacctttatattaaatatgaaaattaaagttatcttcattgaaatctttcgcaaatggatcttcttcaatattattccttgaatattcaatagtaagatcattcatttctttcgatgtttcttcatcatattcagtttcttcttcttctttatttccttgtttttgattacgaattaagaatataataagaaatacaataacaagaataataattattattccaatcaatactccaataataatataaatatatgtttgatcatcattttgattttcattattttcattaataatataaaaattagaataaaatgtgaaatattgtgaataaataataactgtataatcataatatataaatgttcttgaaatatatataaatgttgaattgatatttgtaataataaatgaattaaaatatgaaatataaatacttaatgtttgtgtaaatgataaaatatatgttaaaataaatgaatgtgttaaatttatatatgatgaaaatgtatttgatttagtaaatgtacttgatttagaaaatgtttttgatttcgaaaatgtacttgatttcgaaaatgtatttgatttagaaaatgtatttgatttcgaaaatatatttgatttagtaaatgtatttgatatcgaaaatgtttttgattccgaaaatgtatttgattgtgtaaatgtatttgatttagtaaatgtatttgattgtgtaaatatatttgatttcgaaaatgtatttgtgaatgtattagaattagtaaatgtaagtgttggaggaagacattagtcaattgttcctttcgttatctttaattctccaaatccttcacttatatatgtttcattgaccataacatattctgttggaacatcaataaaacaatcacttccaattgatggtgaagtttcgccataaaaataaatacatttcagtgatgtacaatacacaaatgcttgatttccaatattttcaacactttcgccaatgataatcgtttctaattcataacagaatgaaaaagcactttgttgaatctctataacagtatttggaattatgaaattcgtaaatacacaacttgagaatgcagaactttttatcgtatttaaacttttcccaattgaaattgttattaaatttgtacataaattaaatgcatctgattcaattgaagtgactgaatctggaatgctgaatgtttccctgagatttccaataggataaataatgagtttcataatcaatttatcatataaaactccatcgttttcataattactataatatgaattatcttctgcaattttaataatttgaagactactacaataaagaaatggatttgttgatattgaagaaattgtacttgaaattgtaacatctttaagattaatacagttttgaaacataaaagatccaattgtttgaacaccttcacaaaaaattacactttcaagtttatcacatccattaaatacacttccactagctgctgcaagaggacttttaattgttacatattttaatgcagtgttttgaaatgcacttgatccaatacttgttataccttctccaaatgaaacttcttctaaattagaacacataaaaaatgcatataatccaattgaagtgactgagtctgcaatctctgctgtaagcaatgatgtccattcataaaaagcggaatctggaatttctgttattccacttgaaatgataatatattttgtattactttgataatcatttgtaaattcatttgaatccgttatagttaatgttgatgtatctgtatcaaaatgttgtatcgaatgagaaaaaaacaaaataaacaatatgaaaacaaatctgatgtttgctttacttttggttcgatgatttaatgtaaattttattaaaaaatttaggattttaataaatattaaaaaaagtaatgaaattaaagaaaaacaaaaacaaaaactcaaattggtttggaaagaaccagatagaatgagcaattgtaataaaaaatgaaataaatatttgttcattcggacttgatagattgacaatttttgtgaaataaaacttcgaaaatattgaaaattagataaattctgataaggaaatgtgtcattaatgtttaatattggataagtaaaagtaaagtcctgatccttcagattggaattttttatgttattatcaaacaaattaagatgattcatattaaagacatttcaagacttacgaatatggttggcgtttttgttcatgtaatgataaaaactttcgataaaaataatggaacaaagcttttcagacttcgaaagaaacgttccaacccaattcaattttgaggtttgtgagataatcaatttttctgggcgctggggtttgatcgccatcttatcgttgaaattggtgcagaactcacagattgaatacttatcgttgtcaattggccatggcagccgtcggttatattgtgtcgaaatagatcgttttttgttatagatattcatcagtatttgtagtttgaaccttttattcacaattgtttttgattattttatattttatatttttttttaaaaaacaaattaaacagaaattatattttattcaaacaaattgacgtttttttgtattgcttctatatcgtctgtttcagcagttgcatacataaaacccaattccaaattttcattctttcttattatttcacatgacatttttcttgattttggctcaccacaactcaatgccttcaacaactcattatttctttttaaaaaatacacaaacaacaaaaagcacaaaaaaaatcctttcgacaaacaagtcaaattattaatcaaaaaacaaaatgtactttcattagaattactaatttcagatgttttcatcaacaatttcatacattctactgatgtgttttctataaagaatgtacaaatttggtcatttatagcctttaatccattaacgtcgagtttttttcttgaaaaaagattacaaaatgatttaataacatcagaattcacaaatttaatagtaaacaattgattaataatttcaggattcgtattagaataatatcgaattgtaaccaaagacttataaaacgaaggaatattaacattatacaagaatgaaaaagcaaaattctgaaagaagaaagaaggaagtttcaaaatattattcgaattaaacaatgcgattatgagttcaatcattttttcggatattttaaaatcaaatgaaaacaatgccattcttttacataatgaaacacaacaatgttgcataacttcattatgaaaattattcgaaattaatgtcgttaaactttggattaatgcagaaagttgtgaaggtaattccgaatcacaaagttgaagaaattcttcggattttattattccgaaaatgtttttatttaaatatgttaataaaggtaaaaacaatgaaataaattttgtgttaattataaagttttgtataaatattaaaaattgttgattttgtattgtgtttgaaataattgatgaaattatatacgaaatttcttgatacattgaatcataagtagtatcaatgatcatatcaaaagatactgaaaacaatccaacgactgattgaagttcgaaattattttgttgtttcttaagtttatcaattataattaagataaaacgtaataataatgaacgctttttattgttatttaaactaatgtaatatgataaatgaattgcaattaattcatgtaataaaattggatcgaaattacttttcggaattaattttattatttctttatatatttttgattgaaatgtttgttgtttgattaaatgtttaaggaaataattcggagaatatttaattattcgttttattgttttgttttgatatatttcagttattaattcattggaaatttcttttccgatttgtttttcaataaatgttttgatttctgttggatattcttcaattgatttatatcttttaaagtattttaataactgataaaatattttgttattagtaaatatttcattattcaaaataactttttttgatatttttttgtttttattcgttgcatattttattgttaattccattaaatcaatgaaatttaatgaaaaacttaaaattttttcgaatgtttcttgtgaaatagaaactttcgaatatttcaaaaatgattttattaatgaaaaagattcataaaatttattattctttaagaaaggagaaattgtagaaattattaaaacattttccaaaatgttattattaaatttatattttaattctttaatttcttttttatatatttcatcgacgttaattttagagaatttttgtggatttttaatgatgaaattaataatttcatttacatcgaaataatctttattttttataatgaatttccaatgttgagcgtcaattttatataaatcatttaaatgaacaataattttatttttacgaagaaataaaactaattcatcattcatagtttcatcatctaaaggtatatcattaaaatcaacttcttttaaataattttttactttctcaatatattcacccccacattcatttgcataccttaaaaaagcaattccattaatattattaatatttatcattattgattgtgctataacagtacttaacttaaataataatactgatgcaatcttaggctcaaggtcttgtatcataattaatatcgaatttaatgcttgttcatgtttcatttgatcgacaagtataaaactataatataatagatctggatcattaatacttttctcaattagaattttttcaacaatttgatcaacattcgatggaatttcatatttagttttggataatatctgacaacatgttgtcacaacagaatctttagatgtagtattaaataaattggttacagtcttatataaagcttccgaattaatatgatatatttcatcaatttcaaacgctttctctaatgctaatttatcaaatattggtattaaattaatacaaagccaaaagaaacatgttttgtctttgatgaaattaagtggtaaagaacaaagaaatcgaaaacaatttcggatgggcgctaacactgtttcatgtccaaatgatggattagtaacaatgtcagtatcaacggaatctaaaagtgaatttgttaattggattcttagaacatttcctggaagacttatcgtcatgtgagtaaagctttcaaaattcgagatgacgaagccgatacagaaattctgaacttcgtctgtaaagcattcaattttaacgttcgacaaaaatgaacaaatgttcgaaacgacatttaaagaatcgaagaaaagtaaacattcgaaagcaattggtatgaacattgagaagtcgacatcaaaggtagccgataaaatcgataataattcgaattttctcgaaacgaaaaaatcatccatccaatcgcctttcaaaacataaaacagaaaattgcgtattgtatcataggaaacaatgtttttaattgcatctaaagcaacttgaaacaaacgaatgttcggagaaatagaaaattcaagtaattttttcgatgcgatattaaaataattcggaataaacttcgaacataaattacaatcaataacattaattaagttagctacagctatatcatggacccaattcgtgttttttttattaaggataaataacaatagtttaatatgataatcatttttacattcctttaaaaaactcggaaaacattttgtaaatgattcaattaatgaacaataaagatcatttgtcgaatccttaaaattataaaatatctctgagatttgatctggatcaatatttgatactcgatcaatataaaatgatgctaatgctattagttgagctgacttcattgaatctgattcaacttgcatttctaaaatatatgataatgacgtcggcaataacatccttaatcgcagaaaatgttgtgggtaatcattcctgagggaactaaatatccttttattgatttcttcatatttttcggtgttttttgcatatcgtaaaaattgaatgcagattagacaggacgattcaaattcactgaatcctggtgtaaccttctgaaattcgtgtaatgatgttgataaaaataattctttgccatcatcttcaaataaatcaaatattatgggatcttttaataatgtttgtcctagcgaaagtgttactgatgatgaattaagatcaaataatagtttttttaaatgtggaacaagtttgactttattgagtgaaataagtgatgaaactgatgacgtaaagtttgagtttgttcgttttgaacaacgtaataataaagtttcaagaagagtttgatggtaataaaatggaatgttatgcattaatggaataacttgtggtagatgcttcatataatcagtaagatcagagcggaaatatttatcaacattaacaacaattatgaatttttgtaataaaactggtgatataaaacgtgacagataaacaaatgtattaataataacaattggagaactggattcaacactagaaatcgcatttccaaacgcttttataaataataaaggcttaaatggtgtgatacataaaagaagagatccaagagtactacatgatataacgcgtacatttgcatctgaattttccgtataaaaaagaattgtttctatgatttttgtgaggtatgatagtccatctttttttgatgttttaataaaccatgatattgataaagattttctaaacttacctaaagcagaacaaatttctgatggcttggcttctatgccccctaattttatatcatgaagaaacttgaaacattttccttcatgagtcatcaaaggtgtaaaccaaataaacggtcactattaatcatttcggatttaatcgtttctgaaactttacagaaatacctcaaccaaaaaacattttttcccccttcttttttcattccatactgaagtacttcatgaattatataataattcagatttcaaattaaaaaattttattaacacatgaattataatttctgattgatttcttataaaaatttattatttccagtcattcatgattaatttatgatggattttattttatattgatttgagcatctgaaacctacgaggaaaaaaaattcattcaaattttttatgaaaaatttcgggcaatcattctttgctacagacaaaccttgtcaattttagtagcaaaaaaataatttagatgtcattttgctgtaattaaatttgttaggtaaaaaatagatggagcaaaacgtcagattttgatggaaaaattatgatataagaagataacaaaatcagataaattataaattatttatgtcattattatattcctataacaaatttcgaaatttaatgtcattcaaaccatatcaaaatttgcttctcatattggccaaatacaacttatttaataaaaaaaactttttttatttaattttaagaaagaattataagatcaaattctcaatttaagaatttttttatcattctcgtggacatattaataattttgactgtaattgatataatttatttaagtaacatgcattttattataaatatttaactatttcacgaatttgaacaaaagatttcttcagacaccttccaaatggttatttttgtactttatacaaaatttgaatattatcggaattggtctgaggttgtgtaattgatcaattaaataagtgctgttttaaataatataaataatttccaaatattattttgaaatataaaattattaaaataaatttcaaataaaacaaataaatatctttagcattaatatcaattccttcttgttttaaaacgtattcaacaagttcaatatttcttgatcctgctgaaagtacttgtgtatcatgcggaattgaatgctctttaagaaaatattcaactaaaaaaatacagttagggatcaaaacgtgtcccagtaatgaaagtggtcccatacgttaaaatacgttaataaataatctttaataaaacctcatttttctcaatgtcaacattaacaccagcaatgttactagatgaaattaaacaaaaattagatactatcggtatttctctaagatttactcgattattattaaggaattctcactttatgaacttataatatgaaaatcatcagctatgttttctctacaaaaaatgcatctgaattcgatgatgttattttcacttttaatcaactagcattcttctttaatatgtgcagtaaaactgtatctagaagtatttcaaacggcccacaagatccaaaacctttaggtcgacatagagcattagatgaagataaagaagaaataattgttcaagcaattattgattcatctaatgaaggtcatgcaatgacccaaaggcagatattagtttttatcaaagaaaaattcgatttatctttaacaaagggatggataaatcgattttatcttagaaatataaataaaatcaaaaaatgtagatcacatcctcaagaagacacaagaatgacagtttatagagagcatttaagagaacacttccaatacatgaataaacatgtggatggaaggttaacagaattagtttttaatttagatgatataggaacttcatcttgggaagattgaaaatcgaagaaagtctttgttgatgctaaaattaactcaaacaatgttcatcattattcaacaagaaaagtaactcatatgacactccttacatgtgtttcagcagcaggtgatgctcttactcccatgttaataaccaaacacttatataatgatgatttatgaagatgtaatgatctgtattcgaaatccaccttacgttgattctgagttatctaatgaatatattaatgatgtattgattccatatgtcaaatgtgtagaagaaaaatatgaagttgaagagtatgtagcaattttattaatggattcatttggtgcgcattgtaacgttgatattataaaagttctaggagaaaataaaataattgtcttatgtttttcttcccataccacaaacattttccaagcccttgatttgtcattatttggcgtttttaaaaaaatcaaaaatactgttgaagatgaagaaagccaagaaatggtagaaaatgcaattattgtcatattaatggcatacgagcagaccacaacatcatttgacattcgtggggctttcagatatgcaggaataagtactaaaactgttgctggtaagagagttgttgaatttgttgccaaagagctgctttcgaatacgggatttcatgaactttgggattttaatataaaaatcgatgaagtcaaaaagaaaaggcaacacaaattcggcatcgtgaattctgaataccgtccacctggttgtactttaattagcaacgaaactccaaaatatgaaaatgaaaatgaaattaatcgacttttgcaataaaaattaaattgcactttttaacttatttatagggggtggaaaaagtgcgttcgtcagccttttttttaatgaataaaaaagtaaaatataatataattatatattatgatatgtattcaccttaagtttcaattgtaattgaaagtctgttcatctattcattatatacggctctgaagatgtctttaggaatattatacagtaatgtttcaaccttatgaaaaagttgatcttcattttcaaacttgtcaccttcgagcatttctttagatatccgaacagaaaaaagtcagaaggtgcgaggtcaggcgaaaacgggggttgcggaaatcttttgatcctcaattcattcaatttttcattaaccaaatgaggccgggcgttatccatatgcaaaaaatatctattcgttaatattctttttgccaaatctccaagtacaacttcagaaaaaaaaattcgattaaatttttggcttatcgggagcatcgttattgatttgataccagttatagaccatataacagatatcattacttttttggaggcaatagtttgtttgggtttgtatggtttttgcactccagattcaatccacatcgagtttctcttgttaacaaaataaatccaggtttcatcttgcgtcaatatgtgtcttagtctgtagtcatttgaactagaaaggaattcaaataattcagaagcaatggcagctcttttggctttaatttctggagtcaacttatgtgaaatccatttgaatttaactttttcaatccctaaaatattaatcattatatttttcactgtttttggatctgcgcctacattcttcgcaattttcttcgtcgatgcatatggataacttaatataaaactggttattctttgatctaaatctgatcttcttggtctccctgtttttttctgttcgaaaattgagaaggtatgttcattcatcttttttgtccatttctgaactgttcgaagtgtaataatattgtcaccatatacagcgcataatcgcctatatatgtcttgattttcatttgattctaaccaaaggaaatggacaacagaacgtaattcctcaattggaactgacattaaaatgattaaacgttctctttcaaaggtatcctgaaaaaaagtagttttacttcatgcatcatatttacttggaaaaaagtattataataacaatgataatatatttattataaattttatttatataatttgatttcattaatatctaatataaatcaaaaaaaaagctgacgaacggactttttccaccccctatatatgtaatattatagtttaaataaatatttatacttaaaagaataatttgaattatttttataaatataaattattaaaaccaataaataaatgagatatttatgtttgtttcaaaaatttctgacatctaagtgtaaacgtatgggacaactttaattcatgggacacgtttaaatccctaactgtatttccaatatttgctgcttcattaataatatcatcattgattttcattccttctttaaataaaattgaaaatatttgatataaaatacaaaactctcctaattcttctaaatgattaatttcttttaatttattatcataaaaatattttattcaatcatcgattcaagaagataagatgattcatatgtatgtttatcattaagaaatcgaccaaatatatcaaatatattcgatttgattttattattctcttcaaatattcttatttctttgataatattcaaaaataaatttactttattatttttgattacaaatgaataatatatcatttgaataataattagatcataaaataaaggatggatttcatcaaatttgttgattattaaacctaaagatctcgagaaattttcttcattcaaactaaaaattgcttgatttattgatagaaggtatcatgtggaaaaatgaatccaacgacaaccgatatatcaattcaaattcgaataaaatttgagagtataaaccagtgaaaaagttaatttatctcgtgtggccacaacaggttgtagacggaaaaggtactcgaacgaagtaaaaaaaaatctttaaaaattaatttaatttaagaaatgtttactttgtgattgttaaatggcaatttccgcaataaagacgaccatctttgtgctttgccatgaagcagcctttgcagttttcacactccttacgttgtggttcaactgaaccatctttgccaatcttgaaaagtttaagaagtttcatcttttccttcttgcgtgtgtgtggaaccctcttctttgttgtaaagctcttcttcttcctcttcttctttttacctccatcgcattctgggatatcataaagaatagaatcttcgatgatttcgtaatcttgaagtgaataaccttcaacaagttcttcaccgccgaaaacgagaacaccatctgttgaaagaatggacttgatctcttcaaccttggttgtcgattcgacttccaaggagatagtccttgaaggtgtcttgacgaacagcttcatcaaaaggccacttattcactagctttgtttggcctaaaaatgaactgtcacttttatttcggctttgatcggcattttttttttctaaaaaaaaattaattctcttcatttttaactaggtaacctactttttagattcattgtaataatattttgtgaaatttgaattgaaaatatgaacattagaaatgttgaatgtatgaataattttccaaatctgcacattgtttacaaaccactaaagcagaaaaagaagccaaaacaaatatctctatttaatcataacacatgtgcttccggtgattaataattgcccaatctaaaaaccgatataaccgccataaaacctccaacaattttttcatgttgccgccagacccatttaataactttcttaatcaattaaaaacaaatatcacaaacattgaaaacagagttaaagagctccaagctcttcgtcaaacaaattcaccaagtatcgcatatcttgaagcacaaattcaaaatcaatatagtgatgcacttcaaatgaaagagactcttcaaaggactgttgacacatcacgtattgatccaagtaagcataatcttacactcgaacaacttgatgaacgagaaaatgaacttaagaatgcacaatcacgcttaaacgacatcaaaaacttattagagaacaatctccaacatattacatcccctaagagtgcccctgaaagtaattacgttaaagctaaacgcgaagataaccaaaacttcattgacgatgaactcagatatcaaaaccaacaattggaacatcaagatcaggaccttgataccattaatgagggtgtaactcaaattaaacaaattggaaatgagattaataacgcacttcttgacgaccaagagcgccttaacgatatggacgagcaaatggagcgagcgcagaacaagctcgacagggctgtcaagaaacttattgaaattgcagataaccccgagtgctggttcaaggttggatgtgttgtgctcacgtgcattgccgtggcgcttttgatttacgtgttcttagtgtgaaggaacaatttgaattgtcacaattactaaatgaactatttgtatatgttttgtaattttattcccctttaattagatacaatgttcaataaaaaaagataatagttcattattaatcattaaaataatatcaaatcattcccaaagagacaaattgtaaattacataggacattgttatatagaataattggaagatatttcctctaagaaaatatgagctcaatcaacacacattttaaaacaatgaattattcgtatttttcaatgaatttatctttattaccatcctattactaaagataatattagattaaacttaaaatttgaaagaaaaaagaatttgaaaaaatcatatcaatcttcccaaaacttaaaaaatgaaaaataaaaaacattcgttgtgtgagttttgatatctatgattcattttagatttttcatgacccagcaacaattcgcgaattgtggtttggcgcttttttataccgtttactttttttaacggtcagaaccaaatgagaagagtttccaccaaaaatgaagtttcaacagatgagagcgataacatttatagctctgatgaatatggaagctcagggaaacagcaagcaaaatcaaaaaatacaatttcaacgagtgacatattaaatattttcattgattcaacaaatcctcaagacatcattcaaattaatgaactcaaatcccttaaaacaagctcagatccaaaattagttttaagcaaaattgaagacattttagaacaatataattcatcaattaatagattatgtaatcaactcaaaggccatactcagttccttactaggcttgttgaaacacctgatcttcagtcaatgtttctcatttcacaacaaaatggatctcttttccttcccgaaaccgcgtccaaacttgctcttgaacaagcatctcgtacttctcaactcatttcatccattagtgatttcaccgaaaatgacacaatcattcccgacatcaccgatcaacttttaagtgaaatccaatccaaaaatcgcctcatgcgcattaaaacttttctttttaacaaccccgtcagttcaaaagagttatctgcgctattatggcaagaaattttgatcaatgatattcttcatcgcatcatcggaaagtcaaaaatcggtacacttcaagccttcaaatctgattctgaaacatttaacacttctatttcttcaaatcaccaatttagcttcgatcttaattccatccgtcaacaaataaaagaagaactggaacaaaaaaacgcatccaaacttcagcatatggaatcacaacttcgtgtgcaaattcttaaagagttaaacagcgatgcagcaacagctgaatcgaatatgggcaaacgaatcaaaaacgaacttaagcccaaaatcgaagcaaaactcaaacaaaaattcgacagcgaaaagtctttactcgaacgaagtcttcgcgttcgaatacgaaatgaactcgaagcgactcttcgtccgcagattgagcgcgaattgcgccgacaaatccacaaagaagtcagcaaacaatatgcatccgatcgaagtgaacgtgagttatcacttcgcacgcaaattaaaaacgagcttaagccaaagatcgaagctaaacttcgtccacagattgagcgcgagtgccgcagtcggatcctcgagcgcatgcaagcgcgcattccaaatcgcgaacatcagcatctgaatgacgcagaactcgaaacggcgcttcgtcgacaacttcgacgcgaacttacgccacagattgaatcagaacttcgaccgaagatcaaatcggagctcaaagaaaagatgcacaataaatacgaaccgaaacttcgcgaaacaattcgaaatgaattacgtccacaaataaagcgcgaactcaaacaacgaatgatgtccgaacttacgccaaacattgaacgcgaattacggcctaaaattacagctgaacttcgtccaaatataaaacgcgacgtcaaaatgaaacttgaaaacaaattacgtaatgaacttacacctaaaatacgtagtgaacttacgccattacttagtaacgaaatacgtgcgaaccttaagaaagaacttattccaaagataacgaaacaagttaaagcacaaaacgaaattttattacgtgaagaaataatgaatgaacttcgaccacaaattgcaaatgaaattcgagaagaagtcacaaaacaaacgaaagatgaattaagaaagaaaatcgaaaaggaaataacgccaaagattacacagaagaatcgcgaaattgttgaaaatgaacttaagccaattctcacacgaaagataacagagaaacttcagaagtcatatgaagataagccgcgaattgatcgcgaaacatttgagttaatacgtaaagcagttggtaatgaggacatcgaatacacgcgctataatgtaattacattatgtcgacaactcgcgaacgatgtaattagtattaggaaaaaggcgaattgcagtaatacatcaattgtgaaagtgttcgatagtttgataaagcaaattaagcgactgaataaattactggagaagacaaaagcgctgctgttgtcgcaggaaaagaaaatcacagaaacacaaaagagactgaacgagctcttgaagtggtgtaagagtttacataagtcatttgaggaagaaaagtggaaatacgacgaaattattcacttgcaaaactcaattgaagaacttattaatgaaaacttataaataaaatattggatttgttgtgtcttaaatggaaattgtttttgaatttatatcttataatttgtgtgtcaaaagtatgaataaaattaattttatttatttgatataaaggaaaaacataaaattctaatgcaattcaaatgtttaagataactgattcattgatggataaaaatttcaaatattttaataaaaataatagaaatagttttaatattttattcattattaatgtttatattatatgtgaaaattaaaattatcttcattgaaatctttcgcaaatggatcttcttcaatattattccttgaatattcaatagtaaaattcatttctttcgatgtttcttcgtcatattcaatttcttcttcttctttatttccttgttttcgattacgaattaagaatataataagcaatacaataacaagaataataattattattccaatcaatactccaataataatataaatatatgtttgatcatcattttgattttcattattttcattaataatataaaaattagaataaaatgtgaaatattgtgaataaataataactgtataatcataatatataaatgttcttgaaatatatataaatgttgaattgatatttgtaataataaatgaattaaaatatgaaatataaatacttaatgtttgtgtaaatgataaaatatttgttaaaataaatgaatgttttaaatttatatatgatgaaaatgtatttgatttagataatgtatttgtgaatgtacttgattgtgtaaatgtatttgtgaatgtacttgatttagtaaatgtgtttgaattagaaaatgtatttgattgtgtaaatgtatttgatttagtaaatgtatttttgaatgtatctgaattcgataatgtatatgaattagaaaatgtacttgattgtgtaaatgaatttgatttagaaaatgtatttgatagtgtaaatgaatttgaattagaaaatgtatttgatttagtaaatgtgtttgattgtgtaaatttatttgaatttgtaaatgtattcgaattagtaaatgtaagtgttggaggaagacattcgtcaattgttcctttcgttatctttaattctccaaatccttcacttatatatgtttcattgaccataacatattttgttgcgacatcttgaaaacaatcacttccaaatgctggtgaagtttcgccataaaaataaatacatttcagtgatgtacaatacgcaaatgcttgatttccaatattttcaacactttcgccaatgataatcgtttctaattcataacagaatgaaaaagcactttgttgaatctctataacagtatttggaattatgaaattcgtaaatacacaacttgagaatgcagaactttttatcgtatttaaacttttcccaattgaaattgttattaaatttgtacataaattaaatgcatctgattcaattgaagtgactgaatctggaatgctgaatgtttccctgagatttccaagtggataaataatgagtttcgtaatcaatttatcatataaaactccatcgttttcataattactataatatgaattatcttctgcaattttaataatttgaagactactacaataaagaaatggatttgttgatattgaagaaattgtacttgaaattgtaacatctttaagattaatacagttttgaaacataaaagatccaattgtttgaacaccttcacaaaaaattacactttcaagtttatcacatccattaaatacatctccaccaactgttgtaagaggacttttaattgttacatattttaatgcagtgctttgaaatgcacttgatccaatacttgttataccttctccaaatgaaacttcttctaaattagaacacataaaaaatgcataaaatccaattgaagtgactgagtctgcaatctctgctgtaagcaatgatgtccattcataaaaagcggaacctggaatttctgttattccacttgaaatgataacatattttgtattactttgataatcatttgtaaattcatttaaattcgttatagttaatgttgatgtatctgtatcaaaagtttgtatcgaatgagaaaaaaacaaaataaacaatatgaaaacaaatttgacgttttccttacttctattcagattatttgaattaaattttattaaaaaataaattccttctttaaagaaaaatatcaaaataagaaaaattaaatataaaaaacatttcgaatttgttttaaatgaataaaaagaaataaacgaatatgaagagaaagaagagaaatagtcatcaatttgctgaaaataaataataaatttttgtaaaataaaacttttataattatctaaattttgaaaaagaaaggttttattaatgtttggtttaaaataagtaaaatgaaaatcgtttttcttataactataatgttttatggatttatcaaacaaagtaagataatttatataaaggttattcacaagatttatggtaattttggtatttttgttcattggaaaattaatatcttcatttattggatgatgaataaaattgtgtattgtataaaaaacactcctagttgctaattgtattgatgctgttacgatataacactgcattttgtattcggaacaatcaaatctctttcctttataataaacaatcaaataaacgtattttatgaagtgttcaatactactcaatattccatcggctaatagaaaaaataattcaaaatgagggaaatttgtaaagttacagcacattttcatcatatttcgaatgaataactttcaaaaatggacggaattccgttcaacagtaatcaaaatcaatacaacatccgctatagcatcagccaaatgttattatttttttttaaagttctgtcatataaccaagcaattgaagcatataattatcataccctactagtcaatcacaaaaaacgacaccacgagtgctagcgttaatcacaagacattcagtcttattttcaagttgcaaaaagcagataatgccaaagatctttaagaccaatttgattaacgaacaacaaattcacatataatacaaatatgtaataatgatccaattcttgatactaatttaatttggataaaatcatttttcaaagttgaatgacattaaaaactttttgtcgataattgttcctactgatgaaaagaaattaatatagatatatcattcaaagaaatcacattatagctttttatattttgctaaatattcaattattaaataaaaatgtttaaaatattaaaatttattttttaggttgttaagtcataatgttgatgatagctcatatgtggcaccaaaggcgctattagagtcatctcctgatcgctgatacttcttttgtatggcttaggtttcatatctttcttatctgttatgggtaccgttgtatcttctttgaaatttcagcgctctttccaaatcgatcatcgtgaacatcactttctgaatgactcagaactcgatacaactctttgtcgacaaattaaatgtgaacctacaaattggatcagaacttcgtcctagggtcaaatcaatgttggaacttttcaaaaaagaataataaattgggtaaaatagagaaaagtacatgttcatttttattgtttcaaaataatatttggaaattatttgaattattttatacagcacttataatagcatcttcaaatgataatatataaatagttaaattacttcttgaacaagaaggtattgatattaatgctaaaacaatttatttgctttatttgatatttatttcaataatttagaatttataaaaaatatttggaaattcaaattatttaatacagcactcactcatgaatgcatcttcaaatggtcacactgaaatagataaattacttcttgaacaaaattttataaattgtaacgtaatgaaaaatatcgaactgcacaaaataaattcataaaattcaattcaaacgccaaagtttatttttcactttgctaattcataactattgtcggcggtcttcttcctctgcttggccttacgtttctgactatttgctttcctggtgtcatcacttcctgcaccggctgcgttggctgtttaattgggcgcaactgcacattcatattcgagccgattgggaacatttgctgtggcgccgctgatgcgtactgacttacgcctggctgcgtcggccgcgtcttcacttgtctcacgccgccgcttgcgagcgccttctcgagtcccgagttacgcagcattgccatgcgctccttgatagaacttgtcgtaagctgcttatcgacgacaataggcttttgcagcggcgtttcctccttcttcttctgcgctggcagttgcataggctttggcgccggcggctgcgcgaatgatattgttttactcgctacagcaccactcgttggcggcgtctgaggctttggaacgggcggctgcgcgggcgctgcagacggcgcaggcagtgcaacactctgaacaagaggcggagtcgtttggattgtggactgccacacgtgccgcgatggcggcggctcgttgcgcggagtcgatggcgcaagcacagagtcgtcttgcgatcgctgcggcagctctggctgagtaacttcgggctcgatctcttccttgggcggcttgggcggtggaggtgtaaatgacggaacagtggggcacttgtggacgaggcgcttcgggccggcgcgcgctttgatggtcttgcgcgggcggcgcatgacgcgagtgatgactttgggcttgatgaagtagaattcaatgtcaaggaggttttgcgctgagctgttttgctgcattggcggcgctgctgctggtggtggtgtagcttctgtctttggttgttggatttctgtttgctgaagtggcgctgttggatctggttttggctgctgaacttcagattgttgttgtggcggcgatgctattgtgggtacatttggctgctcagttgcattgttttcgtttggaacaataagagaagatgagctgtgagagccacgagaactatgagtgccatgagtgccatgcgagctgtggtgatggtgctggcgccttgatggcgcaagagcatcagtggtttgcgcagcaagtggcgacgcacctttgtcgagacttgaagcaggcgaattgtagttggacgagtctggtgaatggtgtgagcgctgtggtggtaacgaataaatactttgtggaatagtgaaagaagctgaagaagattgctcagagtttgatggcgaaggactttgtggagctgctgcagttgacattgtgggcggctgaggaatgtttggcactgaagtgggtgaaggaattcgtggtaatgaagatggctgtgtggcctgcggaactgcagaaggaggagaaggaatgttgggcactgcagcaggctgtggaatttgtggtggtgctgctggttgtggaatctgtggaacagttgcaggagatggaatattaggaactggagttggctgtggaatttgcggaactggagtaggtgatggtatattaggtacagtggttggatgtggaatttgtggtgtggaaggaagtggaatttgtggaactgttgatggttgaggtatatttggaacattggtaggtggtggaatgggtggaactgaagttggggctggaatatttggtactggtggtgggatttgtggcgaggaaggaagtggaatttgtggaactgatgttggcaatggaatgtttggtactgaagttggtggtggaattgatgggatatttggaacaggaattggtggaagattagttggtagaggaatttgtggtaatgcactaggtggaggaataggtggaagatgagtaggaagtgggatatttggcattgatgttggtggtggaatttgaggcggagttgagagcgaggatataggcggtggagttgacagcggagaaataggtggaggcactgtcaactttggtggtgggattggctggcttgttccgttgttcattttctggcaaattgaatgccacacaactttaactgttaattcacctcaattttgattcaaccgtttgattcaaatttctcttaacagatcaaaacgcatacattattttataaagtattcaactttgtttttttcacttttcaataaactttcaatgaaataacttcgatgtttcgaatggttatctcattttattcttgaaatatcaataaattaaatagaaacgaaagcctatggaatacctttcatgtctaaatgatttaccttctgtttttgacaaaaaaaatatcaaagaatacccattacagacaaagaagcccgcaaataaagtgaaatgtattaataacattgaatgaaatataatcacccagcattcaattatcagtcaaattccttatcgttttaatttttgaaattggagctttctaagttacagaatgtacgttatagttagagatcaccatgaatagtcattagtcctacgagactatcatttttaagaagacccatagttaaactaagatctcgagatttataaaaaatgtttcagccgctgaaaacgttaaaaaaaactgaaaaatacaacagctgaataaaccagtcaatactttcagccactttttaatgtgaatttaaaaaaaaaaattggtctaatcagctaaaaatagagcctacaggcagatatcagcaacaatatcttccgatattctattggaatgcattgtgctgactattacaagctataataaaattcattatcaaaacctaaaataaatatactgattgtatcagtatatactgattgattatatttgttaacaatcattctctgggcaaaagtttaaaaagtttttacctaaagcataagattgaaatttccaaattaacttgtaacaaatcatcataaaacaattcgaataaagtttatcaaacatgcttggagttgtccaggatacagcttaaatttaaatcaaaaaaattgaatttttaatgtttcaatcctctttgttcaagtaatgctttgtatgcttcagctttcttggctgcagcttctctacgtgctttcttttctttcaagaacttggccttgcgtgcaagacggcgtggtgtgatgagtctttggatctttggttgtgtgaatttgcctggtttgacttcacggcgaagaacgagcttggttacatctgctttcttatctgcaccaaagattgcacgaattcttgttgcacgctttggtccataacgacgtggaacaactttatctgtaaggccttcaatttctgcatcacctttcttaagaactataagatgaagtgctgaaatttcggatgagatgacacacccgcgaactgttttccttttacgttcaccatctttacgtggacgatagcaagatgtacctgcacgaagaagtaaacgaacacgtcgtggtgtaagaacaccttgtttcattggaaatccttgtttatcaaaaccaccgccaagacggaaaagatatcctgcaaattgttgtccaagaattgatccatcaatatcttgacctaaacgatgatcataaagactgttaagtgcgactggatcttctacatcgatacatatttgtgttccatgatctggataggcgagtgtaagcctcatttaaaaaggaaggaccataaccgttttaaccgtaatctacttaacgttttcctaaaaaagatttaacgttttccagaaaggatgtcactttttaatgcaaaaatgatgaaaatttacattgatgaaataaagcaaaagaatacaattgaaattaatatctcaagtgattcaacaatacttgacataaagaaaatgcttgatgattctaatggttataaagttgaagaaacgaaattatatttccaaaaaaaaattcttcaagataatatgaaattaaaagatacaggtgtacaagattcttcacacttaaaagcttattgtcgcggaattagttttcctcaaaccccttctattcaaaaatttgattcaacttcatacgaaattattccaccgaaaaaagaaagtgcttatataaattcaaaatatctttcttacataacggaaaaaaaagtaaaaaaactttatgatgttttcgggggcaaatataatatgcttcaatgtcaatgtcttttgatggttgtaggaaatgacagagaaaaagcaaaagaatatgaaagcaaaggtttactcaaagataaagaaatcggttttatgaaagaagcaaaaaaacttttggaggcaaaagattttcaaactgcaatccttgaaaaaaatgaaatttataaaaagctccaagaattcaataagaaatattataactaaaccttttctttatttaattatttttatttacttttttgctaaaaggtttctttaatttttttaaactagagaaattcaaatttgaaatgaattttcaagaattagacgttgtaatcactgaaatctgattttaaaaaaatgattcacctttataaagactttgatacttatcataacatgaaataagaaaaatgtcaattaaattttcgcacaaattttttcatttattcatttaataagataatgattatattgattttatatttatttatgtgattttttatttttcttatcaaatttattttgttttttatcatttttcttatcgaatttgttctgttttttatcttttttcttttcctgcataaatttcattcttttaattttcttcgctacgttcgccacatcctttgcctttcttttttctttcgatatatatactctattttctttttctctaatactttgaggtttaaacgcaatttcctttgtactttcaactgcgttttctaactgttccaaagctttttcttctttttccttaatgaggaactccttaacatcattcattatttcttttaacttatcttgcgaagcctgaataacttcgtcgggtatagttctcttatgcacagggttatgagagttcctaattacatctttcatcatttcgcgatcttcttcaccaattaatgatacagctctaccattattacctatacgagcagtacgtccgactcgatgaatataaaagctcattctttttggcatattataattaataacattttcgactccattaatatcaagtccacgtgcagctatgtctgatgctaaaagaaattcaacagctccattagcaaatgcagcaagtgactcatagcgtctcatttgtgacatgtcgccatgtaactcaacagatggcatgcctaagattttaaagatcgcatacattcgatgacatgcttttttggtccgaaagaaaataacggttttcttggtgcataaacgggaacaaatggcaagaagagatgcatcacgcgtttcaggcttgatacgaacaaattcttgcgataacgagtcactgacagaatataactcatctaatgcaatccgtactggggtttgaagtgcaagatcaacgagtttagcaactgatgatgtcatagtggcagtaactaaaagagcttgacgacgttctggaatacttttgactatttcttcaacttgtggaatgaaaccagaatcaagaagacgatctgcttcatcaagtatgagaatttcaattgtatttaatttgaattttttgaagtttttgatgtgatcaacaaaacgacctggcgtggctactattatgtctgggaatgtaagaagttttatctcttcatcacgtggtgtgagaattccaccaattaataataaagctgtaagattagtatattgagttaattgacttaaaactgaaaaggtttgttgagcaagttctcgtgttggtgataaaattaaggttcggatacattgttgttctgttggatgtcttaaaagttgttcgattgtgggaattaaaaatgcagcagttttcccagaacctgttactgctgaagcacaaatatcttttccttgtaaagcaattggaatcatttgtgattgaacaggtgttggtttttcaaatttcatttttttgatagctctaaggagtgtgttagaaagaccaaattcatcgaatgtttctgcatttggtggtaacgctgtttcgctatcgaaaaaatcgttcattgaacgaccaaaataatttcaattaaaaataatcgttaaaaatcggaagacgttaaaaataatgatcttgaaaaatgttaaaaataatgaccacatgcattaaataattagaaataaattaacaggcttatcaacaattttacttttaaaaacagaatgaaaggtatcttttttaaagaaacaaattttgcaatatgttaaaacatgaatgttttattattcaataaaaaatcacccaagcatatatgtagtgtttctttttgctttggcaataaatgtatacttaaaaataataataagataattagaaaaaatgttttttttttttttttttttttttttttaacgataaattatttatctttagtccaagaaatttgacctttttgtcttaaacatcaattcttaaattcgaacgagtttttttggttttgaaaattggattcaaggacgaccaaatccaaaattttattttctgatagggactttgaatttgagtcgaaaaagcggcttaaaaattttatttcaatggtctccatccaacaaaacggaggattgtgtgttgacaaacatttaaattctgtgataaatttgttgacaaactcatatgctcccagaaggttatgtttctccagaaacctttgaaaatatggtaggcctaatgcaatctgggactagtgaacaacaacaagaagccgctgcttttttggagtcgtgtaaaaattcacccaattcattgattacaatatcaagtttattaacagcagagctttctttcaactcaaagttccaaatcttatgtatgatactgcatattatccaagaaacctggtttaaatataacagagaagtcttaaaccaagtcaaggaactttacataaattttttgtttaataactcattacagaaccttatttcaactaagcttgaacaggtcatcgcacaaatagcgttttatgattatcctgaaaattgggaagattttattccttttctaatcaatttcttaagtactggtagagaagatctttcttcccatgtctttatgattcttacatacttcctttatcttgttaactcttcgtcaaagatttcacttaaaagacgatcaatcgtattagaacattttatgacacaaattccaaacattttcatattcatgaaaggttttcttagtagtgaagaagttgttacttcttttatagaattttcaaaaatattttgtaatatcattgcagacaattcccaaatatctttgacattttcacattttttcttcgatcactatgtaacagactcacgatatacagcgcctgccattgaagccatgaccaatttattatcacaaaattcatctcatcttatcaccttaattcctaacctcgtagactttatttctcgaagccaacagccaatacccatagaattccataactttctctgtaactatatcaagaatattttaatatcaattcccacaatctgtgattcggacgaaagcatccaaaagatccagcgcctttttgaagttacgctcttagctgctccactggacacattttctttatcattttgggaattatggaatgattcaatacatttttttatgagctcccaagccttattttcgagtttgttgttgccattaataccattagcggtgactaccttttgtgaattgttaccatcttccacagagttatctcgatttatctctccgataacaccatctgcttttttatcattatataaaatttcaccagagccaatcatcgattacatgaccaaaatgcagccgtcatgttcattatgttatgcgattgggattattaagcatccgatatttacggagaagttattacaaataatgaatgaatgttccaaacttaaaacgcccgacataacaataatctctgcaatcttttttgcgttatcaagaaacgaagaaatattacaacaaaacgttgaactattaaattcattccgacatttgttttcattatttttagtgtatgataacgtaaatgaaaatccggacttccaaactacagctttattagcgttaaatcatgttgcgtctaagtcatcagttgttatcactaatgatccgacatttgttgaatatttatttaacattatcatcaatccaaacaattttactgaagaaaactttcatcgaatttgtcgaataatatcaaaagttatactttcattaccgataaatgtacgacaaatgaatatcaatcgaattactaatttcgcttcaagtttcttattatcagataaccctaatagtattttacttggatcacaaatcgttttctctttgtcaagtatatcgatgtgtggctcttatttaatcaacaaaaacttttggatgccgttaattaacgctatgaaaatttcaatggaaaatgactgtttctctgacttggcggttgttttcgcatcgtcaatgcggggtgccccgtggggaatgtgtaaaaagccaatcaccaagttcttaaaattagtaagtaacgctcaaccaattcattgtaatgcaatcgttaacgcgtttaatcaactgtctcaatgccattacgaattgttggattatagagatcaaatatcatcaacttttgtaaggtttatgttggatgatccgcaaccgccgttttttgaattctttacaatctgcggtttgaatgaagaagaagaaggatttgtaataccaaaagcttgtcaatgtttgccttgcccgtcattggatctgagtaaatcggcctcaacaatgctaagaacaatgatcaggaaaactaagaacccaaaatttttcgaaaattatgaacaaatgataattcatgcattattcgcgacacttttcgatgaaatgcacttcaagatgttgaagtctttggctaagttgttgctctctgtctataaaaaacatattagaacaaatacactcggaccaataacagatcaattcgtgacacaagctgtttgccaatttgtcggagataacgaggtgtcaaaggaattcgctattgctatcagagaagttgttaataatggttcatcagacgaatttttgcaaattgtctccgaatttatgatttcttcaggaagatataacccagaagaaatgaggatactgagaaactctttgatacagaaaacaatagcaaaggaattgatggattcacaaattaatgaggccgaactttcgatagaaaatgaagatgaatacgtttcacctttgtaataaatagagaatattatatacatttcttgttttggtgtgaaataatgagaaaaaccgaattcaaatttttttatggaatcgattggatataaaataagtttcaaaatttcaaaaccgtcaaaaattgaatgcgatttcacgtatctcaaaaaaaagattatcttgaaaataatgaatgacttaaaaacacttaataactaaaatttagatcacaattaaaaaaaataattgatttaatgataattaataaagatatttgaatttaaaaatcattaaaaccgttttgtttcaatgaaaacattcctatcggctttttcacccaccagaataattatcattcgtaaaaatttatataaaagattatttctgaaaaaataatcaaatattcccaaatattaaaaaatatatttattattcataaataaataaagaccagtgccacttcatatataaagttgcatataggggccgtgtgatctatagatcatttgattataatatttgaatgttaaaaattagtgcatcgccttgtatattgatatgttgtgaaattattaaaaataaaattttaaaaatatttacatatggaatggatttaaataaaattgaagaattggaaattcaaagttcgaaaatacaatggtgcgaaatgattattgcacataaggattacgtgttggcagtgtccgacttaaataacaagttgacattgttaagtttgccgtgtttgaggattttaaggactttcgagttacaggacgcagtcgtaacgatgtacttcgactcaagaacaaatgttttgtattatgggactgaaaataataaggtgtactcaatagacttccattaaactttaagagtaaataatactatgaataataattaattttttgatgttatgaatttttcatcattttttttcacaaaaattttaatcaaattatatgaaaatcatataatgaaatatgatataaaatattcgatttatcaaatttaatgcattaataataatatatgaaaacaaaatgaatttaggaaatgtttatttcaatatttaaatatttcctcttttatccttgtgaatcttttaattttattatgtcgtcacatttatgatgttgaattttgtctgcaaataatcgaataatttctgcacttttcttttctgatgatatcataagcgctgttttatatgtttataagtaattccaaatattattttgaattttcaaattattaaaataaacatcaaataaaacaaataaatatttttagcatcaatatcaatattctcttgttcaagaagtaatttaactatttctgtatgaccactttcagatgctttcataagtgctgtttcaaataatttaaataattttcaaatattattttgaaatataaaattattaaaataaattttaaataaaacatataaatacttttagcattaatatcaattcctttttgtttaagaagaacttttgtaacttcagaatgaccttggcgtgttgcccaataaagtgctgtttcactaattttatataaattccaaaaaaaaaaatattaaacgttaaatcttcatgagaaacatatttaccattaatatcaaatattttttgttcgatttgccattcaataaatgatacaaattctttttggtgttgaggaagcatctggttttgaatatatttgacacttttatattcggcattttttttcttcaacagttggatcactcgccgaccttaaccaactgaatcgcatcgaaaatttttttctgataaaccacagaatgttagtagcaatgttgttgtgtaaataacggccacggattttaaatttaaattttcaggtggttgggatacttttgaatgcttatgagttcaatgggttttgaactgagctttacattcgcactcttcatcaaatcttttggctcaaaaataacaaacttagtcaaatatggaaattcttgtgtatcttttgaagtcgatggattcgatggttgtggttaacagtccaaaatgatcggcttctagttctaaagcggaggttatattcaatgcatataataaattttttttattttttgcaagaagaaaaatttgtaatgttcaaaataatcataataaaatttgtttgtgagaagaaacgttatgctaaattcatatccttttatcctactatagttataataatttttaattcatcaaattcaatatctgttcttttcgatatttttaattttttctttatattatattcatgatttattggtgttaatttctttcttgaatttttttctatttatgagtaacaaattgtggtaaggtaaaaatgagggtattcatttaagggagatttccaggcaaatataaatcaattaatgtaattttttatgtgatgaaaaatatgtttctttaaatttttttaatgcaaagtttgagaagttctattcattttgaaatcatggccgtgtgaaattcacactgtgaatcacacggcttgtctatgcatacaattttggaatggattattctcatagaatattttgaattaaagaaaatcaatattttacatatgttacatatttaataaaagcattgattttgtgtttaacacttcttattaagaaaatatatttacaaaaagtgacatcttcatatggagagattcgctctccaaaagtgtattcaattaacaaaatcaatgctttcaaggaaaatttgcaggccattctcgcatccaattgaacaaggacctgagtatcccgattatttctcatttattaaaaaaccaatggaccttaaaacagttatgaaaaaacttgaacagaatttatatcaaaatgttgaggaatggattaatgatgttgatcaaatttggaaaaatgcatttctttatttcgataaaacagatctgagataccttattgctattgaaatgcgacaatgggtttaccgcaaactctcaacagtaccgctgagaccaaccggtgaatggttgcattcacttcaaaaaacagcaaatgcactttataaaattgcttcctgtccaccagctcggggtcacggctcttagattcgagcttcacaccgttaagcaaagacaattttgtcaaaataatttgttcgatacacaaaaattttctgtttaataaagataggtttacccgaaattgtaactcttagcttatagaagtcaaaggaaaagatgctatcttcggatctattggagaaactctcaaatgagctcaatccactttttctatgaaattgtgaggatttgaaagacgtcagaaaaaagggtatccaaaaaaccgtttatacaccacgtacaacattaaaaccgaatgagcaatcaggaatttccaaatgtggattggccatatccatcaaaaacagcgcaaaataacttactttcatggtctacaaacaacttgttggcaatgtccaatggtccaattttatccattttttcaccacaatctcaaaatattgaattgcttttaacaatgaatccattaaatcaaattattacaactctctcatggtgttcagggtttgatgctgatggacaaacaccaattcaacttttaatcacaacaagatcattaggtcttgtctatgacttttctaaaaaacgcaatattgcaagcttttctacagatcgctcaattgtatcatctatatggtccataatatcaagtgatatattttttattggggatgcaaattacaatgtcacatgcttcaaaatcacgggtgatagcttcaaagttctttggacaaatgaaatccaattttcgcctgattttttatcaatatcaccatttgactctaattcactactagtatcttcaaagtttggtctttttaagatactatccacacgatctggtgagacaatcaatcttggaggcaagtttccagttgatgatgaacctcttcataatgtcagattttatccatttcttaataacactcttttatttgttgacaaaactggtatttttatctatacgcttgctgataaagctcttatcaaagtcataggctctgaaatgggtcacgaacgaatattcaacattttttttgatgaaacagacgaaacgattttttcattagtacacaacacgcacattcgtaattacgatgtatttaataatggcattattcgagggcgacatataacatatttatcgcaacctaagaataacatttgttcattaattacagcgtcgtattatcgaaacaaaattgctgttttatcagctggaggatatcttcaaatctttgaatacaaagaacatgatattcttcttcaatgtgtttataaaatgcttccatcgaagccaaatgattttgatgtatataataattcacttattactggatcgaaaagtggctatgtatcaataacaaacgaatcgaaaatcataaaattcttccaaatatatgacggcaaaattatacgcatagtttggttgaatgataataaatttgtttctgttataaaaactgttgacaataaaattaaatcatttttttatgatgttaattcaatgaaatcagtttcgttattacgttcatcacttgtctcacttgaaacatcaattgatttaattgtatcgaagaatagaaaatatttcgcattagttataagtggttatattatacttttgtttaaagaaacaaaaaacttcgcaacaataatcgaacaaactcaagtgatcgcaacattttctgacgtgtatgacgaagaaattattaatataacaccaaaaggtattggtaaaaaatatttactttctcctgataaccctaacgaaagttataatttgttgaaaaaaatcgattttaatataataaaattaaatgaacatttaactgtaattaaggcgttaaatgatcatttaatatgtggaactaatcatggcgatataattataatcgattggttcggtggtaatcctgtttcaatccctttcttaaaaaagcaaattacttcaattgaaattcttggtaacaaaatttatatttgcgatatatcaaattcaacaggtttaattaaatacgaaaacgattgttatcgcattgaattcataaacgatgaaaattgcgttgaaaaaattaaatgggttgattcaaatcggattttgataagaaaaccgtcacagccaacactaaccgttctatcggccgacaccttcttaacggtctctcatccaaatgaaattaataatttaacaaaagaagaatttataacagaacttaaaaatgataaagaaaaagatttatcaacgatttgtaaccttgcttctaaatctggttatcatttgttatcaatattacttttatcattatcgccaacccaatttacatcgaattgtttttgtgccaattttaatgtcgaaaggattcgctcatttttagatgtgattaatgggatgttaacgttatcatctcataaaattttacgcgtacgtaaagctcgacttgatctgttattaggtaacaatgaagaagccataaatttgtttttagattcaccttcagataatccaaactttatagttgactccattaaagtatgtttttttaatagtaaagattcgacacattcaatcgcgccatcagttgcagcgctaattgattcgaataacatatccgatgcagtcgacatattaatcattacagaacaatataaagaagcagtgaaacttcttttgactacgggaaatgtcgaagaagtacttgagattgcgaagataagaatgaacaaagaagaaatcgaagcaattcttgattcacttgttcgaacattgttaattggtaatcagtttgttcaagctgcttctgtcatgatcgcatgccgaaaatttgatgaagctgcaaaaattattagaaaaaatggatttgatttcgtggcaaatgttttggaagcaatggaatttcaagaaaataacttgttgagatttaaattggatgagtagagtggaaacgatttgtttgttataaagaattgagattaataaagtttgatacgattctttcgttttgtttattgataaaatttgacgttttagatcgaatttgttctttcgttttagagttttcgttatatcattatgtaaaaataaaaagtgaattgacacaatcaaacatttaagtttgcatcgtatactcaaaacacataaaaatttaaagcagtcggaaaattaaattatttatttgttctaggtatatgtatcaacattataaatagtatttgggctttgtagatgtgatatttttcattgcttttatgatgaaaaatcagaagaatgaaatttcatgttgtaaaatattgaattttctatttaaatagtcgttatttttgtacattcgaagttactggttgcaaacttttccatcataaaaaatattttatatgctacatccaagatccttccaccttatggtgtatgcgaagaatgctcaaaagttgtcataaagggcatcatataaaaaaagttgatcccaaacctaactagctattcttctgtgaatgtggcgcaggtcattgtatttacccatgcaaactcatgaagaatcaaacaaaattaaattagtcataattattattcaaaaattaacataacatattgcattttataataaatttttaatatgttatattttatttttattttttcatttgttaagttattttttgaaattttatagataacaaaaatcttttttattggttagattaataccaatactttagggaaatggtaaatctacttatttacagaaaaatctaaaatattttttcacacatttagtataattatcattaataacatgaggttcatcgtggaaactttttattataatactattcaaattgaattggcgacgattaaaatcttttctattctctcagaggctcaagcaaacaacatgggaagtatccgacttcgccattcattttttccacttcccaataggcgtgttgtgttgcattcttcacaagaactaacgatttctttgatgccttcaattcgccaggtttatttgtatcaaaacttttccatactcgagcataaaaaggctctgtttgctcgtcttcccaagatttcggaaccattccaattggttttgcaaaggcccgtgaatttgtgacagaatctcttagtgaacataataactccctaatcttatcaacgcggctagccatcaaaaactctgcatcaactcttttattttcttcctgttttacgttaggaatgaaattgtatatatcaataactaattgtgatgcaatataaacgacaatatattcatcttctttgagcttggtaaagtacttttcggcatcgagcagttcttttgtgagttgttcttcggtattttcaatgttcttgcttaaatcaatgtatagattgttgaacttggaacctgtatctaatatattattgatagtatcggaaagtggcatttcttgttgcttttgtttgaactttgtacgactatcaacaaacgttttatatgattttttcaaattttggataatattacttactctcgagttatattgttgagaatttttggtgtgaatagcaatgtgatcttttaattttggaatggtattgaattttatctctgcaagaagtttttggaaatgttttgggaaattcgatataattacaccaaccaactcacctgatagattagaagttgagcttgtcccttgtgtttcgttcattagtttgatttcatttagattgcttgataatgatttaaatgcgttttcaaagaaattaagatctgccactaaatactttttctgtttttcgaagagagcactcaccgaattcatgcattcatcaatttcgttgatgaatttttgtccctctgtttgcatgtgtgacaacggttttttacacaaacgcccaaataaacaattgaaaaaatttgaatgtttgagaaaatgtcattttatttggcaacaaactttgatcatgtgaatgttccatggaatagtacatcaaaaattaaaatgagtgcacattttacttgtaatatgtttgtgtgggttaacaaaaaaatatttgtaattttcaatattaatttttagatatgactatttttgatcagttatcgtatatgaagcttaataacttaacttaaatgttttgcaatttcatttataaaaaatattttgtggtaacaaattgattaaaagagattcacattaatcaaaaatattaactcaaataagcatacccatttcctactcctcttttttcatatgtgttaataagaggaatgtaaaaaaccaaagagattttgcacaagctttgtttcattggaaaccaaatttcaccgttgataaaggttcttctcaaaatttgtgcgtttatttaacagtcttgctttgaaatttgagtgcatgaattggtgttgttgaccagtctctttgctgactacaaaagaaagatttatctcttattaaaacaaagtaaataacttttaagatttaagagattcaatagaacaagttagtactcccaagaattaccaaatttataaataatatgcttaaagatcgccaaattaaccataacccaatcttgttggtgcgcctaagcataagtttagattatgtgacagctcgctattggagtgattaaagattttggaatacttaaattgattcttatttcaaaaatgctgaagaactcgtgaacacctttcttaagatgcactttaaaaaaacaaacaacaacaatcaaataacaaaaaaagaacttctcatgagaattaaactattgttcagaaatgcataccaaagctcattcaaataccaatatgccatactgcagtcatcaccatatccaaattttcatggaattatataactatatcaagttacaaaacaaaacagaaaactaaataatttcacatcacatgtcagtaaatgctcgatgacttcgattcgtaattatattgaaaattcgacaccagaaaacccaattaatgttgagttaatcagacaattagcacgccgtagtctcgaagttgacgtagacagagcatattcatggttggttttatttcaaatttttccttcttgttttattgaatggccgcttaaattatcaactatgagtgatgaatattggggatttgtaaatgactttggggtaaaagattgggataaacagatattaccaagtaaattccaacaagaagatttcaaagttcctcatccagaaaccatgttaatgatacacagtgatgttactcgtacaggtcatcaactttttttcttaccagacggaagaattccaggttcacaactccaagaatcatctcctggcgaagataaactattttacatacaaggccatataagacgaattgagcgtattctctacatctttgctatgctcaatcatggtttaaattatatccaaggctttaatgaacttgtatctccattttacatattactaacaaaaactaaacaactttggaataatgacttttacttcgtagagggtctttgcttccatatgtttcaacgccttatctccacgacttcgatcaatgatttttgttcaatccaagataaaaccattgttattcaccagctagctccgttcttatctctacaaaagaaatatgttcctgttgctgccgacataatatccactcttaagatccatcctttattctattgtgtgagatggttttcacttctattttcccaagaatatgagttaccgaatcttttcgccctttgggattgtttattttcgcactttgaccacctcatggattatgtgtttttcgttggtcttggtcatcttaagtatgtagaaccaagaatgtcacctacagattacgctaagacaataacagcactcaaagaaatggatgttggagataacttagcagaagtcataggatatgcaaatgcattttggaacacagagcacaaaactaaacagaactcagtatcaacattcatcaagaacatgttaccatggtaacaatattgttcacacacttcgtttttttagtaaagtttgtttctcaaggaaattcactggccatcggtgtccactttttgacatgaaattgcggttttccctccaattgtcaagccattgtcttttcaaatttaagaagatttccccagtttacaaattgagggagtttagaattaagggtgtaatgggaacgtttagaattgtttgatataaaccgttatttttatcccaaaaggttgcaagaaactgtttgcgtatctcaaattttgtgcgcactctgaattatttgcggttgttgccaaaatcgttgtaaatatgtgaatttctgttagttataattttggaacattccgaagcaatgcttcaaccaaatacttttatcccccattccataggaaaaatagcctctcacaggaaatggtttactccagaagaagataaaatcctccttgaactcgttaatgatgataaaaagaagaattggactgaaattgcaacaaaattgcctggacgtactgctcgtcaatgccgcgataggtataataatacactcaaaaatcaggttgaaaagaaaccttggacaaaagaagaagatgaacttattattacgaagttcctcgaaattggacctaaatgggttaaaatttcatccttccttaagggtagaagtggtaacaacattaaaaatcgttggcataagtatataaatcgtgataaaaaatacgtacttcctgcacatttagctacagaaaagaagatccaaccaagaacaaaacccccgcaagaagtcagtaatactatcttgaataataatacctttgattttaacttcaaaacagaaaatacagagaatacagaaaatgatattttttacggatacatggatggtactgattcatatgactacttttgtcttggaaagggcatgacagatccttttactttctagcgttccagattttcaatctcaatattcaataaaaagaaagtagctaatcgtgtgcatctttactaatatcgtccaacatgccctcgttacattttctttgtaaaagctaatattctttttctttttttcgcttcggggggtacggccgccttgtttttgttttcaaagaatttgcgatagtttgacggttaaaatacagaattccaagttttatattgcttttgtgaactttttattccgccaaaatcctctgcattgaataattgtgagcaatcgactttttcttcgtatacgacagcttactttttaaggaaaattacgactaaataaacattcaaaaaaatatcacagtttttggtaaaaactacagaaaagtgtcatcttcgaaatgtttttttggcgctattaaaattgacaaagtttatttgaaaatagaattgacttggtttgtttccttctttctaaatcagaattctgatttgcattatgtattatcaaaagtaatttttattatcatccaataaaagttttaaaaataaatactgtcttaaataatttttaaatatcattatgaaatgctgtaaaatattttaacgcctaagttcgttaattcttgaacatgagcattacttgctgatttttgatataattgtattattgccaatcctttctttttatttttatatattcattcacctttttgatatgttaaagctaatttacaagcataatcatcatcgcttaattcagatcctttttcatattgatttattaaggattttttcctattaatttcggctaattttttaattaaaaatatatcacctaattcagaagcttttgtgcacaaaacgtcctagtgtattaacttatgaatttgacaagttataaattgaacataatgttttaagattgcttcttcataacattcgtcaatgttcttcccaacatattcataatattctcctaatgaacattattcgttttggctgactcaactaaaactcttcttccacattttcttaagtcttgtggaatcactttgtaaccatcgcaattaaaatgccctttttctgatgattcaattactttttgagtattataggaacttataaattcggatgcaagattatacatggaatgaaaaaacccttttgcgctaatgtttcgagtaactcaataccacgtgaaatatttttcggaaccccattactgaaaatataaatcataaataaattaaacataacagtaagatcattatttaagacacatttctcatataagtttacggcttttggatttcctgctaaaccattttgataaatttgtgtaagattaaatgatgcattgtttgtccctgcattagatcctttttggtaatattaaatcgctttattgattaattcaagattaattttcacaatattctcgtatgaggtaattcctgaattcttgtgtatttatttataaaaatgaaaattttagaaaaagaattcataaaaattttttatttattttcctagtaaatttttgatatcgatatttcctttttttgatgcatatgtgaaaactgtttcatttaattatgataaattccaagaaaatttttagcattaatatcaatgtttttttgtttaagtaacattttaactattttttcatgtccattcatagatgccaaaattagtgctgtattatctaatttatataatcatcaaatattattttcaattacaaaatgattatttaagacattatgctatttgtttaaatatcttttatgttaatatcaattcttttttgtttgagtaatattttaactatttctatattacctttttctgatgcccatataagtggtgttttaattatttaatttattcatatatcatttaataaaattatgaaaaaaaattttgatatttgctattcttcaaattaatatcttgagcattaatatcgatttcgttttgtttaagaaggttttgaaatatttctatatttccaatttctgatgcccaaataagtggtgttttaaataattttaataaattccaaaaattattttaaaatataaaaaacttttaataaatatcaaataaaacaaataaatatctatagcatcaacatcaattccttctaattcaagaaataatttaaatatttctgtataaccatgaaaagaagctaaaataagtgttgtttgaaataatttaaataatttccaaatatgattttgaaatccataattattaaaattaattttaaataaaaaaaataaatgtttttggcattaatgtcaattccttcttgttcaagaagtaatttaactatttctgtatgaccattccaagatgcattcataagtgctgtttcaaataatttatataatttttatatattattttgaaatatcaaattattaaattaaatattaaattaaataaataaatttctttagcattaatgtcaattcctttttgttcaagaagttatttaactatttcagtgtgaccatttgaagatgcaaacatgagtgctgtaaaaaataatttatataatttttatatattattttgaatttccaaattattaaaataaattttaaacaaaacaaataaatacttttagcatttatttcaatactttcttgttcaagaagtaatttaactatttctgtataaccattatcagatgctatgataagtgctgtttcaaataatttaaataatttccaaatattattatcaaatatcagattattaaaataaatattaaataaaacaaataaatatctttagcattaatatcaattcctttttgttcaagaagtaatttaactattcctgtatgaccttttaaagatgcccaaataaatgctgttctaaataatttaaataatttccaaatattattttgaaatcctgaattattaaaataaatattaaatataataaataaatatctttagcattaatatcaattcctttttgttcaagaagtaatttaactatttctgtatgaccattttcagatgctaatgtaagtgctgtccaaaataatttaaataatttccaagtattattttggaatataaatttcaaataaaacaaataataatctttagcattaatatcaattcctttttgttcaagaagtaatttaacaatttttgtactaccattttctgatgctaccataaatgctctttcaacattaatttcgattttcttttgcttgaataagaacttatatatttctgtggaactaaaattatttataatttttaaataaaataattaaataaaacggcaataaaatttttgatacactaaattattgatataaaactaaatataaatgaatgaattatcatcattacttttaatcattataaatttatttttaagaagatatttaaaaagttctttatttcttgaaattaaaatcaaacttaaaacattttttggaattttgtctgtattattttttacaaaatatttaaataaaaatatatttcctgttttaatcgaagctgtaataagttccttaatatttttattttctttatcgattaaaaaggaaagtatttcataattataataaataacacaatctgttaataaatcattatgcagaatatatcctaatttattttcataaatatatttaaagatatcatttcgatgaaattcaattgcagctttatatgcatcttcaaaagatgaatgattttgttcacataaatgaattatttcttcatttccacctgcaattgcatatttacctgtgttatctattttagaaccattcataagtaaatatttaaaacatttaactgaagaaaaaaatgctgcataatcaattaatgaaacattttcttgattaataaatgaacacctttcataaagtgatggttcaattgtttgattaaaatcaaagtttgtttgtgatgatatttcttgaagtttttccatatcatcatttcgaataatttttgctatttcatttggattatgtccttctttaatatattttttttcttcaattattttatttttcgttaatctttcgagaatataatttgattcttgtgtttcaaaattaaaaagaaaatctgtaaaaatattaattatattatcttcttctgtttcatttttgatatcattattttccttatataattcttcttcttttattttaaataattttatatattcaaaaattaattgtatattttgattttccattagaaaatatgaataaagtaattgacatattataagcttaatcgaatatgaatattgctgagttttaaaatgtaatgttgattcaactgtttctggaatattattttcattcattttgaagatatcgtcttctatttgttgcaatattcctataaaatctttattttttcctttaatttgaccttgactatttcccattaatctttgtcaattgcaaataggaaagtgcaaaaatatttttgaaatacgatccaaaattgaggagaaaacgaggatgctctgaaatatacaggtagaaatattcaaaaagttaatggaatataatattctctaatctaatcgattaaattttatagcatcatgtaattattttatattatcatgagaagggctttttattatttcagtcaatataaaatcgaatttccatgatctttttgcttttgttttattctttataaattttaaataaattaataattagtttttacaaacattttaaaaaacacatatatttatttatattaaatattatttctgcgcaaaatgtaccgatgacgagtgtcttaaacccaaaaactcgtgcatcgatgacaattttcttcttctttccgttgtcaccacatttaacagttcaggcttaaacaccaaattcttcggatgtatcaaaggtcccaattcgtttaacacttttttattggaattttcattaaagactattgacaatgaatttgggaaacttgcgtaaaatccatttgcctttaagctttttctttctctttttcttaatttctttttcactcctttcgcttgtgtaattttcttcatgctttcgatcatttcgtctcttgttgagaacgggataattttaattgacgaattatccatgaacaaaaagttcaaaacagattgatatgacttacaatcagttatattcgacgaagtattttttataggttttattaaattctttaaagatcgatttatgtctttaattgatcttaaacatttatcatcaaaatttatattcataaatgaagctatgtttggttgttttttacatattacttcaataaaagaatgagctttcggacatttaaagataaaacgcaaagaaaactgataaattttactcaaaggtattaataaattattattattttcgattttcacaaatattttcgatgatatatcgaatatgttatttaatatttgcgttgatgctttctcacacatattactgtaatgtgttaatacattacataaatcactctcagtcgattgctcaaatattacaaaagaacttggacacgaatgaaagttattcggaaacgaaatttttaaaggtaaaactattaacattaactcattaattttccataagtcgattaatttatcgaagaactcttgaataatattatccgattcgatataaggaatgaaaggcttaatcattggtatcacaaattcattcggaaattgttggtcaaatattatatttttatatatacttatgaagaaattcggcgatatatttatcgattgtgaaagaattttcgagtcgagaaatgacaaatggaattttaatgaaaaatcgaaagtaattttattataattcattatcaaataaaaaacttcaattaataaatcacttaataaagatatttcttgtgagttattctttaaatgataagaaaagatatttaatatataatttggaatattttcatcataaggataaaaaatatgattataaatatgtaatgaaattataactttctctaattcgggacaaccaaatacccaaatcaatgattcattaccccaatccctaacaacttgcgagttaactccaccaagtttttcgatgacttgatcaataattttatggaaattagctctcgggatggaaaagaaattaatttctaagtcgatgttatatatattcataataatatcaacaagtattttattagctttattccgaaataataaagtgaaatgtaaaatcgatggtaattcatttattatttctttaaatgtgtttttaagtattggtaaaaaattatataaccaatttatttcgggttcaattggttgtttcttaatttgcgttatgtaataataatatgaaaatgaaaaacgtgaaaataatcgtttagccatataaatcggattagttttagttatcgatgatattaataatgttttagtctcagtgtttttccaaaagtttataatgaaaacaggtaataaaacattatgatcaggatattgaatgagttctatccaaatagatgaaatattactaaaatattcgggctcaattaactcagtcatttccattaagttacataagaattgatatggagtaaaataattaaattctttaaatatgttttgtgtacattgataatgcattggtaataatcgaatatttttacaccaatgtattaatatatccaaaatatcttttattaagttattatgcgtattttttattatgttaaaagaagcagaaaaaatagattcagtagcaaatgaaaataatattgaaggagattgagttaaatcaataggttcatcatttatatacttattcattattaagaaattatataaattctctaaaaacgttttaggaatttgattattattatatataatatatatttctaatactaataatatgtgaccgaaatttgatataattaaatcttttgaattaaatgaaatccctttaattatcgatgatatatataacaatgaataaattgtcttttgagtaaaactattaatcaaataatgtttaaataaaacatcgaaattatatatcaataaattcgttaaaagtgtttttccttttaattctaactcagaaaaatatgataatgatacatcatcttcaacaattgcttctttaaatatttgacctttactaatgattaatactaaattcatttcaacttcatcacgtaatgtttgtaatgctttagattgcgttaaaccccaattaactaagaattgtaacattgtaccacgtgaattaacaggccaaacttcatcaggtataatattaagatatgaattaaatacgatgtatatgatttggcaataatcaagtaaaaatgttaaattatatattaaacatttctctttatcttcggtccaattttttatacgacgtaagttatttaatttcttttgcgttatataataatgtaatgaattaaaaaagtttataaagcgtggtgtattatgtttaaaaaatttcttttcgaaaatcggattttttattaaacttgctaaaatgtttgtgactttaggtattaaatcaattgataaattagaaaatatatcaattgttacacttaaaagtgagaaatttaaatgtgataatactgttaatgtagtattataaatcgattcattattcgatgttaataagttattaatagtattacaaaaaaattctcgattatcaatgaaatctttattaaaaggttcgaattgtttgaagtttttaatgaagttaaaatataatattgtaggtaaataatattgtgaatttattgtaagtaataataaccctatagatgtaggccttcttaattcatcacattttaatatttgttttataagattttcttttcgttcttgaaaaaaatttaatattggaacataattacaaaatataaccaaatcaaaaattcctgataaaaaatataaccatatatcataataatgagaaattaaagcgatttctaatgttattacactttgtggaattttttttattggctcaaaaacatttaaatgcgttttataatatattttaaactttactgatttctctaaagttttattattcgataatataaatgacattaaaccatttgaatttaataactcattaattttcattagaattgtataagctaatttccgtgttgaaggatacattgatgaaagacaacataacataaagaattcaagttcatgtaacatttttattgagaatatttctttagtatattttagtatataaaaaatcaatgataactttgtgaaaaaactttcaggtataatatctttacaagacaattttaataatatttccatataattagtaatatttggtaatttaattaatatatttttacatatatcataagacgtcgaagcaattttaatattatcatgattacaaagttttatcagtaatttaattaatttctttgatgaaaaatcatttatcgaaaatatgtattttaatgtcggaattaatttcccaattaatgtgaaattcttttcataatattcgttctttttatgctcaattaataattcactatattcatgaatatcccaatcgtctaaaatggttgatatcttttgatctgcttcttgtgatgttattgaagaaagtattaaattcgttgcttgtaaaaatatcggatttttattaactatatcattattattaaattcatttaaacatgatttaactttagtgtttaagattgagttaaattcattttgttgttctttagttactgtttgaaatgcatttttaataaaatcattcgaattaatttcgggtacaatagataataatgtaataaatcgtgaatcattattattaagttcaatgaatttcggtaatacattttttataaaataagtaaaatctaatcctgctaatacaattaagactattttaaaaatttttggtgaaatactaaaatctgatttaagaaaaaagctgctcatgaataatgaggtaaatgatcgtggatcttcttgtggaaattcaatgacagatctggacttaatataactaagtggtgatgaccgtggatttttgccccattcccaaaataaacaattgggatctgggttacgtgaatgataaactaaaaaaaagttgaaaattaaatttctgactttgagacgatcagaagcttgtgaaattattttctttttaaataaacgggttaattggggtgcccttttcggcaaccttgaaatcaataagtaacaaagtgttcttgaaaaatcagaaaaatttttctctcgttttagaggatggattaggttatagatttcttgaaaagtatcctcggaataaggaagagttaatagcataaatccaattgattctaagatttcattatttactgattttttctttagaagttgcttaaatgttgtcattatctgatcaaaaaatacagagccaaaaccactgtcacaatcaaaccgtataaatcgaaaaagaataaacggaactgtaaaatcatttgaggttgcaaataaagaaaagatttgtgatacagaagaaaaatccgtttcggaaatgatggaataaatgactgaccattgacgaattattttaattccaagatttggtaaataatgttgtgacgtagaaaagttataacccgcacgaagaacaaaacttgatgctttccctggaccatggtttgctataagatggcatgttaaatcagtaacaaaaaacatggcaaaataataaaataataaaacatgatgtcgattttgtggatcaaaactgggagatatcccttggatttcagaaaatggtgtgctatgtgaatcttttagaattcctttgatgacttttgataaatattgtaatgcttcatcacttccaaattcaaacatttctgtaatttcatcaatggctgatgcataaaatttcatctttcttggaaaatattcaaaaattgattcaagtatttcattatttgtttcttcaccaatttccgcttttttttcgaattccgctaaagcatatatcacatgtaggcctgaactttcaacatatcgcgaaaatattgctgcgaatatgttggttttattatcgttcatcaaagcaatagggtaccctattttttctttttttttcaagccatgtgatcagatttaaaaaaaatatatatattttatgtattgataaactttctttgtaggattcaaaatgtgagaaaatctttattgaaaatattgtaaatttattcaattcagatcgatgttttaatttataaatttaagaatatcttgttataactctaggcttttttgttacatgatccttttgacttagatctcaggagaaaatggagatagcaaactatctctaaaaatctttgaaaattgcccttttgattttagggcgcctcaaaatatgcttaaattcaatactttactaaatcaaaaaaatttcttcaaatggaacccttcgagaactcagaagaatggtttgaaaggatgttcggattcaaagagaaccttcaaagcgtcaatgaaaattttgaagttcatgaagaaggtggcttcgtttttctacgttctaaagttaatttggctaaatattgtgctggacatttcgaaatcagaaaactttcatcatttcaaagacttactcctcgaggcggtggtaagcttcatcttatcagaggtaatggaaccaaatcaaatcctttaaatcttgttgatgtaattgcagctgaagctaatccagataaccatggcgccacatttcaggtagcttccaattttaattgtcttgatcacgttcctcaaggaaatcatcgtcctccacaaggaacatgttctgaatattacaccagacttgtccaaggacctcctgctgatgttgcatgtggtcctgctcttctttaccgtcaatattttcttccacttccaaatggcaccattgggcaagtagatatcaataatgatctcaatcttctctcagaaactcctattccagtacatgacgggtatacttacattcctgaaagtctagctaaggatcctcaatttattcaatttgattgggaaaatcttgatcattatcccattggccttcacaccgaagtcgacgttactatggaccgcgcacctcatggaatgtttaagcttgttccaccgccccaaagagtgcatcaagtgttttgttcggcggttgcattcaataattacggttcgaaggatccgtttgtctatcgtattgcgtcttatattcttcgtgctgaatatcgggcaacaatcctcgcagcttgggagaattcactgaatttcccaggaagacctggatcgaataagtgcttcctaacattgattggaggcggagtttttctaacgccaatgcaaattgtcactgacgcaataaatgagtgtaaggatataatagtagcgtcgggtttggatgtttacattgtttgcttcgatgaaaaggtttatactaatgttcatgcatattgtggaaaaacagttgaagaaactggtggctcaattataagaggaaatctataaacgtttaatattagtgattatttattgaaaaatatttaaatttttaattttttatttatataattttaatcatggcttagaagaagacttaaattgtcattcaatggataaaagtttagacttttgagaatttcttctctggcttcctttaggttttttatatttgattttagtgtaattagatttaatatgtttaataaatattttgatatgttttcaatagaaagaactatttctcctggaaatggagaaaattcatctgaaatgcataaaacacgatatatcctataagaaaaaggtgtcaaaataagtgtaatcggaactttcttgatattataattgagatttaattttctttttgtttcattaaaaataattcttattggtggatctaatgattgtagcttctttaaatctttctctttatttaccattactaaagaaaatatataaccaaatccattaaaataaggtatcgttggaacaggttctttaaaattcggtaaatcatatttaatagacatttctttagaaatattcattggaacaccaatattttgaaggaagtataacatagcatttgtcattctatccatattattttgatcgttacatattgattgacataaatcaaggatatgaaccaattcaataggcgtaaaaatagtatcatcaacttcatcataactttttattattgattttacaaaatttgaatctttaataacccgaagctgaactttattatttgattctataaagcatgttgtagccaaaaattcatatattcttggtctaagataaggctctttatgatcaaacaaatcaacacaagattcaaatttcaaattacagaaattttctctaaattctttctcgggttctaataaatcttcagatgttagcgtttcaatatttgtaataaaattgtcttcttgatgtaaacatgatgattctttatattcatgtttttctgtctttatttcatctgataaacgaggttcaagttctccttttaaatcattttccaatatccaaacagattttccaaaataagcacgcgaaatcattacaagtgaacctttgccacttattttttgaatcatagtaactaatgtattatttacaaaataataacttatttgatctccaaaagcttcattctcttggataaattcttcatttattttttgatatttaccttttgcaaaaagaggcaaattgaaaattattttactttgtaatttgtcatataaagttcgaaggatttcaatttgattaatatcattttgctcatttctttcatttgaaggaaaagaacctttttgagtgtataatttatgatttattttagattgagatttagctaataataagatttttttattcattttaatttgataattatcaacaaaatttagaaaaactttcactttagtaaatgtttcttgtttagaaatatatgaaggaatatattccattaaagatattaacatgtgtaaagttacaattaatattttaataaaggatttttctttaatacggtcattcatttttattactgaatttaaaatatcgttatataaatgagaattatcattttgttctaaaaattttggatcaatacatatgaaagttccaacaaatgaaataaatttttcaattaaattgtaattataatcaactttgtaaataagatcacaattataaaagaaatcttgaatgcactttataacaattttcttatttactccagatgataataaaaaagataaaagaaaatattttgtttcatatgaattaataaaactccataattgtgatgcaatagaagtttgaacagtttcataattttcatttgatataccaagagttacagatgaagaaatgaaaaatgaaactaatgcattacaaaaaccattattttttcgatgtgtattttttggtcttttacttataaatttgaagaattttgagataaataacgaagagataaaatatgaaaaccctgaatcattatcatataatgaacttccatatctcaagaaaataacaattcctttggaatttaacattgttacaaggttagaaattaactttttaatatgttgatatgaattatcatttgaattccatgacaattctgttataattaatatgataagtttgatcttacgtaatatacatatttggaaatcttttgaatcattaaattttaaatatattattttaccaaaaagatttacatatgtttctaatggaaacttaactaacaataattttgaatgtttagctgcatgttttctaattattgttatagtatcaattaatgctttatatactaaattcaataaaataggtgatttttttaacattttaatatttaacatcaaatacatatgcttgtaaaaaagcattacatttgctttttcattttcttcagatttatcataagttgtatatatcatttttttaaaagagaataagaaatagtttttccatatctgcataaatgtagtattattaaaccaatttttggtaatttctataacttttatccatgttttatcattattacaaaaatatgctactttaaaataacattttattgatttatataacaatttattaataatattatgctcatttgatgatatttccaaaatatattctactatcccagttaacacataaaataatgtttcatttatttcatcattttgtcttcctcttttcaaacaaaactttgtgtaatcattaaggatatcaaataaaatttgataatattgatttggaatttctcctcttaaatcaaagttaaaaggtatcgacaactgtttaatcataagttttatatatttattttggcgattaatatttcctaagaatgaagtatctgataaccattcgctatatcttttctgagcaattgatatagtacgaaaatcagctggatttaatgataatccatatgcataaaattcaatcatcttaaaatatttgcttttagaatattttttatcatacttattatcaaggcatttaagaatttgcataatgggttttgatatttcttttatatcacttaaagaaagcatataatctttagaatcatctggaaataatcctaattcaagaaggattggatgaaaaaatggggaattattttctgttttcattgtatcataaataagattttgaacccaaataaatttaggttcaatttaatggtttttaattaaccataatttatattcaacacgaaattttgttttattatttatagctattaatgttcgctacttaaaaataaacatagttaattttaggtaagtaaacaattgttttccaccaaattctatttaaaatataataagtctaaatacttcttataaatgttaaaaaaaaatgaatatctgtatgaaacattgaaagaaaataataaaaaaaaaatgtaaaacatataacaatgtttttatcttgtattatgtatttaatgatgtagaaacgtattcatatttctccagatttgacaataaatttaaacgctcgtataaaatgaaaaagcagaaatttgaatgattatttaacggtgaccactcaaaagttttatcatttcaatgtcgggcacttccaaaaagaaaatccttgcaaacataaattctgttgttgaaaacgcaaaaaacgaagtaaaacattaccgtagggaagtcaagcatcttagaaaatttatggataacctgacaattatcgttgaacatgaatgtccagaatttacaccaaagatgactcaaatatcaggaaagttttataactccttagcttgtgaagaaaggtttatcaatgcatatgaaagattaagtgaggatttcaatgatattgctgaacgtttcaatgttctttaccgtgcatcaatggcatcaatcgatgcaaaaaaccactacaaacagcgtagcgcgaaatatgagaagcaaaaggaagaagttcgtattcttgcagaaaaaggatcttctaaacgaattaaagcagaagctgagcttgccaaaaacaaggagaagaaagacgccagccttgcagaagccattaagaaggaagaagaacttttagttgttcaagatcgtttcaccaaattcaaatgcagaagacttaaacatgcttacactttcttagcaaaagaaatgcgagccacaatgaagcagattctggaggactccaaagcaatcaggtcaatttgttctgataattcagtagcaccaaatgaacaaacaaatattcaaaatgaaccaacaaacacagttgtccaagaagagcaagcaccacaatacgcaacttatcaagaaccacccgctgaagttccaacatattcgcaaccaaatgttgtagaaaatccatatacatccattccgcaagaaccacaagaaacatatacaccatttgaaccacaagacacttacacatcttttgaaccacaacagcagcagacatatgaatcacgaccagaagaaacttacatgttcattccaacatttgactgaataaagtaaactagtcaaataaacgtgattttatgcaaacggtttcttcttcggtttttttttagactaaaaaccaaattattaaataatattttaattaatggctaatttcaaaatcatattcctaattgcaaacacaaaatatatgaacttatgtatattaatgtgtatgcaatggtaaaataatttttgcgtttgaagagttttttattattttattgtttattgtttagattttattaattcattaacttcctttgaaagatgtgcttcagctttaaggagatctttatattcgattccttcaagtgagagtaaatatttcaccatttcgacatcattattaaaagcagcaacatcaagagcagttaatccatcttcatttcttgcatttagatcaattcctttagcacttgaaatcaacttaacaatttccaaattctttgcttgagcagctccaattaaagcggtcattctaaatcatataaataaacacaatcaataagaaaataactttatccctaatattaacatcaattttttcacattcaagtaatgcttttgtagatttaggactactagaaacagcagcaagaattaaaggtgttctatcgaatgcatcttttctatttacgtcaacttctttgtttttaataagaagcttaattgctttatcttgatcattacaagaagcccaatgtaatggagttgcatcatatcaaaaaaagaaacttcaaatgaaatatataatttctatctttagcatttatttggatatttggacaattaagaagaacttccatagtttctatgtaaccttctttcgcagcgcaatgaagaggagtttcgaataacataaaaaaacaccatcaaaaaataaaatcaaaccaaatcagttatattcacatttatgtttgggatttttaataaaattctcaatgattctattgagttataagaagcagctagatgtaaaggagtccaaaatataatgaataaacataaaaagataatataaaacataaaattatatttataaacttcatctctatcttcaaaagggactttattatcaatgagaagcttaagaatttcgagattattaactttagcagcagcattcataagtcttcctgttaattttgtctgtttcaataagaaatcaaatgattttttacggaaaaactcaattgaagttatcatagcattttgtatgtctaattttgttttagaaattacatattgtaatagttcaatatttccacttattacagcaaagtctaatgacgaatgattttcttcatcaagcaaagataaatctgctccgtttttctctaaaacttttaaacattttattgaaccataaaacgctgcaattgatataagtgatggattaaaactaactactaatgatggaataattaatgttggttcaagtgtatcattaacatcaataacattttgatttattaatgtttgaagcatttcatcattatcattcataatacaatcgagaaaagttttacaaggaaaatctttcggaagattccatttggaattttgaatgtcaataatttgttgataataaagtttatataattcagcattctcatcaagtttaaaaccaagattaatgttatcaaatcgaagtttaagttcattcataataagatcaaactttgggaaagtagatagaacttttccataataaaaaatgggatataaatattgaataaattgtgcgttatcaagtttttcagaatgctcaaacatcaaataaaggtattcattggctttattaggagatagaaattgattttcaacaagatatacaaagaataagcatacttcttgttgatttggttcatgcattttattcaatatgaaatttaaaaataattgtttattttcagtgtcgtttaattgagggattttattgagaatcgatactaataacttgaagtgagtaggtcgagctggtataagttcaataaaggcttttgaaaaaatggagatattgctttgacttgaactaagttctttatttaattgttctattacatcatctgaattgttttcttctaagttactaataatcctttggatttccattaaggaattactttctgggtccattttgcggggaaaagtacgataaaaatctatggactgccccaaaattgacttaacggtttaaggaaaagtgtcccaaaagtgacggtggttgtggcctctccttttcttaagataatggccgaactccttttcattgcaccaatccaaaagaaggacccaaggaagccaacatggcacggaatcccacgtgttgctttaacacgcccagctgtcgctgctgaaatcgatccaattaaaccagaagaaatcccagttccagaaaggaaaacacgcgactccatccaaaatggtactgttgtcattatccttgatggtgagtttaagggtaagcgtggcgttgttttcgctgataacggaaaaggtgttgtcaaagtcaatggcccagctatcaaaccaattgaagttgaccaagatttcttaattgctacatccaccaaattggaaattggtaatgtcgatgaagctggatctgctgctgcaatcgaagttgctgcacaaaagattccagaaatgattgattaccttaaggccacattttcactcaaaccaggagatcgcccacaccttatgaaattctaaatcgtccttaattttggtgaattttttttaaaattttatctcatgttattatgcaatctaatttcaatcaatttattttgtgttagcaaccaaaaccacagaaattgttctttggaaaaagagatcgaaaagaaaaaaaatatttttttcttgaattagatactttttcatccaaaaatgttctttatcaatcaaatgaagcgttgtattgtttacttgatcggtataaaaataatattgcaattttagtgatagtactggaatagtttaataattgaaaataaataattgcattatagtttgtttcgtgtacacaataatagtaccacgcgacttgagctttttttataaattttgaagattgaaaaacgtattgaatcaaaaaacattcaacaaatcgtattttcgcattattgaaattggcattaaaatgatttgtgtaatatttgaaatctcaaagtttaaatctcaaactttggttaatatgtctgtttgatatgaattgataagtattatttcacttttgatagaaagcagttagaagtggcaaaaaaatttcattgagccactttttataattaacgtccgtaacagaaaatgggtggaggcggatcaagcttaaaacccgaaggaattccaaatgctgaagcacggagtttcttcatcgccacaatccctactcaaaagcaaataccggaaaaactcaaacgatataataagacatttaacaaagtcatgtatgattcacttaaaaaaaatcctgaaaaagacaataactttagtctaaccataacagggaaaggaacaggtcctatttttattgatttttattttcctgttcttcatattccacaaacactaacaaaactttctctccgaaaatgttcacttcaacaacaacattgcaaatccatatctaggctcttaatatcacttcctaatttacaacaatttgatgctggtgataatgattttggagattccattcaattaatcttcaactcagttgctggccacccttctcttacggcccttattcttgacaattgtcatatcccagaaaacgttactcagtccataattgatcttatcaatacatccaggaaaattgacacccttcgaatcacgaccacgaagtccacatccaaccaaaaacgcctatccactgcacttatgaacaatctctatctcaaaaacacgacaatcagtgatgatctcacttcgctttcggccaccaccaatgagcgcaacattgctgtttccaacatagtcgattccattgtccgctcaccgtttcagcgtcgtttccggtcgaagatcgaaagcttcaagtccatcaaaggccgcgaaatgctcataggaagagccggccagaaggagcgcatccgcgggacagctctttttgatgatcttgaggctgctgacaagcgcgcgaagaccatcgaaagccaagaaacgcatcaaaacaccgagttattccggagcggccaagctgacatgattgggcgccgacagacaatggaagatgtctccatcatattaatggatatgcctcggaaaggcgctgcattgtatgggttattcgatggtcatgggggccgtgaagccgccgaatttgcagctgcaaatctcccgaaagcaattagcgagcgattaaaggccactgcaaatgttgaggatgcatacgtcgcatcgttccgccaattacagatggacatgaagccatggtgcgtctatgttggcacgacttcagtgattgctgtcgttgaaggcacaacgctcacagtcgctaatgttggtgacacgcgctgcgtgttgtgcagagacggcaaagcagaaagactaacagtggaccataagcctgacttgcctgatgaagctgcgtacatacaatcgaaaggcggattcgtaaaagagggaagactcggaggaatgctcgcggtgtcaagagccctcggagactcgttcttgggagacgcggtcaacgctacgccttcatttagaacattggaattgaatgagaatgactcgtttttgattttggcgtgtgatggagtgtgggacgtaatgagtgatcaagaagcgtgcgatattgtggctgcagaaattgacccgctgaatgcagcaaaaaagttaagagatgcagcgttcgaattgaattcgcttgataatatatcggtaatagttgtgttccttgcggaggctttcgcacataaagaaaataataatggtgatgatgagtaaatatctttttatgaagaaaataaaagtgatttgatactgtttcattctgattatatataatgatttctttgtgaattcttaagcaataatagaaaggtaaaacaaaacgagtacgttttcgttatcttcttcaaataattatgttgcacattgtattacattgaatggaaaagaaatacaaattcctacagaaatatttatataaattaaaataggttcaaagattaaaagtctgcgggtgtaatttttttaaataatcgctaattccaaacgttatatcaaaaaatgaaataaaataaacaaaatattttatctttggtgttaatattaatacttttttgattaagaaataatttaactacatctacataaccattttcagcggaatacatcaaagcagtttttaacaatctgtacagattcgatgtacgagagatattctaacggattcagaatccaataaattaaatatttaatttgtcctgttttatataaaacttgatatatatatatgttacatatataaaataaaattaagatcaaataaagttaattttttagttattataataatttcgacaaaaaattatttatttttatcaattcctttttgttcaagaagtaatttaattatttctgaatgaccattttcagatgcaaacataagtgatgttttaagtattttaaataatttccaaatattatattcaaacataaaattataaaaataaattctaaataaaataaataaatatctttagcattaatatcgattccttcttgttcaagaagtaatttaactatttctgtatgaccttttgaagatgctttcataagtgctgtttgaaataatttatataatttccaaatattattttgaaatatcaaataaaacaaataaatatctttagcattaatatcaatttttttttgttcaagaagtaatttagctatttctgtatggccttttttagatgctataataagtgctgttctaaataatttaaataatttccaaatattattttgaaatatcaaattattataataaatataaaataaaacaaataaatatctttagcattaatatcaattcctttttgttcaagaagtaatttaactatttctttataaccatttttagatgcataaataagtgctgtttgaaataatttaaataatttccgaataaaattttgtaattttaaattattataataaatataaaataaaacaaataaatatctttagcattaatatcgattccttcttgttcaagaagtaatttaactatttctgtataaccatttttagatgctaaaataagtgcagtatataatatttttattatattcggaataattttttaaatcatcaaattctgtaaataaataagtaaaaaattaaaaatacatcttttgcattgatatttatttcgttatgtaaaagaataaatttaacaagttctgtattatcagaggataatgaaaacaccaaaatattttttggaatttgattcttttctataaaatgtttaacaagatataaatttcccatttttgccgtttcatttatgatagaattatcaatttgagtttcattttctaaaaaaaaaagaatttcaaaattactacttttaatgcaaatatcaatcattttgttataatcattttgttgtaattcatctgaattgctattattttcataaagatatttaaatatatcatttttatggtatttaattgctgcttcatatgcatcttcaaatgatgaatgattttgttcacataaatgaattatttcttcatttccacctgcaattgcatatttacctgtgttatctaattttgctccattcataagtaaatatttaaaacatttaactgaagaaaaaaatgctgcataatctattaataaaacattttcttgattaataaatgaacacctttcataaggtgatggctcaattatttgattaaaatcaaattttggttgtgatgatatttcttgaagtttttctatatcatcatttctaattatttttgcaatttcattcggattaactccttctttaacacatttcttatgatttataaaatcttttcttgaaagacaattaaaaaaatcttttttatatattgcaaaaaatccagattgggtatttatatcaaaatttgtaaattcaattaaattttcccttatcattttttctagaagaaaatatgcttcctgtgttttaagcttaaaaacatatttaccaaagatatcaaaaattcccaaatttttattattgatatcttcttctttagatttaatttcttttaaataagtaaaataaatattatattcgttccttcgtgaagaaaacgcagcatatactataatgcaaatggagttattaaatgaatatggaaagtttgaatcaaataagtctattgattgttgaactgatgagctgatattattttcatttatattaaaaattatattttttaatgacattagcagttgaatggaattatccttaggatcatttgtttgatcttccaaagaattaattgtttgcaggactccaaaattttgctcattttccctcattgagtaaaatttctataactgttttctcacaaaatattgaacagaaagtgacgttttataaaacatttatcaataattattgataaacacccagtaaaaattaaaagcatcaatctataaattttgtaggaaaacagaaaaaatgagatcgatgatttagtttcattagaccctattttttaagaaatctatagattcgttaactagtgtgaaaaaacattctagatgttcacaaacacccctactttagggtgcggtgagtggagtacacttttttatgaagatttttttttaatttgaaacgcatttttaatttttctcaaaattggtcaatagaatttcttagatattctcaccactgtacttcacaacatgaattatatgaatttttgtctgtttaatttttaaaaaaattccaatctttcttttgaaagcaattatccgtgcaaaatgattaaaattttctcaaatgaaaaaaaaagacatttatttgatgttgaatccaacccaacaatttgatttacaaacgccctgaaatttatatatatgcttcctataaaacgcttttgataatcttcgcataagtttcgcgcttaaactgcggccacaaagatgttaggtcatcatgaagggaatcaacagtagaaaacctctgcatatctttatcacctaaaaaaacagcgccgaatgaactttaataaggatcttcttccattttctgtagaataaaatcaatcaatgatttttcatttcgaagtttaagttgatcattccctaatattaatagccattgtgataacggtatgttttgtgttttaatttgttcaaaatttgttgcaccaaacccaatatctttatcaaagtttatcgataaactttgttatcgataacaatgatttgattttaattaaatctgttagagtatcacaatgaggctctggtatatcaaaagagataagggcgaatttattaaaactcttcaaaatgtttaagattgatcatttgaattgacacttattgtttttccgtgtaaaagcatttctaacttctgaagtgttttatctgtcatttcttcatcaagaaacaaactttttgcatttggatttttagacttaagacttgaaacaataggtgataagagttcagcaagcaatcaggatcatgcaaaattcaaaattatttacattaatgaagttgatgtacgagtaacgttatgtctatttttgtttgtgatggttcattttaatttttcgtaaaacattcaaaacatatgtaaagtattcaacaacgtttttgatttcaaaggaattttctggctgaggattttcaaccaaaaaatttgtcggagcattttgaaatttctgctattaattgaattcaataatcctgtttaaataagagaattgtgaactgtacgaaactatttctagaagcggatcttcaggttggttttcttcttcgacttttatttcgtcctcgatcattttacaaatattattaattagttgcatgagaagaattaattaaaatcacaagttgatcaaatatctattctaattcaatgctgatgtctattgattaattgtctaaaatcatcagcattcctgaatgaaatttgttggaaaacagaaaaatgcacgttaaaaatacgttaaacagcataactatttctctccaaacaccctgtcaaaacttcccataaaatgagacgtggttaattaaacgtctctcattcaattatcgggtctgacaaaattagatcgattacaaaattactaatatctcatggacttatctttatataaaccatttatgatatttaacacgttaatttcaactcaacatataaatatttatattctaaagatgagaaatatcaagaaaaaatagtttcatttatttgaatgcactattgaaaaaacggaaaaccgttttctcagtttcttgatatggcggtagcatatggtggaatgaaattaggaaatcaaaatgggaagcttaacaattcgacccaagctgtttccaacacgggaattattgataacgcttcaaatgatccaattattaatattcatgtttcatgtaaagatataatcaaacttgatgttggtagcccatcagatccaatggttgtcatgtttgttccaatcaatggtaaatattgtgaagttgcacgtactgaagttgtatgggatgatccaaatccatcctttgtcaagtttttccaagctctttatattttcgagactcaacaacctcttcgttttaatgtttatgattgtgattccgagaatgctcctcttgaaagacatgatttcattggttatgcagatacagatgttcaaactcttgttagtgcaggtgcaaacgaaataaaacttgagcttaaacataacacagccaagaacaagcgtggtactcttattcttacctgcgaacaagcatctgcaagtaattctgtatgtaacatgaccattgcatgttctgatcttcgtaagatgagaaccttttccaagaactggccatatgtccaaatttccaagccaagtgaaagcggcaaattattaccaatttaccgatctgaagttgtacccaagacatacaaatgcacattcaaaccaatccaaataccactccaagtcctctgcaatggcgacaccaatgttcctgttacgatatcaatcatggatcataagcgaagtcatgctgatgacttagttggtagtgttacaatgagtctccagacctttataaatggaggcaacagttcctataccattgaaaacaacaaacgaaggaagatgggcaacatcagatttttgacaatcaatgtcattaagaagccaacgttctacgattacatccgtagtggtctccagctcaatttaatcacagctattgattacacagcatcaaatatgagtccaacagatccacgatcattacattatctctcaccgaatggcctcaatcaatacgaatcgtgcatctggtccattggttctgtagtttgtccatatgacagtgatcaaatgttcccagtatttggatttggaggcaaaatcaatggcgttgtttcacattgtttcccattgacatttgatcccaacaatccgaacgtccaaggcctcgagggcatttcgatggcttataagaactcattacgcatggtacaattaagtggtccgacattatttgcgccaataatccacgcggcaacaggcgtcgcgaggacgtcattcgatgagtcgcacacttataccattttgatgattttgaccgatggcatcatcaatgatatgcccgaaactatcgacgcaatagtcgaagcatcggacgcacctctgagcataataatcatcggcgtcggatgcgctaacttcgacgcaatggacgtcctcgacgctgacgatcacccgctgaggtcgaggaacggcgtcatgatgaagagagacattgtgcagttcgtgccgttcaataagttcgcggcgaacaacggaatgggacttgcgcaggaggtactcgctgaggtgccgcgacaagtggaccagttctgttcggcacatggatttatacctcaaatttaataaaatttttgatgtgaaaatacttctgagtgcgaatgggttcaattgtttgtgagcagaaatgagtaattatgttaacgacagcgcgaagaaaactattgttgagcagtgatagatgtaccatctcaacaaatgttttgagtgataaatctatttttagtttctacatcaataagacaataaattgttttcagttcgaagatttcagtcgattcagattaaagcgttaaatgaagatatgattttttatataaagtggttgaagaatgattttatatacacttcagtttttgaatatgaatccgatgatttttcattcatttgattatatcgtttggaaacctttctgcaaccactttatagtaaaatcgtatttgaaattagtacgactgcactttttgcaaaaattcaattaaaatatgcaactagacgaatatactttaaagtgataattagtaaagcaaataaaaaacattttgaattaaattattagtatcgaacttaagtaaaattaaattaagaaaaacggtcattacaaagattgcttacgatcaaaaacgattcaaatataatcaaaaaaccagaacaaatggttatatttgtttttatccatttagctatatctgaaccttcaagtaattttgtttttttccaatcttttgaaaatggcgattggaataataagttcgtatcaacaaaattaccaaattataaaggtgaatgggaatcacttgaaacaaaacaacctcaaatgttcaatggtgaaaaaatgctttttataacatcaaaaggaagacaccattatggaatatcagcaagtattaaaccagcaattaaaatcgacaatgaaccattaatcattcagtatgaaatactacttacagaaggaatcatgtgtacagatttaggtattaaagtattcggtccaaattttgatcctttaaatctttctgaaaaaacaccatacttaattaaattcggaccagaggtttgtggaaaaaactccaaagtgtatttttcattctatcatttgaatcctctcaatggctcattcgaagaaaaaaagataaaatatccacccacatttcttcctgataagcacaatcatctttatacccttatgatatttccaaataacacattcaacattttaattgatcagactcttcttcgtactggcagtcttcttaaagacttcgcacctcctgtgaacccgcctgaattcatcaacgatccgaacgatcaaaaaccgccagagtgggatgaccgtttaaaaattcctgatcctcaagatcagaaacctgatgattgggatgaaagccaacctccaatgattcccgacccagagcatgttagtccacctgaagggtggcttgttggtgaaccattaatggttccaactgaaaaacctgctgagtggaatgatgaactttttggtaaatggacaccatcatatattccaaatcctaagtgtaacattggatgtggagaatacaagccaccaatgatttccaatcctctttatcgaggaaagtggattccaaaaatgattccaaatccaaactaccaaggtccttacaaaccacgcaaggttcccaatccacagtatttctgtgacagtgagccatataaatttggtccaattactggtattggattcgagatggaatcaattgatggtggttctattggttttaataatataatggtttcaacaaatgaggttgattcttacagatggacccatgatgtatttcttaaaagacaaaaacgtagaatttggacgataagaattcatcgcttctttggtctcattcgtaatagtggtattgtaacatcttttttcgacttgattaaagtgaccaaaggagcatggaatggtttattccgtctttatccatacactacattcttttctacaattgcaattattgttattccaatagttgtactattgatagcgtatctccagaagaatgatgacgaaattttcggtattgatgaggaagaattgaaacgacaaaatgagcggatgttgttaagaatccaagaaaagtacaaaaaagattgatagttatcagtatttgtgtttattttaataaagagatataccttaaaagcaatcgattgcaaattattttgaattttgtttgttggtgaattgaatcaaaaacgatcgttgtggaactttttctatggattactgtaaatgaaccagagaaaactttccttgcattgtagatttgcttttattggtgatagtggcgttggcaaaacagcactgctatacacccattttagcaataattttcaagatgaatataacccaaattgtttcttgggtactccttgcaatttcatgtatgaggggcataatatcttacttgatattatggaagttaacaacgatgaagcagtcatgaaattgctccctattacattcgttgatattgatgtttttattatttgtttttctcttgtttgtcagaattctttttccaatatcaaaaattattggattgaaaaaatcaacaaatattgcccaggtagaccaattattttggttggaacgaagtgtgatcttagggataaagaagataacataaaaagcgaaatgatacaaacaaatcaaatcgaagaaatgaaagaccaaattggtgcacttaaatatattgaatgttcggcaaaagagcgtcataacttgaacgaagttatgacatcagcacttgacattgttgtttctgaagattatgaatctccacaagatgcctataagcggctccatccaaagaaatgttatataagttaaaaaatattatttcattagatataattccagaaataatattttccaaataaaaaatttttatttctttgttttcatagcatattatcgatttaagattcaatatatatatatacataaaatcattaaaatggtgatccaattaacttcatttttaattaattaacgcgtttttttgctaatctagattaaaaggaaaaatgaaaggcaattcaccatcttattgattatgaccataataaaatatttttcatttgttttgacttcattacaaacgaaggtgatgactcaataacaacactattttcaacaatcttatgatgaaaagttttaaatgcacttaaatcaagaaattttaaatttgtgcaaacgcaggaaggcctaacacaaaatggatatattggggttggtatgtgggtttgaatcgaaatgagaaattatcacgttttggaaccatgctttctggtttgaaataaatccttctaaccgcaaatgcgtacctttaaagttagatatttttgaaagaaaatgtaaatataatgacaatttgtctaatttcaaattgatgatttaggattaaggttagactgtagtcctttcttatacatttggagtgaaattttgttatttgttcatcgtgtatagatcgtaaaatttatatatatacaatttcagatattattaataataatggaaaaagattccaaaattccaagcaccctagcgatgggtgactgcaagcaaccagaagaagaaaatgtattttttgaaaaagatgttcataaaatatttatagatggaaaatttaaatattaagtttattgtgatgttgatgaattgtttggctacaaagaaatttgtgttgcttgtgcgaaacatattaaaggtttatgaaatcaaggaatcatatcgaccgaaaatcaagtcatggtggaatatttataacaagccaaatgatcaacttcacaaccaatgcattattttagaaaaatgcaaaacttaaaatttccattttctttatactcagcaagatttttttggaatccctaaaaaaatccataaaggatgggttccaaattggatatttttgaatttagtatcctctagatgatacttcccacattttggtccctcaaattttgattccatttaggacaaccctttactaccaaggtgtgttcatcatatgttagttgcttattctaaaagtttttaagttaataagactttcatatttaacgattatgaatagatttgatataatcactttcagcctttgcacttaccacatatgaaattcagacatcttatctattatgtctattcctttatcaattgggactcaaacgtaataatttattgtaattattttcgtaaatgataaaacaattctcagcaacaaataggtaattcaaattatcattaaaatataatatttatattttctgttttaaaacagaaattcatgtttttttattttgaaagtgttggccaaaccagcgtggggacagaccgtttaaatacgttaagcttaaccggattcgattacaacttcaataaagtgtcagttttttttcttaaaaaacatgttttaaatcaatagtttatttcgctaattgtatcgtctcctcttaaaattgataagtgctttgagtgctgtatttctgtggttgatcggagtaaacttcataaatttgattatatcagtcaaaaagcttactttaggatgagtgaaaagaagcccaaactggttgttgcaggagatggaggtgttgggaaaacatctatcatcgtcagatacacaaaggatcaattttcagaaggctatgagccaactcttgaggataattatcatgctaaaattgagttagaaaataaagaagtactagagatagaaatagcagacacagctggacaagaggattacaaagcacttcgtgataagtttatggctgaaggtgacgcatttcttattgtttatagtatcattgacgcacgttcaatacagatggctgatacactacttgagcaaatatcagtccttcatgaaggcgatgacttcaaattcgtccttgcaggaaataaatgtgataaagaatctaaacgacaagtaactcaagaagaaggtcaagaccttgccaaaaaatatcatggtgtatttctagaaacatcggctttatcagcaattaacattcaagaagtatttcaacaaataggaaagatgcttacagcaccacccaaggagccagaagctccaaaggctgaaggttcatgctgtgttattgagtaaattgctggtcttttacagtattttaatattttttcttttggaatcaacaaatgcaatatttttttattttgaaagtttcacaattttttgtttatacgttgctttttctttgttaatgatattaaatattcatcatttattggatgttgcatgatcattgttttcatggaattccaaaaattataaatattcaacttctatcattttttatgcaacacacagtgattcgcccggattattagagctccttaaaagtaaaaatatgatttttactgaacattacaatttgtcattaaatttcattgtgacgaaatattagttgattaacaacttagacaaaacatgaaaagatttaatattagatgctgtaatatctaataatgaaacaaatttcaatttggttttttaatttccactttgaccacaactttgttttataaaactcaaagtgatttctccattcgatatggacatccacacatttaataagttttaggtgaaagattaaaaaaaaaataacgcagccgtttttactaagcatcaattaaatatttgcgaagaaattgttttctttgaaatcatctacaaatggatcttcatcaatgttcgataaattgacagtgaagttgttcattgaaatgttgtcactattgttgttcatgttttcatcaacaacactttcttcatcacttagttttttgtttcgaatacgaacaagtattacaacaagtatcgaaatgattataataactgcgacgccaacacaaactccgatgataatttgatttatattattttgttcttcatttgtgtcatcactttggttttgaagaactgtataaaaacctgaataatatgaaaaacatgatgaatattgaataaatgtatactcgtaataaataaatattgtatttatataataagtcgatgaaccaaacatagaaatagttatagtatctgtaaatgtaagtttaggcgtaatcgtttgtgttaatgtttgtgtgataattattgtgcgattatatgtttcgccgattttttttgaagctgtaaatgaattcgatgaagtaaatgtgttcgaattcgtaaatttatttgattgagaaaatgaatttgattttgtaaatgaatccgattgagtgaatgaattcgattgagtaaatgtgtttgaaaatgtatttgattctgtgaatgtgtgtgtcggccatggatattgttcgcattcttctgttggtgttccaagtgatactccaagcgttccgaaattcgaggaactatataaatctgatgtcataacagatttcgcttttatgccataaaatgcattggaattaatcgttggggattgataaccagtgaaataaatacatgtaagatttgtgcagtatccaaatgcgtaagttccaatcgaattaactgtatccggaattgtaatatttaataatgatgaacatgatcgaaaagcagaacttccaatcgaagtaatttttccttcaataatgactgtttctaatgctgtacatgaataaaatgtataactttgaattgaagtaaccaaatttggaattgtaatatttgttaattttgaacatgaataaaatgtataagttccaatcgaagtaatttttccttcaataataactgtttctaatgctatacatgactgaaatgtataactttgaattgaagtaaccaaatttggaattgtaatacttgttaattttgaacatgaataaaatgcataacttccaattgaagttactgtttctggaattgtaatacttgttaattttgaacatgaataaaatgcatatgtgccaatcaaattaactgtattcggaattgtaatacttgttaataatgaacatcgataaaatgaataatcatcaattgttgtaatcgtatttggtatttcaaatgtcgtatctgaaattactggtggacaacatataattattgttaatcctttatcataaagaacaccattatttccattacaataatatttattttcttctgatacttgaataaattcaagtttcgtacatcctgaaaaaatacccgttcctattgaactgacagattttggaattgtaatatttgttaatgatgtgcatgtttgaaattcataatttccaattgttgttacattttctccaataataactgtttctaattttgagcatgaataaaatgcataactttgaattgaagtaactgaatttggaattgtaatatttgttaatgatgaacatgatcgaaatgcataagttccaattgttgttacattttctccaataataactgtttctaattttgagcatgaataaaatgtataactttgaattgaagtaactgaatttgtaattgtaatacttgttaatgatgagcatgaataaaatgcataactttgaattgcggtaactgaatcccaaattttaatattagtcaaagatgtgcatgatcgaaatgcactatttcaaattattgtaacattattgccaatcattattgatttaagatcgaacaataagcaaatgcataatttccaattgatataactgaatccccaatttcaactgaaattaatgatgtccaactataaaaactatttgtatttaatatttcaacacctctaattattattaagctgtgtttgacttttatatgtatttctccctgaatattcactagaattagtaatagttagcattttggttgttgaatcatatgtttcattcgtttgaatgaaaaaagaaatatgaaaaaaaaaacaattttggtcgtattatttgtcttcttataattttgtaaaaaaaaatagtgataaataaagtatcatataaatcaaaaacaatgaaatcatattaaattcaataagatataaatttatctgcataaaatctgataaaatatttcggaatttattaaataataatgatttttcattgtaagatgatataattttacttataggtatcgcaaatggagatggttttaataacaaatagttcgaaataattacatttttttggtgatcgtattgctttgtattcgaaaaaaaatctgaataaaaattggaatagaataattcattacgatcattcactttttttggtcgctgaatatggtttatttaaaatgattttcggataagatataagtgtatttttgaaattatcgtcatagacattctgagtcaattctgtttgcaatagtatgtcggaagaatgatataatatattatgagtttcctgaaaacgacaaagagatgagaaacatgtctgatatatttgcgtatttttttcagggtgttgctgcggtttgaaattttttttgtgtttaaatttgtatatatgtggtattttgtttagcagtcattgaattaaaccgcctcttttttttgatttcgatgtcatgtaaacttggtttcgaaacagacattccactcaaattgtggtagatactgtttgaattgtttataaggatgtagataattatcgaaaacaactcagttactaaaacgaaacccattctaagcaaaacgaaaaaacgaatctttaacattagatgtttgctaaacttaaacaatataatgataaagaaaatgctatagaaactgcaaatactaacaaaggaaacacatttttttgacggggctcttaaaggttgattaatatgtttaataatcttggaacttttgttgctttaggcctcacatgaatgtaatgtgtcatgtgtcatgaatgtaatgtgaggcctaaagcaacatttgtcaatgggaagcccttatattttgtacgtttaagattattttttgtcgattttgaataaataattgaaatttctgagaaatccgtttttttacttttttggatggttcgtgaaattgttcacctccaagcaggccaatgcggaaaccaaatcggtgccaagttctgggaagttatctcagatgaacatggtattgatcctactggttcattccatggcgatagtgatcttcaattagaaagaatcaacgtttattataatgaagctactggcggcaaatatgttccacgtgctgtccttgtagatcttgaaccaggcactatggatgcagttcgtgctggtcaatatggtcaattgttccgaccagataacttcgttttcggtcaatctggtgctggtaacaactgggctaaaggttattacactgaaggtcaagaacttgccgaatctattcttgatgttgttcgtaaagaagccgaatcttgtgatgcccttcaaggattccaacttgttcactctcttggtggtggcactggctcaggccttggtactcttcttcttaacaaacttcgtgaagaatatccagatcgtattctttccacatattccattgttccatcaccaaaggtttctgataccgttgtcgaaccatacaactgcactctttctgttcaccaacttgttgaatctgctgatgaagttttctgcattgataacgaagccctttatgacatttgcttccgtaccttaaagctcaccacacccacatatggtgatcttaaccatctcgtatcaatggttatgtccggtacaacatgctcattaagattcccaggtcaactcaactctgatcttcgtaagcttgcagttaaccttgtcccattcccgcgtcttcacttcttcatcgtaggcttcgctccactcacatcccgcggctcacaacaatatcgcgcgttaacggtccccgaacttacatcacaattattcgataacaagaacatgatggccgcctgcgacccacgccgtggtgtttacttaactgtttccgcacatttccgtggaagaatgtcatccaaagaagttgatgagcaaatgcttaacatccaagcgcgtaacacgtcgtacttcgtcgaatggattccaaacaacgtgaagagctccatctgcgatatcccaccacgaggtcttaagatggcagcaacattcattggcaacacaaccgcattcagagaattgttcacacgcgtcgactcacagttccaaaagatgtacgctcgaagagctttcatccattggtacgtaaacgaaggactcgaaacagtcgaattcgatgaggcgagatcgaacatgaccgacttgatacaggagtacgaaatgtacgaaacagttggaattgacgaagtaggcgaagaagaggaagaaggcgaaggcgaaggagaagcaatggaagactaaatgaatgaaataaactgaaatttgaatgaaatgttacttacagctgaagttctgcaatggaaaaaaatttgcagcgaatgttttacttcattttaagtgatatatatgacgaagtattttaggactgactacagaagacatgttattatttgctgtgtgaaaagaaatgttgataaggttttgggagaaaagttatatcattaggaactgaaaggtaaaaggttaagtaaatagttttgcattcatgattcattcgaatacatgaaggcattttacaattttttgagaaatatgttatttactaaattaaaagtgcattgttaaactaaagatgaactcggtttccatcaaattattataaatgtgaataaaatattttttttttgtatttgtttatatatattttttagagacagttaatcggtacaaggtgatgaaattacaggaactgttatatcctcgtcactagaatggtcagaccagaatcttggcaattgttccgtagctggaccgcctcgaggtggcggtgaaatagttgtccaacttggcggtgttgtaggaagatcagaaactgacgaagcatttacaaatcttttgatgatatttcgataacaaaaaaccgtaccctccactttgctaaagaactggtctttcatccttgcattttcattagacaatgcttgaggtaatgaaaatttctttgttttctttttgaaactagattttgatgctcttttctttttcgattctggttgatctcttacgtatatatgtgcattatcttcaataccgaaccacttaaaagtaaaagatggaattagttgaatgtttttatagtaaaattgatgatttccagatggaagatatggttcaatttcagtgattgtagaatgtgaattgacaactactgatatcgggtcaccatttccataatgcaaatgaagtgtgtatgtttccatttgtagaaatttgcgaatccaattttggaatttgttttgcggttatgctggggttaaaattaaaatttgatatgtgcattgaattttgcttgttcgattcaaaaacgctattgaaaaagttacatccggatatttgaattgttgtaaatattttagggttaatttgcaggaagaaacttaaaaaaaaaggataactaaagagaatttgataatgataaaaaatttattgctttattgaggcactaaggtgctatatttgttttattaaaatgaaacaatatttttgcctcatataatgagaaatgaacctcgttttcattttttatgattaatgatatgatattagtgtagattctttaatagaaaaaatgcttttgaaaaaaatatagtttttcaaacaaattgtgaaatattcattttttatgaataacttcgcatataagtacataaatagttcgataacagtttattggcattgttggaatacttgattagaaaaattgttttctgttggacgttggaaaatttcatagtcttgcaatatttgctgaatctcctgacatgatccataaaactgctcttgcaattgaagcaatgtttgttttaattgatcaagagggagattcaccaatattttcaaatcaggaatattaatttgcataggtttcattggaagattatttgatttcctatatgcccgctttttctttgctctttcgtagctgtattcagggttgttggttttaaatttttgttgctctattttagctttatttttataagggagcctgctttcttcgctcattgctttccataggtctgctagaattttggaagcttcaatgtttgatgcgtctggattttgttctcgtatttttgctcgattttcgatacaatatagaagaaatgcatttggcggccgctttaacttattgttctcagtggcgtttcccccttgaggtgggattgatgtgttttcgaattgagacatagcttgaagttggagttcactgagttcttccatggcgcttttttttgaataaacgttccctttattgtaattaacgtactttttcaaactgcagttttttgtgtaaaccttattgaattatttaggtacacttagcctaagtgaagaatttgtttaattaatagttaaaaaagaaatgaaattaatatcttcaaatattcatcagaagtctggtttactatttgttttttcctttagaatatggatgatgcatataaaatacattaaataaaattttttaatattaatatatatttccaaaaaaatcttaattctttatttatttcatttaaaaatgaactttggtttcatatttatgtgtcaaatcaagaaatcacaattaaattcttatttttcatgattttttttcaagttgttgatgatagttacgaactttcaaagaatggttgggaactttttaagaaatatattgaagaagatggcaattataatttaaaacataataaatagcgcagtaatcataattttttgctggacggttattgtgggatcattttcaacataaaaaatggcccaccccaaattccaatgagtttggctgatccctgccaaattcaacctttcgatattattaataactaccgtgtaataaaaataattgcaaatggaggatttgggtctgtttttttcgttcgagaaattggaactaatcaaccatatgcaatgaaaatcgaaaaacctaaaagaagaacatctcaatttgacattgaatattcaatccttaggcaaattcaaggcagtctttattttcccaagctttattcacatggcacatttgggcagaataattacattgtaatggaattactcggaccatctctttccagagtcaaagcttttttacctaatggtaaattctctgtttccaccacgataaggctaggaatggaaatggtttgtatgcttcgtgaattccatgcgcgcggttttgttcatcgtgatgtcaaacctcagaattttcttgttcgtctcaaaaatcccactccactttgtcttattgattttggtcttgccaaaagatttattgatccagtcacaggcaaaccacatcaacagtcctcagtttcatgcttcattggaacgtgtaaatactcctcacttaacgcacacaaaaaagttgatcttggtccacgtgatgatatgatatcatggtttcatacaatgattgaaatgctcgatggggaacttccatggagtaatgttcatgataaagacagtgtgatggagatgaaagaggcaattactcctttagaactcacgaaaaacgctccaaaagaatttgagaacattattttgtcacttttgcagctaaattacgaagatatgcccgattacgacatgattctgctagaattaagtcaagcactaaggggcattggaaaagaggcttcagatccatatgattgggagaagttaagtgagtttgagctaaattcaatcttccaatatccaacaagaagaggaagtgatgtatatgactataaccagtcacatacagtaatgccaatgagatcgtcaaaagaagaaactaatgagatatttttactgggtggagatgatgatagaggaaaatgttgtttcgattgttgcggtgttgaataaatgtttttatgtttgtatcaattaggtgacattaaaaagagacacaatacacaatgtgagattaattcattaaaaattgtttttattttaaaatgaaaatttcactcaaacttactcaagaatcaaatcttatcgaaatcgttatcaccatttttagttgacacaaaattattcttgaaattcctgtaatttagtgtcttattttacatcttgaaacagttaatgaaaacttttctgaaaatgcaaattcaacaaaaaattattcgatttaattccaaatcctcatgaaactatttcacaataacattttgtaagatgatttcaaaataaaatatttgcagcgaataacgttttataaaactttgactttgggagtttctctttcgacgaaattctcgaacttgcttattggcattccgagtccgattgctgcaccgattttgccatcgattccgagttccttttcaagttgtcccttattcataaagatggccgaacacatatagcccaaatagaactgtgccacgcctaagctctcagccatcaatgatgcgttttggtatgacatgttttggtgtgcaattgtaaatgtatcatttgcctttgagtggaaaagaatgacagactttgttcttctaaggactacatcgttgcctttcttatattcttcgataacatgttgtaattttggaagactttggaaggaatcaggattgataattttgagaataggcttgaggataggattagtcaatttgtcaacgaccttttggaattcagaaatcgtgaattcggtaagaacttttaatttttcttttgaagaaacaattgtgtattcaacatcatcaatgtttcttgctgttggcgcataacgagcagcttcaatgatcttgtccaaatactcttgaggtattggcttgtcggacattaatctattggaacgacgtttcttaattaaattgaatgttgcttctggagttggacatttctcaaagttgattggctttattttctcgggtgggaagagtgaatgttgaagggcatgagttggacaaattgcagcacaatggccacatccaatacagctatcaagattattaactttaatgttctttgacttgtcaaaagagagtattaaacatgggcatgcaagaacacatcttccacattttatacattcctttcctattgtaatgctcgttgctggcttcattagctaaaagtgggccggcggttatctgatcaggcaattgaaaaattgtgtaacaataacagtttttacataattcagaacacgttgaacgttgcgttcaaaaattacgatttttgttatgtttacaaacggaaattcaattgttttttttcctgaaaaactaattacgttcgatcaactttcttgcatataattgtatttttatccttcgtttagcatgtatttttctttgaaagtacatttgtttataataatttttaataattatattttttggttaaattgaagaaatttaattaaatgtttttttcgaacaattatgtttttttaaatgtcgaataaatctagaacctatgttaacatattaacaaatgaaaaaaagaatttttgccgttggaattgaactgatttcaaggattttaacagacgacttttcgaccgtttaattgaatttccattccgaaaaaaatctcaactcaatggcacaaaaacaatgcaacagtatcgaagaactttcagccgaattttccaaatatgttattacattggatcaatttgagataggaaagaaaataggtcaaggaggatttagtaaagtatatgtcggacttaataagaaaactggccaactatgtgcactcaagattttaaactacaaaaaccttcatcacgatcgcatgatgctatttgatcgtgaaatacgaattcttgctcttgctaataatcgatttgtacttgattttattggtttcaccaccacagttccatatgcaattgttactgaatacattccaaatggatgtttatatgacatattacattcacataaatccgaaaaagttcttacaggaactgaaaagacaattatagccataggcatagcttgtggtgtccaaacgctcaacaaactagggattattcatcgagatttaaagtctcttaacatattacttgattcgaattatggtcccaaaatctgtgattttggactttctcgatttcaccaagaaaacaagaatgattacatgaccaccaatgttggtactgttcattggatggctcctgaactatttgtatccagctcatatgattataaagttgatgtctatgcttacgggatactattatgggaattacttactggtcatatgccgttccacgacatgaaacctatgcaagttgcgtacgccgtatgcaaggaaaataaacggccgaaaatcccatcaaagactccgccatctctacgcgacttgatcacttcttgttgggaccaaaacccatccaagcgtccatcatttaagaaaatccttaaaaccttcaaacatcataaagccaaatttcctgatactaatgatgatgtcattacccaattatttcatgacattaaaagcaaaaccattcccacgtttaagaaatatcaacatttaccagtacaatttcaaaacaaaaataatgtttcaaatgaacaatcgaaacaaccacaaacgcaaatcccgaagcaacaaccaaacacaaatacaaacatgacaaaagtacaaaaggttgttatgccacgtgatgtaaattctcccacatttggcagtgacttagagaagatagcgattacagttgagccacaattttccgggcatttcttcaccactttaattaaatattttgagaaacaattaccaacgaaagcatatcaatcaatacttaatgtcattatactgctattaaagcaaggtacgcaattttcgaactcatttgtatcgaaagggactcatttacatttgaaattcgatgacgtaaaatgttcgaatgaaatttgcgtcatattatacattatctttcttaagcatccattcgagatcactcccgaaatattacaaaacatgacgaaattcattaattatgtaccggagaaagtgttaaagttgttatgtatatatttgacgacatatccgcagcctccaagttacttggatgcgttagagatattttttaataatgtgaatgtttttgttgagaagttaaaatttttgccgattttggaaataatttttaatgttttcttggtgaataatgagttcttgtataagtttaaagagaacattaaaaatatatttgagaaaactttagaaagtaatgaaaatgatacaaaagtttatatgtttaaagcgatttgtgcgaatcaaattatgtttcaattcgtgagaaaagaattaatttataaatatttggatgacacaaattataattattatttacatattattttattacaaaataacgatattaaatttgatgaaatgattatcaaaagtttattaaataacgcaaaaattgacaaattccctttaaacgttttaatgaataaatgtctcaataatgaagacgtatcgttggcggtttcgaaccaaattaattattggattacgttaaagttgccgacgttaaaaatgacaacaaaattattgttaacggttttgcggtttgacagctctaaaaaagttataattgaatgcaatcaattggccgactttttgatatgtttatgtaacgactccagtcaaaaattgaattgcgtcataagtttaataattaaaaatttaccaattaataataactttatgaataatatttcaaacgcacatttcttatctatattttataagaaaatgttgagcattaaggattcgtcggcaatcatgaatatgattgttgtatctgaaacattagcacgtgttcaatacaattcggaattcttggaattgttaccagcgctccaagtaatgatcgaaagcgatggctggagaagcttcgcgatttcattgatatgtactttgagcatgtacaaagaaacgagagaacatttgaagaaattcgacttcgtccgcaagatacaaatgtataaagacgacccgcaactgttaccgtatgtgcaatgcttcttaaggaatatggcagatgtatattaatgttttgttttagaatatttattattaataaatcattttttgaaattgttttatcatcgatttgtaagtgttttagaaacaaatttataaaattgtttgaaaaaagtgtttatattgtcgtaatgtgtgtttatgaacaagaataagagttatattacaaaatgatcttcaaaaataagtatttgaaatatttttcatttgatatatttcgtatgaagttcctaataatatttttaatggatactatgagaaaaacattattataactaattgcccaaaaaaatctctgggctaatttagcaaagattactcatttggtaatatttacatgtttaattaatgaatgtaatgataaataattatgtgatttacacaattggttaacttttttttaattttaacttgaccatcgtgtgaagtgtttttgcttgcaaaccagtattgaaataattaaaaatttttatattattgtttattaagttaattgtatcggcttattttttggattttctatcaattgctttgtgttctcgaagtaatttaactatttctttataaccatatttcgatgctatcataagtgctgtttgaaataatttaaataatttccgaataaaattctgtaattttaaattcttaatataaatttcaaataaaacaattaaatatttttagcattaatatcaattccttcttgttcaagaagtaatttaagtatatctgtacgacctttaaatgatgcaaacataagtgctgttttaaatattttaaataatttccaaatattattttgaaatattaaattattataataaatataaaataaaacaaataaatatttttggcattaattccaattccttcttgttcaagaagtaatttgactatttctgtatgaccattataagatgcaaacataagtgctgtttgaaataatttaaataatttccaaatattattttgaattttcaaattattataataaatttcaaataaaacaaataaatatctttagcattaatttcaattccttcttgttcaagaagtaatttaactatttctgtatgacctttttcagatgctctaataagtgctgtttgaaataatataaataatttccaaatattattttgaattttcaaattattataataaatttcaaataaaacaaataaatatctttagcattaatttcaattccttcttgttcaagaagtaatttaactatttctgtatgacctttttcagatgctctaataagtgctgtactaattaatttaaataatttccaaatattattttgaaatatcaaattattaaaataaatataaaataaaacaaataaatgtttttagcattaatatcaattccttcttgttcaagaagtaatttgactatttctgtatgaccttttgaagatgcatacataagtgctgtttgaaataatttaaataatttccaaatattaagtcgaaaccatgatatcaaataatataaaaatacttcagtatcattaatatcaattccattttgttcaagaagaaatttaactatttctgtatgcccttgtttagaagcaactatcaaagcattttcaccatacaaatcaaaaaaaacataaagtattaaataataataaattatttttataaactttgatcaaaataaataaatatctttagcattaacatcacttcctttttgttcaagaaggaatttaaccatttcaatatgaccattttcagatgcaacgataaataccttataaaataattttagtgaattccaaataaaaaattttaattttaaattattaaaacaaaaacttccataatttaaatcaatacctttttgttcaagaagaaatttcattaattctaaatttccagattttgatacacaaactaaaatatttttaggaagtatataatcatacataaaatatttcattagaaaaacattaccgattattgctgtttcattaatgatatcttcattaaattttgactttttcttatctaatagagataaaaacaatgaataattatcatttttaatacaacttattcctaattgagtatattctttgattctaattgctcttttcttatatatataatcaaagacattattccgatgaaattccaaagcaatttcatgaacgtgttcaaaaatacaattattttgctcacacaaatgaatgatctctatatttccacctgctattgcatatttatttatattatttaacttagaaccattcagaagtaaatatttaaaacatttaatcgatccaaaaaatgcagcataatcaattaatgtaacattcatttgattaacaaatgagtacacttcataaagtgatggtttgattctttgattaaaatcaaaatttgtttgtgatgatatttcttgaagtttagcaacatcatcgtaacgaattgctttaacaacagatttgggattaactccttctttgagaagttgtttatgttgttgccagttatcttttttatacttttcaattttttgaaagaaatttgaaacgattccgtaattttttaattgattaaatttggtatcagtaaaataatgtgcaaaatataaagtgttttttgattgaactacattagaagaaatatatttttcttcaatcatgttttctagaaaataaaaggattcttttgaatttaattgaagaagaaaatatgtaaaagtttcgattatactccaatttttttgtattaattcttctttcgagttaattgcctttatgaataataaatatactccaatatctttcttttgaactataaatgatctatatattaaacgtgaaattattagattagatgaatatggtaaattgatatcaaataaattcatgatattttccacttttgactcaatattatcttcatttaagtcaaagacgattgattcaatgtcttttaataatgtaatatagctattttttgggttagaatgtttcagcatttatgaataatacttcattaattcaatggtttatttataaagtaccgatctttataattgaaaagtgttgaatgtagtaatcgttaatgttttaacattgtttaaaaaatttcttttttaaattttaaaaaactttttaaataagctcttttacataaacaattgaagcaaaattacatttgtgacaataatggatttgatacttctaaaatgctgtaattaaatgataattcttagtttttaacaaagaataatagccacatatattataaaataaacattttatataatcaaaaacaaaagttttaatgaattttaagtcttgagtgataacatatttatgaatttcatttatgcaaaaaaacaaatgttaatggtatagaaattaagttctaccccaaataaaaattataaacatctgctgtatttttatcaattccattttgcttaagtaataaattaacagattctctatttctattttcgtacgaaaatagctgctaaaataattgcagtcttaaatttaatgaataatttccaaatattattcggaaatctcattgaatatagataaaaataaacaaaacaaacaaatatttctctcattaatattgattcctctttgtttgagaagtaatgaaatcatatttatttgactttttatagatgcaagcataagaactgttctaaataattgaaataatttccaaatattatttttagatccaaaattgttaaaatagattttaaaaaaaacaaataaatattttttgcattaatatcaattccttcatatttaagaagtaattgaactatttttattttatttttatccacagcattatgaagtgctgtataaaataatttaaataatttccaaatattattttaaaatacgaaattattaaaataaatattaaatacaacaaataataatctttagcattaatatcaattccttctttgttaagaagtaatttaactatttctgtatgaccacgataagatgctccaataagtgctgtataaaataatttaaataatttcctaatattattttgaaatccaaaattattaaaataaatttcaaataaaacaaatcattatcttgagcattaatatcaattccttcttgttgaagaataaattcaacatatccaacataataataacgccaattactacatgcttttataagtgttgtttgaaataattttaataatttccaaatatttttttttaaatataaaattatttatgaaaaattcaaaaaaaaattatcaatatttttataattataatcataatatttatattttataagttaatcaaaaatttctttattcctagaattatatgatttttccaaaaaatttaaacttatgggattttttccaagaaaatattgtaagagaaatatgtttcttgatttaatagaagcaacaataagtttttttgtaattatcattcctttttctactaaaaaagaaaaaatttcataattattattccaaatacataactttcctaatttttccaaattatttatttcagtaattatattttcattaatatatttaaaaacatcgtttctatgtaatctaattgctgcttcatatgaatctttaaaagatgaattattttgttcacataaatgaatgatttcaacgttttcacctgcaacagcatattgacctgtattttctaaatttgcaccattaataagtaaaaatataaaacatttaacagatccaaaaaatgctgcataatcaattaatgtaacattcttttgattaataaatgaacatctttcataaagtgatggtttaattttttgattaaaattaaaatttgtttgtgatgatatttcttgaagtttttctatttcatcatttcgaattatttttgctatttcatttggattatgtccctctttaacatattttttatgaagttcaaaatcattctttgctagttcttcataattctttaaaaaataatcatcaaaattagtatgtattaagttattcgattcaagaaattgttcaatatcttttttattaatctttttattgtttgataaatgatgtataaaatatatattatttttcttgtcacattgtttgatcaaataatttattttctatcattttttcaataaaatatctatctgtactattcgggtgaaaatttaggcattgaacacaaacatcaatgatacgacatgaaattttatattctctttcttttatttcaagctcttttaaatactctatacatatctcaatataatcccttgatacaaaaaatgcaaacacaaattgaaaaattatggaattgaaataaaatggaaattctttggaaaaatatatattaatgttgattcaactgattttttgatgttatcttcacataaattaaaaataatttgttcaagagattgtaagtgattaaaattttcatgtactgaaattgaatttgagtatcctcagcaaaatcattcgaagcaaacatgaaaaacagttattttcaaagcttaacaaaaaagttaccttacaaacaaatgaattcaatcagatcgttgtatagttcaaacagacaacctcaattcgggcggttttggtcaagcttccttttttagatgcctcgtccagttttgcatcaggatcatctcaaaattgaagaagatgttaaaattacaatcaaatctggtgttgttacagtagaaggcccacgtggaacccttactcgtgatctttctcatcttaagctcgacattgaatataatgccgaagaaaaaactgttttagcacgctgctggtttggaaaccgtaagcttgttgctcgtattggaacactctttggtcatatcaaaaatatggtaactggtgttacaaaaggttatcgctacaagatgagatttgtcacagcacacttcccaatcaagcattccatcggtgacaacaaggattcctttagctttactcacttcatgggtcaacgtgaaaagaaatcagttattgctccagaaggtgttaaaatcatggacagtccaaaccaaaaggaagaaatctggatcgaaggtaatgacattgataaggtatcattagtatgtgcacaaatccaccaacatacacatatccacaacaaagatcttcgtaagttcctcgatggtatctacatttctgaaaagactcatatcgttgagtaaacgaacatcttcattcacttttaaattaatttaataattttaaaaaaatgtcaaaaaaaaatttatccaatgaattaattaagaactatttacttgaactgttcatagctaatgttcaaatgttttgttaaatcgtctttttccttgttggcgaattgacgaagtttgttcgataaaaatctgtggtcggttattgattcggatgtcctttgttgttcgaagggttggttgtgggacatttaatccgagagcaatgtgcttttccacagacgaaaggtttctttttgttggatgtggaaatattataaacatctacgacttgcctgatttacaattaattgaccaacggaattgtcacaaagggaaaattacagcactagtgtgcactgatgaagttttggtgtcagctgatacagatggggtaattttgtttcaccgatttaatgaaattacaatcatcgaaaaagaaccttttgaaagctaccagaacaaagaaccaattgaaaagttattaattcgaaaccgtaccttatactttatattttatagacatagaatgttttggattaatgaatatcagaacccagaatccaagtttatagttactcctgatgtacaaaagaaacttactgaccttcatatatcacttgtatatcgtcaaccatcatggcttagatttcataatctggattgtttcgatataaataatacaggcacagaaattgttcttggtgatgaatgcaaattacatatttacaattttgaaaccaaaagacatcaacaatttaacttacacaatccaacccgaatttgtaaattccgtggtccaaatgcccttgtgttcacacaaaacggatatttcattcagcttggaaacaccttttataaagatcattggcattttgtttgtcccaatgattttgtattcaatagtaacaccatttattcaggtggtactgaaggtgttttattaactcttaaccaagcgacacataagaaaaccttccttccacgtctaggtcttacaattgaaggacttgcgataagtaataattccacatatatagcatgcatttctgataagaacattctagcgttaattgatccatccaattttgttcgtcagtctatttctcatctttatggagaagtatcattttcaaatgatattatcgtatcacttcgaaaacctaaccttctacaattcttcgattctaaacatggaaaatgccttgaccaacttcaagtctcctcttacaactgcagaaatccagtttccatttttgaattgacaaacgactttttgataacaattgagacgaacgatagtccccatgagccagcacttacgataggacaagatgttgaatttcatcatacagttcctcaagcaaatttacaagtacgagatgaaaaacatgcaaatcttttaactcaaagaaggattgatgagatcaaaaaaattttaaaaaagagatatgaacttaaacaatatgaaaaaacagaaaggattcgacctaaatctgtagaatgtaacccacttgtatatacttccgattcttcggatatcattggatatagtgaaattaaaatttggagtaataatccagaaaaagattcttttgagattcaacaatcatttagaataactggtaaaaacgtttcaactctttctatgcatccaagccttcctgtttatgcgatggttgtatcgaaagagcttcaaatctggaagaaatttgaaaattgggaaattctgaaaactaaagacattagtgaaccacccaattctattacatggtccaaagatggtactatccttattcttacctacaatgaccgcattgacatttatgatgccgaacttttaacggtcatctctcaaaaagttttcgagtactcaattcttaacgtctacttcatgaatgattatgaagttatcattcattctaaaataggtatattaacatttgatcttcgatcgttatcaataaccaagaaaatctttgcacaagcacgctgttgttctgccgatgagaattgttatgcatttgtcatcaacaaagaaattccaattataatcctttatgcgaatggggaaatgaagagttggaacatgccaacaaatggcactccaattcgagccataaaagtgttaaatgaaagcactggaattcgaattgttgcaattgataatgataacttcatttggtcgattgatcaattcggacccgaaacaaaggaaattaaacgcgcaacgttaccgcaacttaagccaagagaaatcgtaaagccaaagcaaatcgaaattaaagtcgataagacacaacaaatcatcgaattgttggacgtgccttcgcaccaaatccctccaatcgatgacctgtgcgcggcactgttcggaattgtaatcgatgagaagaaagaagaggaaatagtgtcggtgccaattaagtgccaagaagtggatgaactcagggaaataggcgcatgcgcactggaagcaaatgacatatcattcttaagaagtttctttagctagagtaaatatatattatcatatgcaatgttttatataatatatagaacaatgaaacataaaaatggaaataatcagaaaatgactaaaaaaaaattaaaaaattcattccgatacggggagtcgaaccccgctcccgtggatgaaaaccacatatcctaaccgatgaacgatatcggaattcgaaaatggataaataacttaattaataattgattttgaaaggaaaattaaaaaagaaaatcaaaactttcaatattagaaaatgaacttgcaacataaaatgtaccagaataatattgctgatcaaacaggtttcagttaataaagatttatttttatttatttcaataatatatattaaatatgtctttcctaaatgaaagagattttttgcataaaaaaaaattacatctaaatgctggaaaaactgtatttatttcttaatgttaaactttattgttatcccagttggtggatataattgaaacgttggacattaacggttatcaacggttattctcgttaaaggacgtttgatttactcaaatgaatttcggctcgaacaacatcgaagaacaaattgtcagcttattaaaaagactttttgacatgaaatttactcttttccaattctctgagctttcagggagagaacttctagaattattcaacacaattttatacaaaattagtgatactatgccggagaaaatcggaacagaaaaaatagaagcaacggtagaacgtatgtcggaatttttacgtgttctacaatatgaatttccttgtgaacctgaagaatgggatgttcgatttggcaatgcagacaaagaacttattcatcctgcaatgctttggcttcttaatgactttgatgagatgaaaaagcgagcctacaaagccaaattttttgaagaagttccaattccagatgaaatcaaagttgatccaacagttgccgaacttattacacaacaaaacgagcttcgtgagcaatttgatgcagctttaaccgagtacaacgaagttggtagcacaaatgtagatgagctcaaaaaagttattcaagaactcgaatccaacaaagcacgaatagccacacgtatttccagctttaaacggaagttatccaatgttcctaatattgatgaacttctcaaatggacgagtaaaatccgagaagaaaacgaacgagaagttcgtcttgaagaacaacaacaaaagcttactgaagaaaaacgccttttaattcatcgtcaagaaatttcatcaaatcgaatccaaaacattcgaagccacatggaatcgcaacttatatcgttacgtaatgcagttgccgaattccgtaaccaaggcaagaaccaaagttcttcccccaacgaaaaaagtgtcgcattctgccagcaacaagttatagccgctaataaacggctcgctcaaaaacaacgacagctatcggacattcaaaaagctcgagccgaagcggagcaacaactccaagagaagcaagaaacaggagcaatagaagtgccaaccggaaaagactttactgcatttgtccggacattaaaaatcaaaaatgataattataaagaacttcaatcacaactcgcattacaaaaacgagaattggctataatgatgcgaactgaagaaatagtattacaacatcaagagaaatctcataaggaagttctgaagatagaacaacaacgtggagttggaggatttagagatgcaagagaaaaactggaaaaggtatcagctgctaaagcagatctcgatgatctcaaaggcaaaacacttgaagaaatgagttcaattgtcaaagaaattcaacaaagtattcaagctcgacaaaatgagttaaaaccgtatgtagtacgacttcaaaaccaacgtaaagatacagcggctgtagaaagcaagtatttgcaagccaagaaacgatataccaatgcagtatctgaatatgattctgtttgcatggaattagatgaagaatccaagaagctgagagttgatatttccaactaccaatcgaagtacttcagtataatgacattaatgcaaagtttggagcgaacgttaaagcgagcaaatgatgagaaaaacgcaatcgaaaccggaaatccgatttcgaaagacatgaaaacgtattcggacttcttccaaaagtcggcgcacgtcatgaagaagcaaatgagggagctgaaggagcaaaagaaaacagtcggaacgcaaagcgaaacgaatcagaagcaattggacgcgttccaaaacttaaggcgactgctgcaggtgaagctggagtgcttgaaggtgtcgaagaaggaaaaggaagaaaagctgagtcaggaagagaaagaaagacaaaacacagaagaaagactcgaaatagtataaatatttttaatgaaataaaaaattatttataaattaggaacgaataaaatgttttgttgcgtgaaattaaatacaaaatgaaaatcatttggaaatgcaatgataaatttaacacatgcacaggaatgcattgaaggaattggaaaactttgtatagaagcattactgtttgatattaataattattgcagctcatatattatttttaactttcatttggttggatttattgtaaatattgtaagcaaattaaaataagttatataattgatttgaaataagtttcaaacatattcatttcgatatctattcattttaccaaagcgcttaattcaacgtaaaaaattctcacaacgcaaaaatacatttattacatttatcgtcacaaatattcctaagcgattatttttattacgtaaaaataaattccatccatattaaaaaatttattcactttttggttttgtctctattttcttcttatcttcatcttttttatcttcattattcttcttttgaggtttcttaataataagagataatattaacataacaccataagttccaaatgtcaaaattgtacccaagtaaccatttgaccttcttacgaagaagaacgagtcgaaagtcctataccaccatgtcgaagtcgcattaaacattgacatccatatccaaaaacgataaattaaacgtactactatcggcccgacatttgccacatcaccaaacatttgatgtattaacaaatccgctttttgcgccgcaatcatttcaggcaaaagaagataataaacaggattaaagccatgccacattgcagacacgccaagaaccattggatttgcaagccaatatggacagccatgatcaagtaaaggatataataaatatcgcttccaaaagatatgcgctgaatgattccatcgttgaagccatatggcaatggtgtcacttgtgagaacttcaaagatgttcaaattggaaatgtcatcaatttcacataagcctgattctcctgctccagtttcataaataccagcttcaactgattgccaggcaacgaagtatcggatggtatggaaaaatgtacagaaaatggttaaaagtaatcttattattgcgggtgaattaacatagaaaggcttgctatagaaagatattggcgtgattttcatggcaacaatggtaagaatgacccaaactggaatcattatgaagcgctttttcgcatatttatgtgatattgaatcatcagaaacatgtggacgtgtgcctgtttcaagaatgtattcgtgtatcttataattgaagtttggacctgatgttgcaccatatggtgtaaatgtgtatgatatccattcgactaaactcatctttttatcgagagctacacgttcatggaatggacgtatcttttctcctttctttaacttcctgccatggtaaagatctaaggccgttgtcataattttttggaacattattaaagtcatactgtttaccatccatttccatcccttagcaatagtaaccatacagtaaacgttagaagcagagctgaatacaaagctataaataattgtaattaaaggatttaattcgagcataaaatatgttgaaactgccataataagtggtatgaagaactcgataccgaacattgctattgcgagtgctaatccaagaataacatgaaaccataaattttgttttcgggataatttcggtaaaatataacgagaaatcggatataacaaaacgttaaaaacaatgataatgagcattggcccaaatgtctgaattaaagaagcgatggtattgagcaggggagaacccatgacgaggctgttcggtatgtaaagttttgatttggctggacggttgtcacttgaccaaacgagccacaattttgaccaaaataaactatttaaaaccacttaaaaaaacaattttttacatcaaatgtctgagaatgaacaaaacagttaaaattgaagaatttgttcataaaaaactgggcgttgaaacttcaggccatgacgtttatcactgcatacgtgttagaaacgtcgctttaaagattgctgagagcgaaggaaattgtgatcttgaaattgtttcttgtgctgctcttcttcatgatattacagattgtaaaatttgtactgaccaagctggtgctagacaagaaatgattcaagtcatgaaagatgttgatatatctgatgaaaaaatatctaaaattcttgatataattgataatatatcatacaaaggagctggagttcctactccaatgtcatctattgaaggaaaagtggtacaagatgctgatcgtcttgatgcaataggtgcaattggaattgctcgttgttttgcttacggagggcatgtcggtaatccaatatacactcccaacgaaaaacccgttctaagttctacagaagaagaatatcgaaatcatcgtggatcaagcatttctcatttttatgagaaacttctccttctcaaagaccgtatgcaaacacaaagcggtaaaaggatagcagagttaaggcatcagtacatgtgtgattttctcagtaaattctttgaagaatggtcaggcgccgatacgatttaataaacaactgaattttcaaccctaatagaaaattcaaagcaaagccgtttttcagttctgaaaatattctatcatccattcgaacgttaagtttcaggttcaagaacaaaaattttgttatttgggagctttaaattccctttcctaatgccatcaaagaaaggatgatttaagcactgttcagcagtgattcgttttgaaggtgaatatacaaatatatgttcaagcaaatcaagcagttggggatcagcattgcttgatagtgcttcttgaattggtcttctttctctttttatattaggacatacctttgagttcccatattcatttaaatcagattcagttggggttccaataatgtttatcatggaacggatcatataatcattggacttaccacgaaagattggtgttccaccattgacaaactcagcaacgatgcatccagctgcccatatgtcaactggataattgtaataccgacaatcaaagaggagttccggggctctatagttacgtgtagctatgtaggaaacactgggttcattagattgaattttcttggctgatccaaaatcacagatacccagttttccattttcaggatttatgagaatgttagatggcttaatatcacggtggcatatgccgatcttgtgtagatatgaaagagctcgaaaaatttgatatgaaaatattttgataatgtcattactaatattacctttttctttccgaaggtaaaaagatagatctgttggaaaacaatctgttattatatgtaagtataattgttgtggttcaccttcagttgtaacataataatcgattagcttgagacaatttggatgatttacttctttaagtatagaaagctctctgtttttatagtgtgggtcctgcagaactttttttatagcatataatttaccatctgctgtttgagctttaaaaacagttccaaatgttccctttccaattacaattgctttttcaaattcgccaattttctctttagagctttcattttggaaaaatgccaaagagccaatcttcattggaggtaccttagctaaggcccttcgtttttgtgataaaaataatcgttcttatgtaaacatcagaaaaaaccaccggattgcattcaaaaaatttacaacatgtgtaaaatttcaaatttttttggttaatttaaccagaacaaaaagaaaatcattgaatgagcaataacgtgatcaaaacaaagcagatgagataagagccaattttcaataatactttaataaaatctcatatataagctactctcttatatataagctcaagatggaataattttaaggagcacaaagtctccaaaaaaaattaaaagataaaatgtatttaaagaaaaccatcagtttcaatgtgctttcttatcatcaactaaaatggcatttttttcaatgttttatggaatccgcaaaggaattgttttacacgattttctttaagcaaatacttcatgttgattttataaaattatttttagttctataaatcatgaaaacacattttatttttgtgcaaatgggtcattagcaaatggatctacaggcggagtaccttttacatttgcagccgcagcaaacggatctacatttggagtagccgcgaatgggtcaacagatgtattaccaaatgggttagcaaacggatctacgtttgaagcggcagcaaatggatcaatctgtgtattgctttgtgaggcagtagcaaatggatcaactttcatattattttgtgaagcatttgcaaatggatcttggttaaatgagctaaaattccatcgattgctcatatctttatcaacgggatctactttttcaggtgatttctcttcttctccatcaaattgaaatccaatattagggtttttaaagtcagagcttcttgaagaagatactttatcttggatgacttttgtttgctttacattctcaaaaagtccaaacggattatcaaaattgactgtgtttgtttgggttttgatttcccactttttctcgatgagatctgggaaataagaatacagctttcccaatagttctcgagctgtaggtctttcatttgggttcgacttaaatatgcaccttacaatttctttgaaacttggattgatctttttactttcgggccatttgtaatttatatttaaaatttgaagatttgattctggaaaaggatcttggaatgtacaaagcttatataaaatacatccaagtgcccaaatgtcagactttgaatcaattttttgacctcgatataaatcacacatttctggtgatcgatatattggtgtagtatttttttctatatctaatgaagcttcattaaattcatcagtatttgccaaatcatatactttatttgtggctgatccaaaatcacataatttccattttccttcattccataatacattttctggttttaagtcacgatggataattccacaagaatgaataaagttaacagcttcacaaatctgagagaaaatttcaacaatttttttgtcatcaaatcctgttccgaaaactttgttcatttggttaaccaaattatcttcacaaaactccatcaaaattatcattttgttttcatttttgttttcaatcattccatagattgaaacaacgttttgatgtaatgaacattcataatgatatttgtattcattagatgccattatataacgttctttatcaggtacttgtaagatcttgagtgcacaatttttcccatcagaatcttttgctaagtaaataacaccataaccaccttcaaatatttttcggtcgataactaaatgtttatctttaaatataaattcattcccagtgagatcgcctccaaacgaaccgaacattttttgacagccagatttaggtgaacattttacgttgtaaacgtgaacggaaacggtttggggtgcccctacaatacgttatcctccaaaaaaatgttattttcccttggctcagaaagaaaattttctaatgttataaaaaatacaccagaagaagtagggcctgggaaatataatgttacgtctgaaattggtaataaaaagaaaatgaaggctccatttggatcgagagcttcacgtgatatgtgtctcacaaaaacagacgacaacccagctccaggaaaatatgaagctaaacctcttaatcaaagtgtggcaataacatcggtttttaattcagaaagtaaaagagatgttttcccaacaatatcaacaccatcacctgcacaatatggacacatcgaagaatgggttggaaaacatccaaaaaaagtatcaagaacaaatcttccgacaagaaaaacttcaagtggttatgttggacaggatgtaattgggtacattcaaagtggtgatggtaattgggttcctgtgaaacaggttaagcatggaccagaatggattgggccaggttcgtatgataccaataatcccaaaaaaacatctttatcaatttctctcgacaggagcagtaaacgcgatttatttcttaacagagaaagcaatcctggtccagggtcttattcgccttcagatatcaactccaaaattcctgttgcaatatcacctgttcctagaaacaatcgcgtatctgatggtggatcttctggcttcgttagccctaaagtttgggttacaccagagcaagaatcaagtccaatgttcaaatatcgcggagaaagaaaaatattcgacacacgggattcgaccccgggccctgcagcatactatcgttataaccgccgtcagaattctatcggcggtggttttgagctgtattctgatcgtcattcgcttcaacctcttaatcgcaacccagggccaggttcttataataccaactctaagtgggttaaaaataaacatagtgctttaccaagggctcaatcgcgttcggtggattcaaaagaatgggttcctggaccaggtaaatataatacaactccactttgggatcatgaatatcgtcctagtagcgtctttaagtcatgcgcatcacgctcaaggaaagttgataactctaatcctggtcctggaagttattcaccacaaatcacagactcagcacatcatataccaatgtcaatccatgagtcaaggtttgagaaacatggagattggattgagtcatctaaaatagagacaccatctccagattcatatcagaaattagatagtgatctcgaaaaaggaagaacaattccaagaacttaccgagaaaatagaaatgtggacaatttccctgggccaggagcatataatgttgtccatggatcatttaaaacaaaatctcataatgctgctgcgattcaggatatgagcgactgatttttgttataaatatttttgtattcgatttgttactgtttcgttttcatctttttgtaaattatttcgcttaattgctataaattttagttatttttttgcaagatatttgcaacgtaaagaagataattgatataaaaatcaaatcttttatgcacaatttgttcttttttcttttcttaataaattcatctaagaaatacaacttaaaatgaatttggataaggaaaattaatgagtttatatcaaacttcattcagattttttacacttcaaatagaaaatattaattccaacagtaaaaatattataaatcaaaataatcttttttccaaacgataaattatatattacattttattttcgctaaaagttatttctcatggtaacgacaaatttcctctctttacaatcagcggaggagctgttgcatctaatgttgaattgaacaatggaaaattaataggaaacatggaaatcggattagagccgtcaaatgtaggcgcgaggcttgggagcgtgatgtgtgtcttatttgttgttgttgttgtttgaggttctgatattttattctgatttgaaattcgttttaattgaagatatctgtgtctacattgcaagtctgttctccctggaatctgtgatgcaattcttctccaaccatattcgcccaattgattaacaatatttatgagtttttgatcttcttcagctgaccatggctctcttgaaatggctggattaagggcacgcgtccacctttgattacattgtgatgaggttcttccattgccaacaaatgcagaaatcattacccaatcatgtgtgccataacgagaaattgctgtaagtaaacgcatgtcttcatctgctttccatacagcactcttttttcgagttggcatcaaagctgttttaagattatcaactgtcagttttttgacgggaagaggcttataaccagatgccttaacatgtgcaagttttgttattacagttgctggacatgagcattcggaaaatactgttaatgcggcagtcatagaaatcttattttcgaaaaatcccaaagctatatttgccaatttctttctaacttcatcgccaagttcaggtgcggatatgttcaactctttttcgataaattcttgcatacaaatgttttcaggctttgtaatgtttccagattggtagaggctcatttggactttcaaatttgagcaatattggtattcaaaaaggtagataaacagaaaaaacctttcaaatatgttgctccacaaggtccagcattttgtttgaaaattaatcgtttgagtacaaaaatattttatagaattctatcgttatccataaagcttttattctatgagatctctcaaatatatcaaaaagtggatgtgctatcgttagttcggttaattatgctttgggtgttgccactcctttttatcaggaattgtaacatagttccatttgacatccatggtgaatttaaggaagttcaaacagatgaaaatgggtgggcatatttcggagtaggttttggtgacttcggacatactgtaaatgttaaagcatattcaggaaataaccaaacagaagaaatatattataactatggccatgaatgtccaactaccaacagcacaaaagttacctcaaaccaagtttttctttctgattcatcccaatatgcaatttttggattaaaagcaaaaccaaacgaaaatatgaatgtattgcttgcaagcaatgtcaagcctattcatcctaactctgcaactgctttagtttattcattcttttttttctttgcagctaacgtagctattgcaggaatccttcaattcttttattatagatcatcaatgaatcctacggagtatcaaaacttgaaccaagatgaataattatctttgaataaattctatattcatatagagaccgtttaattttaacgttttttgatgagattctaaatttaaaaaaaaaaaaaaaacatttttttactttacatagtttttattcattcgattttagctcatttgttattttttcaatgagtgtattattaacaaaaaaaatcagaagaacttcactgaaatcaatcaaagaagcatcagccaattttgtaattccctttggattaataatgactccatttactctgaaaatggtctttcctatgttttctaagtagaagttacaatctggcataaaatgaagaattgcatgaactctagaaacatgattgcaaacatttggttcacaaaaagaaagattaacattaacgcagtcacactgagatgacctacctattgtaatgtaacaacttttcatatgaaaacgtaatctttctgtcatcaaaattgcaagatcattttcctcaaaaatccccatggtcaaaaaaggaagtgattttgttagagatgaaatttccgggtctattcgtttgttaattatagttctgtttacattattaaatggacatgttgaagttgttaaaagatgcacattggatgaaacatttttagcttttttggagtgaagttgcatatcattgattacacattgttttgcgtattttttaattatggtttttgtttcttttggattcatttgtttaatggctgcaactcttttgcgaagagatgcccttgtgcggaattgcttaaaaacatttgggtttgcctttgcaaaagcttcaactgaatcaaattcatttgattgcgaataaagcaacaatgcaaaatcttcttctacagaaaatggaggaacatcaaccctcccttgcatttcatttggaaatccattgatgagtaaatcgttgaatatatcttcaatttgtttttgtgtgaatttttcaagcccaggtacaaatacttgacaatatggcaaaccataccctaatacaccatttatgattttaatttttgtttcttctgaaatttttggttccatctagaaaagccgtttaatgatgttttgaatataaaagtgagaggtaccaaaactcaaaatcctgcaatattttttcaacgataattttatgttaaggataacattgggaggagattacaaaaataccctcttttcgaaatttcgactgtacaatctttcgaaattcgatctgatttcgaccatactttttatggaattttggattattttctatatagtaatgttgtatattatatgtgtttattttctaaactattatcctttatcattttcattaaaaattttgagaaaaagtgaaaatatatgaaaaaatcaacttagtcgataataaatcgagtgcaactttttatataagatggcggtggtctttatttatttatgaataaaaatatatgatttgttatttaaaaaactgtgattgttaaataaaaatattttttgcatggatttttatgaatgattgaaattttgattaagtgaaaaaaataatgtgaagtgattttttctttatttatttttttatttttttattcgaatttttgggtgtctacttaaatatttaaatctcttaagttaactgatattactgctattgtttctttaatgttatcataatatttctggatccattcgagcatattttgctttgtttttgtatcatatttggaaaatggaatttgatagtattcagaacaatttacgatgatatccttcagagtactacataataacttatttccaaataatttctttacatcaattattatttcttcattaattggaggatatttccttcttatctttaatcattgagaatcttcgataaagcatatcttatccattgatactttggattgtgtaagatttctaccatttaaacctgtctgaacagacaaggtaactgcattaatactcaaggaattcattattctttttgtactaaaataaaatgtatcaaataatatttgaaaaaatccttccacgattttagaatgattactaataatgatatcaaaattttctaaattaacaataggtttttctactatgaatcctgcttcaattaatagtgaataagcaattgtccttccatcatatggaaataatgatttatcgtattaattgtttgaaattgtaattccaaatgatgatgctcttttagaaacctttaaaggttgtaattcttggtctgttatgtcagctattatttgatcagttgatattctttttaatgctgatcttagggttttgaacatacccatttttattcttaaacattcaaattgatgttcaagaggatttgacgtaaatctatttaagctttttttggcattcatatcttttaaaagtaatgtaacaaataaatgaattgtattacgacaatgaatacataatttctcatcaaaaagtgttaaagcaacaatatttctcatttttctttgtttaattcctgtgtctaattttgtttttttcataaatttataatatataaacattaaaaaaaaatgatttcaaatagcgaaattttttcgcttgaatttatattgtcattagacattgcttctataaacaaagatcatggtaagaaatataataatgctgaaaaattatgtttctcatatagcattaaagtattgttaatagaaaatgagaaaatgtaaagaatatcgtgcatttttgtgattttagagttattaattacaaacggtaataaatttaaattttcccgtattttggaaatgtcaatgattggtgaatttcgattaaattcaatagttaatggtatgtctttaagtaaacgatatcttgcacgtttgagtatataaaggggatcactaatatatatatcgaaaaaaaactctttttgcgattccaacaattgaagtcgtgtaatgttcagcaacacattcatattgaccaaagaacgaattatgataagaatcatagcaattatcaccatcaaaggcaaatccaagaacatatattttatgattatttaatttattacgtaatgtttcgagtgtttcacattgaatattcgttgcttccccctggggtgaaggagaaaaataaattattgagcacgaataatctggatttataggttgaatgtaataaacaaaggcataattttctatttgattccaatttatcattaaagaatttatccattgttgtgcattttcgcagaaaaattgataaggattttcaatattttgtaaaaccactttttttaaaccaataatttcattatcttttgttatagtcacatcgggcaaaaatgatattgcgtcaatacttaaaatacaatccattggagctgaacgaaaaatattaatttgattgtgtttataatcatttatgattccatctatttgattaatatcaatcaaagactcgaaacgttcattgattaaatctgctaaatgattatgtattgatgtataagaaggtaatggaataaaagatctaatataacgtaaagcttgtggcgaaatcgaattaatattggatgctaattgataaattttttcatcatatcttcttgcatttgggtgaactccaaggtttctcaatattgaattaataatttcatcatattcttcattttctgaattaatatcttcatttctttctatgtttgaaacacatttaacacttttcgcttcataaagtcttctataaatacgtgcttgtctttctgccttgatccgcttttgtctttctctcgctaattgcaaaacttgtcttgatttttccatgataaaaaataaaaatgatgtgaacgaaaaattttctcagaatttcaatggcattaaatgaaaaacaactagatgcattcaaatcagtaaaaatttttattcaaaaagcttccggccacgttttgtaaagtattcaatttatttttttgggaaacaccccaaaaagaattgcacataaaaaaaaattcagcagtccaaatcctgagataggttcgattataaataaataaatcctaaacttcatagttagtcgggtcccattaaaaaactattgcacgattttttttatcattaaaaaaatgagaaaaaagcacccatttttttaatcaaaaaaattaaaaaattattttttttttcatcaaaaatgtatattataaaaaaccatatatgtggaaagacagcaaatcgatcataaattattttacacatttaaaatttatgatttatttacttttgacatcatttctaaattattaattcggaaaattaaaatttaatttccttcaaacaatacattcgtgaaacaaaataaaacatttttaatcaaaaaaatttctatttaaaatcatcacataaaaaaaaaatttgaaaaaaccgattttcgagcactttttgatattaaaaatataaatattctaataaataatcaaaattatcgaaatatatatatatataaattaatattcatgatgtatttttattatagctagaaaaaaaagatcaccgccacttcatataattttttactaagattttaaaaaaaagtgagaaaaaaatgcaaaaaattgaatgaaaaaaaattatgcttttaattttatgaattaccatttataaaatataatttacatcaaaaataataaagattggtcaccaaaaaaaaataggaaaaaatcgatttagaaatttcgattttgatccggatattttttttcccaatttgaaagcagatttttattcatgtgttgatagggatctaataaaaatcaaaaaattcaccaggatatgtttatttcccagtttgaggaactcttaaaagtgcgcctttttcttcttgttgctcattatagtaaaaagtaatgtaattacttgattcgtctaatatttttaaatattttgataaataaaatataattttttttataaagaacttatttattcattttgatatatactgcatttagaaataacagtaaattatttcgaaataacatgatacaacgttattgtaatttttagagattatcaatattatgttaacgtaaagcttcaatcataattagtgttttaaagcttcttgtaataatttcaatattagataagcgtaaccgacgtaaaatttcttatcatttatttttgctatactaattgcttttttaaaatatttgaataatttttaagaattattttgatatcttgaaaaaatgaaatcaatattaaacaaaatttagaaatatttttaacatttagatcaattcctttatgtgcaataagtaatttaacaacttctaagtgaatatgtgaagttgccaaaataagtgctgtattatatgtttctaaagaaattccaaatattattttgaaatataaaattattaaaataaatattaaacaaaaccaaaaaatatctttagtattaacattaactcctttttgttcaaggagaaattgaatgatctaactacttctgtatgaccatttctagctgcaaacataagtggcgtcataaatattttaaataatttcgaatgtttttttaaaacaaagatttaaaagaaagatcaaatatttcaaacaagcatttttggaattgagatcatttcctttttgttcaagaagatattcaacgattttatgttaacctttataagatgctatcaaaagttttgtctcaaatattttatataatttccaaatattttgttgatacaaaaaattattaaaatatactccaaataaaacaaataattatttttagcatcaagacaaatagttcctttttcaaaaagtaatttaactatatcatcgaaaccattttatatagcataaaaaaatggtgtttgaaatatttttaataattttcaaatagaaatttggaatttcaaattattgaaataaattataaataaaacaaataaatatcagcaacattaacattaattccatccttttgtaaaaggaattcaactatatatggttgaatatctttagcatcgtaatcaataagtttttgttcaagaagtaaatttacaacatctacattattatacttagatgctgtcataagtgctgtgaaacagaaaattttatataatttcggaatatttttttgatacaataaacacttgaaataaattttaagtaaaacatttaaatatctttcatattaatatcaattcctttttgttgaagtaaaaatttaattgaatctatggcaccaaccagagaagccgccataagtggagtgaacaatcaattgaaaaaattccaataattattttgaaatgataaattaacatattatattttgttatgtaaaacaatagaatattattgtcatttatattaacttctttatgttcaagaagtaattgaatgatttcgatataacctgacatagccatccacacaattggggtgaaaaatattttaaataattatcaaatatggatatgaaacaaaaaattattattgaactaaattttaaataaaacaaattattattaactttgtcattaagatcaatacctttatgctgcataactaattttattatatcagtattacctgtttgataagctagaaaaattgcagggttaaataatttaaatgattcccaaatattattttgaaatatcaaattatcataataaattttaaaaaaaaacaaataaatatcttttgcattaatatcaattctttcttgttcaagaagtaatttggatacatctatgtgtttgctattcaatgccaacaaaagagctgcattaaataattgttataaattccaaatattacattgaaatatcaaaatgttaaaataaattttatttaaaacaaaaaaatatctttagcattaatattaattccttcttgtttatgaagtaattttactatatttatataacctttgccagatgcttgaataagtgctgaattgattaattcgattttatgcttgttattaattaattcttgatcaagtataaatttcacgatatcaaaatggccatttctagctgcatttagaaatggagctttaaattttttgaataaattccaaatgttttcaagaaattttcaaaaaatttattaaaatttaataaaaattattaaaaaatttcatttttatttttaatatatttctcctttaataggaaactaaaaagttctttatttccagatagagatgaaatttgtgagaaattaatcgaaatccgatttatctcaaggaaatatttcctgtttcaattgatttaataataacattattttttaatccccttgtttttgataagaataattaaaaaattttataattatcatatgaaatacatttgtagattaatgcactttttgaccgtaatgcacaattttgtacagaaaaatatatatatatataaatacatatattcatgaaaaaaatatttaaatgaagataaaatccaggtcctagtaatataaccaaatttaatttatacaccaaacctgattcaactaacatattaatatacgaatatccgagatttcgaatctcaaatatgtttcaaatttaaactttactcactaaaataaaatagtatattaacttctttcacgttaaatagttccctccgtttaagatgatacaggtgtatttgcccttgaattttttatattgacctgctttgttcgattattctgtattgaaatttcattttaatgaggtaactgccgcattgacagctcgaaaaaattcatttgaaacgaatatacctatcaaaaagtgggctgtgtggggttttgttcaaacgaaaatatttctttcttctccatatttatcacaatataatttattctaaaacaaaacaaatgagtatgtaaatataatttatagttgttttttcatttactgcttgattcgatgaggtttgaagcggaaatttttcttattttcagataacatgtcataattaaggctggatcaatgagtaatcttccgaatgaaaataacaacgcctcaccagattatttcagcggctctctaaaacgaaaggggttcttttttggtatgtaccagacttgttatggcgaattaaagaataaagttttctccatcaaaaaaaacaaaacatctccaaaaccagaactccagatcaaaatcaaaccaactacacttgttcatgtttacgaaaacgaaaaagtccctcgatttgttatttcaaatgaaggtgaaagcgatgtttgtttagcagccgaaactccagatgatgttatggcatgggttgttgctcttcgttcagccacctttcagaatcaagtcaagcttagtatggattccttcaacattatatcagttattggacgaggtttttatggaaaagtcatgcttgttgaaatgaaatccgatggcaatctttatgcaatcaaaacagtgcacaaatcccgacttatttccagtcgaaaagttcatacgattttaaatgaacgaaacattctagttcgtgccaataatccctttattgttcaactcaaatatgcctttcaaaccgacaccaaattttatcttgttatggaatatgttccaggtggtgaattatttcgacatattcgagagaatggaaaacttacacatcaaatggcaattttatatattgctgagattgctcttgcccttgattaccttcacagcattggtgtcatttaccgtgaccttaaaactgagaacattcttcttggcgctgacggtcacatcaaattaaccgattttgggctctcaaaagaccttagttacctcgaagtaacgtcatcattttgcgggacaaccgaatacattgcccccgagattatcaaacgcgagccatactcatatatgatcgattggtgggcgcttgggatattaacttatgaattactttttggggtgaccccattttttaaccgtaaccgctcgagaatgttccaagcaataacgaacgatagccctccttatcctcctgatactgatccgaaagtttccgatttcattaataaactactgacaaaggatcctaagaaaagatcaggattctcccaacttaaaaatcatccgttttggaatggtttgaattttgatgatgtaatggcgaaaaaaataaaaccggcattcatccctgacgtgaaagataaggtgccaaataacttcgattccgaatttacggaagaaccggccgcagattctatcgcatctgcagtcgaacaatcatcttcgaattttccgggattttcatacgctgcaatggatattgagaataacgaaaataataacgtgaatggaacagatggagatttgaaggtagaacataaaacggatctgaaggctacagagatagatcctgatataacgaacattcccactgaaatagaataaattatttgaatatgtatgaaaaataatcagaaattttatgatgtttttgtacgaaatgataaatttatatccatgtaaaaatatcaattaaattctttttgtaatttgatttagatttaattgttgtgatcaatagacaaaatgagctttatcatatgatgtaaaacttgcttataatgataatatatcttggaactcattcggatttgttttcatgtttcgattgccgaaagaccgtttcctttattgaaagctgattaaatgctttttcgaaatatcttttacacacacaaatatatcaacgaaaaactgtatcaataccatgtatttaagtggttggttcttggaaattaagcaataattttataacaaataatttatgatgattcatcaaagtgatatatgaagatgttagcaaaaacaaatagcacacacctttaaaaaaagagaaagaataaattaacgttaatttattgggaatttaataaccataggagcggaggatgtcagcaacttcaacgacagctttgtaacaattttgtggttgaattctatcattgtggtaagcaaatacaaagcaagttttgcatcttgacatcattaatccatatgaatgaaaacgcatttggaggttctcgctatcagctttaaggatagaatactcgtttccttggaacttcatgtgtgctgataaaaaggcagatcctttatcataaatattaaaaatttgcattaattcatcttccgaaagagagaatccttctgttgatgctagtacttgaccatcaaacctaaagatagatgcgcttgtaacattggttccaaggagatcaataaactgagcccaagacattcaaaagtgtcaaaaaagaaaccgcttttttcaatactcttccacagaaaatctgaaacgtaattaattgcgttttcttcagcgttgaggggaattgtggaaatttaatttttatttcatgttgagcaattaaagttataagtataacgaaaatatttttaacatttcttatacaaaaatcatatgatgaagatatcttcaatgcttaaatctaaatcgactgaaatctttaaaaaggttttaaattataaagaattttcaagtcaaagccaacacaattggttcagtcatgttatgtattgccggaataattacaaatctctttggaggattaagtcttgcacaacgtcttattaaagaaggacataatccaaatgaaatttcaaaaataattcgaaatgatgaaatcgaaaaacttcacgaaatatcttcataagcaaactttgattttagtcaaacatcactttatgaaagatgttcatttattaaaaaaaaaatgttacattaattgattatgcagcattttttttcttcagttaaatgttttaaatatttacttatgaataatgcaaatgtaaataacacaggtaaatatgcaattgcaggtggaaatgaagaaatagttcatttatgtgaacaaaatcattcatcatttgcaggtgcatatagaacagcaatttaatttcatcaaaataatatctttaaatatatttatgaaaataaaattatcgaatgtctggaaatataacttatgatttaaatagtttttgtattaaataagataattatgatattttagcatttttggaagaaaaaggaattaatattaatgctaataatataaacgaatcagctagaaatggaaatttatatgttgttaaatgtttcctccaaaaaatattttgccatttgcttcagaatcagataatattgaacttgtgaaatgtgatttagaacaaaaaggaattgatgttaatgcaaaaactattcatttgaataatttataatatgctttaataatttagaatatgttttaataatttgaaacagcacttcatatagtagtttgaaaccaattggtttcctttttgccgattcgaaaaaaaattaacataatttctgccaaagcgacaaaatcctcaaaaatccataaaatctttttaataaggtatacataataatgtaactcaatagcgtttttgacaactatatatttaatcaatggatttggaatatgatttatttccttgaaagaatcattaccaacataatttcttaataacaaccttatggttttacgaaaacattcattttttaacattaacttaaatattttcgactgtttatttgtccaagcaatttcgtatgaaaatcgaaatgacatgtgatgtggtatacttgatcactttatctttcatataaaaaatgttatcttatttttaaaactttcacaatctttggaataaatcaaaatagtgccatatgcaaaaagattgagtatgatgaaaattattctattttatcaataatattatatgataataaatacaccaaagcatttatagtcttattgatatagaaactaaaaatagataaatcaaaacaaaacaacgtttattgaaatggttcatcgagcactgctagaaattgttccattttaaaatcgctcaatatattcgttttcgtcaaactatctctgctttgcagtaaacaatcactaactgtaccataagaatcaatcatagaggcagcgtctttccgagaaacaccaattgcattcaatgcattgattgcaatgtcatatgttgtttcatttgttgcttttaattcatcaacttgtgattcttgtgtattgtaaattgttaagatccatcgtcctgcttcctctaaattaaatgctaaaacaaggttaaggttgtttgcaattgattgagctgttagttttgagataacacgatctggatttttgccatctacaacaagaagtagtattcttgtagcatagcctcccttaaagtttgctattctttcgcttagatagttaggatgttcacgatgaaattttagtgataaaaataatattccaattttataaccaattgaataatcgcatgtagaactatcactccacaccgtttgagcaggtgcaagtattttgatcaattggtttcctttttgccgattcgaaattgtgattgggagtttcaaggtgattggttcaccacaccataaacgataggaaattgtatgttttacattaaaaaacaatgggctgaataaaaaataaacataaagctccaaaaaaatcattcaataaagcaagaagtcaaccaaaaccataagaaaacttttttagaattatacttcaagctagttataataaatgacttttctaatcaaaatatgtaataatatgcattaatatatggagatcgatttgtctgatttagcaccattaaaataaaaaagaatttcactacataatattagaaataatatttggaacttcgcatatgtcacatttaaaaaataattcaaaaaatcatgaaattcccttaaaagaaaattgataccggtatttaagtaagggatattagtttattttaattgatgtgaattttgtaaatttattgttccaatataaacaaatgatatttttttgtaatatttttttttcactatttcttttcttttcacaaatttttcattactcaataagacttattaaaaaaaaatgtgaacaatatatctctctttaaaattatcattgaatataaatgcctcataaatattatcgaagtttttcattttattatatttcaattcacatttcatatataaataaaaatttataaattttcatatgaaaacagataaagaagaccctacagaatatcttgaagaccaatcatatcgggtcataaaaatagcaattcctgtcatcataacattaattctcgatgttattttaactcgggttatcgaaaatacgcatggatctacatcatacgatcgatctttttcacaaacaatggtttcaaataatcttggtttagacacagcaacttcaatttatcttgcactaggattaattggaggcataattgttgttacagcaattttactcctttgttattatcacggatgcacaaaagttatttatgtttggatgattattgcagttactcttattctttcatattatgtttatcaaacattttctcaaattccagcagttctaaatataccaacagattacctttccggtgccatctttatcctcaaccttgttgttgttggtaatatgtccatattttggagagctcctcaaattgttacacagataattttaattttcatatcagttcttattgctattgtttttctttctcttcccgattggactgtttgggtgcttcttgcgcttcttgttatctatgattgttgtgttgttctttgtccgtttggtcttttgaatatgctcatcaaaaaatccgaagaaagaggcgatgagattccagctcttgtctatgcttcagctgcttatcatatgccagagcataatgaatcagatgaatctgatgaaagccaagaatcagaatctcagccatcttcatcctcatcttcttcctccagatcttcggctcagaacaacgagagtcatcgtgacgaaactcaaaacgaagagcatcaaaatcttaacgttccccatatcgttccacaaccgccggaggaatcgtttgttcttccgccaccgccaaagaaagaacgcgatggtgttcgacttggtttaggtgacttttgtttttatggtatccttataacaagagcagcaaggcaaggatgggatttgactattctttgtatttttgctgttattttgggactttcattaacattattaattttagcatggctgaaaagacctctcccagctctcccattgtcactcatcctcggtattgtgttctttatgattggcgctcttactttcagaagatttgatgcaaatctcaataatttacttttggctttttaatttatttatttattaaatctattttttatataacgttttttaatataaaagtgcgtatatgcagaattcgttgctttgatctctattcatattgtctccagatattttacaaattcaagaatttttatcagcaccaataagtaatttaactaattttgttcgatcatttgaaattgttctcataagctgttttaaattaaataatttccaagtatctatatattaaaatttaaaaaaagtttgcactaactatattagaattattattataaaatttcttgaaattaaaaacattcggttcgcactggatttagtgaagattattaagattcctaagaaaaatatcaatcatttaataaaatttcttattaaatttgaaattatttatttctggaaagtgacacttcaaggaaacttgaagagtagtatctattaacaccatatattaaactcgacttgcgatttccacccatcgtatatagcgatcatcctacgatcttgatatcataaatatataatatatatacatagttacatctatgattaatataaatctacgaataatattatgattagcacgagataaatctattctatcattccaaaaagtgacaaaaatcgacttttgcatgatttatatcaaacgatagcagcaacgataagtgacgatatgagcgaatttgaatgatggtaaatattatcaaaattttaccctttcctcgaaaaaatgtttacatcattgtaatttgtcaacagccaaattaaatgattcttggtttgttaaaaaataaaaatattgatattttatcatagaatcgtgatttgttatttattccaaataattatatgaaatcttgattttcttaaatttatgaatttattgaaaaaatgaatgatgtgataattttggtaataccttaatgatgtacaaatttaacctgattaatcatttataaacaataaaaaagtttctgtatgagtccattcttgatatatcttggtatggtctaaatattttttatgaacaaaacgatttctgatcattgaattcatttgatgatttttttttgtttatttatttatttttatttacctattttagcaaaatgtttaaccttatttaataaatatcaatacaaatgcaatttgcaaattatcttttaaaatactgacttatgatacatttatcgattttttttatctcatattacttgttgtttcaaaaatccaaatcatcaaaattgtaaatataatttcattaaaccttcatgtattacaacaacattagattctaatggacaatatcatttaaaaagaagtgaagaagaaaaaagagttgtcgaatattaaccccttatatattacttcggaaaggttatgtatatctaatgttatcaaaaaacagctgaaaaccctgataagattacttctacaggtcattatgtattaaaatataatacgaaacctgaaccatcatataatgtaaatttatctgttgatgattcagttttgcacaaattcatgcacgtgtagtttcatcagaaaaatgcatttaaaggatataatgcttgaaattttgtattcatgatacaaaatgcattcatcaaagtggtgcacctcctgaattacgaaatgcttcatatgatagttcaggtaatcaaattcgaatggatccagtacaaatatattttaatataacttcagaacttgaaaaaattggttttgctgatctttggtcttggtatgagatcaaaattgatacaagtggtataaaatggcaaggtgacccaccagatttcaatcgtattagacctccaaatatattaaatagaaatgatgataatttttcttatttagatcaatttggattacatgaagaaatattaacacctatgccaatatattttgatctaaatttagtcaatgcaaaacaattagttgttattagaagtagaaaatatgcaatagtgggtttatacaaatataatttgaattcaaatcgaaaacattattgttctcatttattattttctgcaggatgttggcgttcagataaagaaattatatgtgattttgattattatgaagaagcttctaaattccatggtatttttactgattctaattattctgaaattgatcaattcttcataatgtatattaattacatgattaattcaaatcgatattcacctggagaaattgctagaaatatatgaatgataaaacgatcttcaaatatattaggtattgaacaattatcaaatgaattctcaacaacaattcctcaacgaataaatcaatttaacaataattattaaatcaattcaatatgttagaatctttgaacaatcatactcatccaatagaaaatgataatactaatgagattaaagaattaatcggtttggattattctattaatcaaaaaatagcagctagaaatttgaatgctgatattagtaaacttaattcagaacaaccttcagcttctaatatgattgtagatgcatttattaataataatggaaatgattctagattatttatttatggcaaagctggaacaggtaaaagttttttaattaatattatacaaaaattctgtgtatctggatcacatagtttcattacaacagcctcaacaggaattgcgactttatcaattaatggtattacattccatagtgcatttcctatttaaatgtcacctgacggtcctgttagtatcttaaatatttctacacatcatggactcgcaatttcacgagtcaatgtaattattgtagatgaagtaacaatgttagatagatcagtaataaatgctgtatctaaaaaattaatagatttatgtggttatacaggaaatcatattcaaatcccatttgcaaagaaaatagttatttttcttggtgatccatcacaagtaccagcagtaactcatactcatgatgacatatctgaatgtgctgaacaatttatgcacattactggatttgatggttttataccaatccattcgaaaaaattaatgcgtcagaatgatccaagtcaagaacaatttagaaatttacttgatgaagtatctaaaatgacaaatgatggacatttatctgacgttcatcaagcaatgttaagatcaagttttcatcaagaaaatattactgaagatcaaagtattcaacttgcatttaatcatgcttcttctaacgttttcgctgacaaaagtatgattattacttatacaaatgatcgggcaaatatctttaatcaatttggtatcatcacacagaactcctattgatattgcatttaatcatttttctaacagcatcattacattttgttctgtcttgacgtatgttcaacttttcgaaaaaaaaagtcagattcgttatttttttgtcgaatattttccattttaaaatgatttgctttatacttaaatgtttaagcatttggccaaattcagagcttgctagagagaaatcataaattttaaaaaagattaaatggttcaattccatttggaatattttcttcttttttgtatatctttttatagatttcgtaattacaacatgatatcatttcaaggttcttcatgaccttctataaattcaattcaaaaagtatggctatatttacatttgaaaatagcataaaatgacaacaacaaaatttttaaccttttccacatatcatttagctgttatttttcacagataatcaagtcgttaatcaattgtttagagaactgtcaactttaattgtgtcattttcaagttttcctcggcaactgttttgaagtcttcgctaaggactctcggggggaattgcacagatagttgtaatctctttccgcgcaattgtggatcattttcgataacatatctcttcaggtcaccaactgtggcattcatatttacggagaggacaatgattccgttcggaagttgaatgcggactttggtcgatggtagatctggatcggcataattcgtttttgtgggtttaagtggtgcattgctgacttgctgtgtgggagcagatggtccatcgttaagcttatgtgctgttccgctccatggatcttttggcttaggtttttcaacataattcttttctcgattatcttcaatctcaacatcaacttctgatccaggtttgtaaagctcacgtggaataacaccgcgtgatatggattggagaaattcatggttggccggatcttcgttaagacgaagttccccatcattgacttgaaatccattcttccaaaatgttaccttgactttatcaaccttagtattaggtgggtcttcaggttgtgtttgctgatgatttgcatgatgaaagatatcatcaataatttgtctagaatcttgatttggttgagtaggttgtggtgcaggccttggtgtaggttttggcgttggtgcaggtcttggtgaaggtgcgggatgtggtgcaggctgaaatgatgattgatcattatagaaaagattaattgcaacttctaaattaccatttgcagattctaacatttgccttgcgactgttggtgaaacacctgttatatctataaattctctcactactgattcgttgctgctcatttggtttggttccaaccgcttgtttaagggcaccccgaaattggcacattttatgttcatccgccaaaaagtttattcattgaattgtttgtataaaaccgtttacgtattcatcaattttttataaatttttttacaatgtcagtagaaatcgtggatgacgaggaagaagaaattaccacacaagaaaaagaaaaaactcaacccaccagtgaaggacctcatcttccaaatgcacctaaatatccaatttacaaacgtactaaaatgatatgccatccgtggcatgctgttccatataaaggccttaacgatgatgaaattcgagctgtaattgaaattccggctttgtctagaattaaaacagagcttgataaacaatcaggattattgaaagttgatagggttttacattcatcagtaatctatccagcaaactatgggtttgttcctcaatctttagcagaagataatgatccgttggatattctggttctttgccaattatcagttcccccattatcaataatgagagttagacctattggcgtaatgccaatgaacgatggaggtgaagcagacgacaaaatcattgctgttgcagctactgaccctgaatataacatatattatgatatctcagaattacctcctttcaagttattaatgataaaccaattctttaacgattacaaaactttggaaagaaagaaagttaagacattcaagccacttggaaatagtcaagcaagaaagatcattcagaaagcgttagaagcgtacaagacaaagtatggactatgaccaagcattagctatcccgaaggacaatatattttaatgaattagtaaaatatttttctaatatgtcatattagataaacactttactttttactaatgcaaaagtattcacttggaatatgttttaataatttgatatatgttttaataattgtggatttattttaatgatttagaatattttttaataatatttgacaccaattagttcaatcacttagagattagatctgatgaaaatttttgccttcttaaagacaatctaatcagtaatgtgtaaacattaaattattaccaaagaaatgaattgtttataccagacgtgttttgatttctttcgtaattttttgttctggtgttacaatataaacaattccaccccaaccactgagtccatcgcgttcgatagctgatatcaaacatgttgaaattgttttaaataactcatcaggattcattcctggcctccaaagactttcacaaataccatacaatgaatcacttgatgttcctgcaacagcaaaatcattcggttctatcatagcaccaatactatctgatggattatttgtacctggttcaagtccagctataattggttgaactaaatattgatcaaatcgatgtttgaaaagaaatgactttacaaactaagtgtggagtagctaacttaaagaggtgtgaattaatcttcataggtaatttgcctattcataaaaaatgcctaatcaacaaaaagtggttttcaaaaagtggattttgaaagaaaaatggcagttatgtcaaaaacaagggtgatgtgagctggaaatgaattatttattaaaaagtgtctaccagatcaagtattttgaatcagtaactggtcgggaattttattcattgaaaattttgataaagaaataacggttttcttctgtcttgaagaccacaaaaaatggagagttttgaagcaattggacttttaattctcatattagaaacactatttaaagtatatcttaattaccgccagctttcatttatcaagaaacaaaaatcaccgccagaaatatatcgcaaagaagtcacctttgatgaatttgaaaaatcaaaggaatacgaaacagtttgcatgaagttttctgttgtaagtgaatttgtaggcctaataccaaatgtactaattcttcttaatttacataaattttggacatttacaagatttatccttgaaatcatacaccttccactttttattttagccaccacgattctctctactatttttgaaatcccattacgttattataaaaagtttgttattgatgaaaaatatggctttaacaagtccactgtctcactttttgtttctgacaccatcaagagttttcttgtatcctttattcttcaatctattctttattcagttttatcgtttatctataaattatcaagtatctatttcatatacataagtttagtatttcttttcgtctttgttattattgttcaagtgttatatcccattattatcatgccattgtttacaaagctgactccactcgaagatggccccatcaaagaagccgttactaaagttgcagctgattcatcgttcaacttaagcgagatataccaagcggatgattccaagcgcagcaccaagcaaaacgcctttatgtttggtatgtttaagcacaaggttgcaattgctgatactgttttaacaaatggtacacctgatgatgtcgctgcaattattggacatgaaattgggcattcaaaacatcgccatatccttaagttattatttatttcacaaatatcgaatcttttgactttgttatctttcgttaaagtaatgcaaagtgattcaatattccaaagtttcggtttcgtcgatgagaaacctttcataattggaatacaacttgtgtcgttcttcgttgtgcctgtgtatgagttgtctaacatgggattgaatttgattagttgtatgtttgagtatcaagcagatgaatactctgcaaaaatgggcctgaaaatcgacgacgcattgttgaaactgtgccaggaaaataaggcaattgtcgatacagacccaatttatttggcattcaatgcaaaccatccaacgttggcacaaagaattgataggattcggaaagtgcaaaagaagaaagaataaagaaattaattatttatgttgaacgtttcttttatataaatttgtatatgtggctttcaaagatattttttcgatgattgcaaaatatggcgtacaaaattcatcgtgataaagtgattagtaattacaatcttcatctgaatacgtaaacaagtatcccccaagtacaacagtatattaaattattaaaagatatccaaaattattcaaataaatagtttttgtattaacatcaattcctttatctaaaagtaattttactatttctatattattatttctaactgctatatgaagtgctgtttcaaattattaaaacatattcaaaattattcaaatgaatattttttgcattaacatcatacatatgtagaaacatcagactttataatagctgttttaaacttataaatctaatgcttctttcatctcaaaatatgtatcacacattaatttgaacttaaaaagtcatcatagaaaaatgttgttaaacattttaataatcaattcatcgacttcaacatattaatttaaaccactacagacttagaaatgcatttattttataacatttaacttttttattcacatttttcttctgagttatttggcgcatcatgaaactcattacacggtataattatcggggttttcagcttatttatttgttgcaccgctctctccatttcttcctgaatagccatatcttccgggtccgcttcgattgccttttggtaaaactcttttgtcttttcgaattctcccataaagaacaaacaatttgcttttttccttagcatttcagcgcttggattcatttctattacactttcataatcacttaaacatctcttaaactctcctatcttcacaaacaagtcagctcttcttatgaaaacatcttcgtttttgtcgccgttattaatcgcctttgtaaagttgtcaattgcatcgataacgttccctttcttttcttcatcgatacctttttcttgatattgttcatatgattcatcattttcttttgttaatgctttaagtatttgttcaagtcgttctttctcgcgttcaatttctcgagattctttttcttgaagtgacatttcaagcgcttcaattgctttatcaatgttaccaagagctgattgatttgtagcaatcttttgatacgcacgagaaatcatatctttactcgcgttgtgatcgcgcccaatttgaatggctttctcacaaatttcgatcgcatcaagaaaacggttttgcttagtgtgaactgatgaaatgttcgtgtaatagatcatgttcgtagggtcaatggagattgctttgttgtaatgctccatggcgctatcataatcgccacgtctaaagtcggcatttcctaagtttttctcatcttcggcttcttttctgtttcctgataacttttcagtggttgatgcgggtgatggaggcgtttgttgtttatcttggttaagaagaggctcaagtaatgcccgaatgacaagaattagtcgtggatctgattgatatttatctgaaaattgtggatttgtggttatgtcttcaaccattttgacaaaagaaggatcactaaacatcggagctattaagggattcattcgaagacgatctattaaatctggtgggaataacggatttagaggagagggtgctggcttcttgttttgacgtacacgtttgagatcttcggcaataaggttgtttgttgggtcgagttgttgtgcttttaaataagcagcttcggcaccattccaatctttgattgcttctaaagctgcagcgagacgagtgtgtccacgagcccaatctggttttaattctattgtttttctagcatcatcaattgctttatcatacatttggagagataaataagctccacttctatttgaataaagagtttggttgagtggatcaattgctattgcttctgtataatatgaaattgctagctcatagtcttgtgaagcaaatgctgcatttcctcttgatttaagctcttcgcttgtcatttggcctagcttttgggataacgtttccttgaatcatccttgaagtcaaaattgactcagtctgttggcattgcaaaatatatttcaaatcatatgtcagataaagaaaccaacacatcagaaatcgacaaaccaattccaaataaattatttattcaatcaaatacattctttagacaatatcgatatgcttattattgtgataataattcaaattcaaaataaaattaaaaaaataaatgaaaatgaaaactaacgaaactttatttttttcccattaattcagaaatgttaatccgatcacttacgtatgtaattaacaaataaagcttttaaaatttttttatgacaaatagatctaaaatattaacgagcgaaacttgtttgaaaaatggtaattagtgtttactcagtagctggtttagtttcttcttcggcctttgagaaatcaacatcttctggaacatcgccaagatcattattttcttcttctttcttatccttaagtccagaaaggttcattcctgaaatgaggtcagttaaaacttcaacaattggtttcttttcaacctttcccatgatagcatatgtatttgcatgcatgttgaaagcaagttctggcttttggaaggaaagagcttcttcgctgccttggaggatgattgatgctgagtctaattcaccaaattcacggcatccgagacgttgtgcagccaaccataccttaagtccattttgatttccgttcttttgtgttttctttgttttgcggcgccatgagccacggcctcctgttttcatacccacacctggtgacatcagtaaaaggccaaacacaaccgttacaacccccaaaatctcgataacggtcgccataaaagtgcttgatatcatatcgttccttcaaaaaaatgattttgttttctttaataaaactaattaaacttaatccctgtttttaatcaataattaaatagagcacaatttcgtgtatgcataaaatacagaacagcaaactatactttttttcacaattgaatttactcggacatccacctaaaactaatccaacaattaaagcatatgacgtttcaccagaaatgaaatatgttcacataattctttttaacgctttgttatttttgaagttacacaaacatttcaaattttactcataataacaaaagtttattcatccgtaccataatagaagaatagcgctgctgttgataccactgcgacaatttcgcttcttgggtgtgcctcgcacactgttactcttttgttaaaatctttaccaggctcaggaggtagtctttgatttcttgcgcttacagccttatgctttgtcgctttttgtcttttccaatcccaagcaatataatccgcagaataacaaccagtcacaattttatctttcgccgtaaacgcagttcgaaattgatctttcacataatcctcacttaaaagatattccatctgattaggaaaccattgaacctcaagtttcgcacatggagaattaagattacgtatatcccagacttgtaaatcgttaaagcgtcgcactacaaaattgtttccatcacgtgaaaatgatatacttccaatcatgctgcattcgtctgaaaattgttggcgtattgaaaattttgatgtgtttatgtcaaaaagtggcatcagattttctgcttcttgacgaagatcatacatcttgcagaagccgccgtcattaccaaccatgaaagtggatgattgattcggctgtataccagatgcagtgatttcggaatcttgttgagatattttacaaagacaaacagatttgatatctcgttcaatatcccacaatttaacacacgttacatcaaccataagaaatgaccgttgatctgataacgtctgaagatcgacgatgtactcggtttggatatcattgaaagtacgaatacattcgggggcgtactttgtatcgctacgttgtggcatgggaaaaatgtatgtgtcttttaatttggtgttccatgcaattcgtggtgtggaattaaagtgccatagtttggcatcatggctattacaggatataaggagaggattaatagtttgtcgtggaatccattttaatgaatttactctcatctcgctgatttcgcttcggaaataatcaaactgtgatttatgtgcatgaatttgattagaaaacgaaatggttggtctaccactgcttgaatatgtaagtttgaaaactaccacccttcctgcttgatcacctgatgcaagaaattgtccatcatgactgaatgcaagtgtggaaatggtgtcgtctggtttgaattgagacagtggaacatgatcaccgaaagcagcaaggaatttgaggttcatagaattattttttttttgaattggaaaatttgacctttttacaacaaatctgacttctcacttcacatgagaccgtttattatgtaaacttaagcttaacttttgtttttatgttgaatagctaatattttttaatagattttaaatcaatcgtttcctttcattgaaaataagacaattttttgttcgatggggtatgataaatttaatgctcgaaatttaaatcgataaataatcgatattttattagaacacttccgctttttatcgtaaaaatatttttcacaaaaaaacaatcaagttttctggaaaaagatgcataaacataaaatctttacttttgaagttcttcaatctagcggttatgatcggtatgtattgaaaaaattctaaactgctgatatttatatttaatgcttccatcaatccaaacaattcatacaatagaaagaattatttttgatattactgaagataatataaagcaaacagtagatttaactctagatttatttgaaaaccaatttccagattcatttaatcttcttgtttctcaatttttatattcggcttttatttcaaaagtatgtaataaaaatcttattataaattatttattaattttaaattcaaatgaagaagaaatattcaaaactaaaaataatattatttatatatttaaacattatttactccaaaagacttcgcaagaatcatattttcttatagcgaatatgataaaacaagaaatactcgatgcaagttttgtaaaaaatataaattctttatattttgcacattataaaacattagaagaaattttaagaatgaaagatttaaagttttatgatgaatttatttcaaatcttgaaattctttctaaaaatgattggaaacttcataaaatgttaattgatgaaggagttaatccactaataataacaaaagttttacgaaatgataatttagaacaattacaagaaatatcatcacaaaaaaaatttgattttaatcaattcattgaaccatcactttatgaaatatgttcatttgtaaacaagaaatatgtatcattaattgattattgtgcattttatggatcatttaaatgttttaaatatttattaatgaatgggtcaaatgtaaataatacattaaaatatgcaattgctggaggaaacttagaaattattcgtttatgtgaacaaaatatttcattattatctgaagatccaattgaatgtttcgaaacagcaatagaatttcatcgaaatgaaattttttattatttttatgaaaagaattttgatcaaatatatgatttaactaaattaggtagaaaatgtatcgattttagtaactatgaaattttttcatttttagaaaaagaaggtatggaaataaatgatatgatcataaaaaatatagtaacaaatggtaacactttcttacttaaagattatactcaaaagaatcaaattccaaacatattaatatttgcaattccatctggaaatcttgaaattgttcaattactccttgaacaagaagaaattgatattaatactaaatatattttgtttcagtgaatatttatacttattaattgaagctcgttttcataatttggaaattattcatattatttgaaacagcacttatttatgcatctaaatatggtcaaattgaaattgttaaattccttcttaaacaaaaaaatattgatataaatgtaaaagatgtttatatattatattggatatttgttttaaataatttttatttaatttaaaaattttggatttatctgatttatttagaatttattttaattatttttaacagcatttctatgggctattttatataatcatattgaaatcgttaaattatttcttgagcaaaaagaaattaatgatacaaatgatatttatttactttattggatatttacacttaacatttgtagaaggtctaatgtttgcatctcgatatggacgtattgatacagttaaattccttatcaagcaaaacaaagttgatctaaatgcaaaaaatgtttttattttctataaaatatttgttataaaaatatgaaaattattttaattatctggaatttattttaatagttttggaccgcattaatgtgcgcatctcgacataatcaaatcgaaattgttcaattcctttttaaacaaaaagatatcgatatcaatgcaaaagatattccaatattttatagaaaattcattttaatttatcgatattaattttaaatatttggaattcatttaaataattttggacagcactaatgcatgcatctcgatttggtcagtttgctgtggttgaattccttcttgaacaaaaagatattgatataaatgcaaaagacatttcaactttttatagaaaatttattttaatttattgaaattaattttaaatagttggaatttattttaattatttaaaacagcacttatgcttgcatctgaaaatggtcatattaggatagttaatttacttcaatcgattcaattctaattttaaaatcgaaattaatcatctaaactatgtttgtaatatataaatccgacattttttcaaaattctgatgttttgggttcaaaatcgaataagtttgtttttagtgcaaaattggaactgctctcaattttttatcgtcttttagcttcagaacaaaccgaaaaaagcattgaaaacgaaaaaacgagctccgtatgaatagtgaggatttgccccctgttcctggggttcttcacaagacttctcatgacggaaccaaggtaagctatgtaattggggagaaagctggctctggaggtttcggtactgtttatgcaggagaagaactcccatctcatacaccaattgcaattaaatgcatctcaaaaacacgcatcacaagcgaaagaattaagcgcaaaatttttagcgaggttgatattcaacgttctcttcatcatccacatatagtagaatttcgcggggtttttcaagatgataattacatttatatccttatggaatattgtcccaatggaacccttttagatattctcagacaaaaacgtgttttctcagaagatgaagcagcagattattgtcgacaaattcttgaaggtctagtttacttacatgacaatcatgttattcaccgtgatttgaagcttcagaattttctacttgatagtgaatggaaattaaaaattgcagattttggattaagtgccaaaatcattgatgacgatgaaaaacgaatgacaatatgtggcactccaggatatctttcacctgaagttattggtcatcgcgaaggccaaactactagtgttgatatatgggccacaggtgtttgtgcctttctaatgcttacagggcaccaaccctttcagtccaaagataaacatcaaacgcttaaaaagattcgtcatgttgcatattcttggccggaaaattgcggagtttctgaagtcgcaagaaactttgtagattgtcttttgcaacgtgacccagccatgcggccaccagcacgcgcccttctctcccacccgttcatcactcgccaggtcaccggcagcttgaaccgttttccggttttgtcagagcgaccgttaactcttccaagcacatcagtgcgaatttggtgggattattcccatcgttatgggctagcttatttactacacaacagtatttgtggagcatgctttaatgattcaactcggatcttaatgacacctgatgaatcattagcacaatattgggactcacctcaaaagccagctcctgaaataatatccatgaaaggtatcgaggaatcgccacatcgaaagaaactacttttgatcaaatattttgcatctgaattaaaacaaaaagcaaatgaattaactgcacctccattacgtattaatatgccaacagatgtaattggacatgttaaatattgggctagaactaacgatggggttttgtttagaatggcaaatcgagatatccaagcaaattttagagaccacacaaaactggtcatcgaatctgcatcgaaaattgtttactttgacaacgctagcgaagtaataaaagtgaatttgtcggacttgagcgataaagaaaaataccatgaaattagaaagagattcgcaattgtaaaagaaatggctcaacatttagtataaagcacttttagtgttacggaaataaattatatatatattaaattttccattttttttaaaatgacaaacaatttattatgataaaaataatgtttgaaatgcttaaaaagtcaaaacctaaagatgttcatattttttattcatatttatacaattgatttcaataaaaattaagaagttcattttgtttaatatttttggtgaaaatggaacagggtgccccaaaccaatgtctcaaccactgaaagcagaatggattcctgcacatattaactatgatggacctgcaaaggtaagtcagtactttgatagcagaatttcagaaaacaaaaatggacaatatattggattttttagaggacatcaattatttggaaagtatttagaacttccagatggttacaagcctgtcatagtaacaacagatgaaggtgaacttaaaaaaattgctgatgttggacaagttagactttgggatcttgacactccttcactcgaattttctcttcagtgcactgatgttattaaagttagcgacattttagcagaggattaatatattaaacttttattattatttctaatttttaaaaatcatatcttgtaatttaagtgaacttgaaatcactttaattctaaagcaacactcatgacttttattatacctggaattttaaagccattattttgaaaaattaataaatgtttaatttaatatatttcgataaaactaagtaatacctgaaaggcactccttctatgcaaaaaaaactatgaattattttctagattttgatacaatggtattattttttcttgtttttccagtgatcaataaccgcctgaccatttattttcagaattccatccaagacgtcttgaaatggaaccaatcatccaagaatactcttcacaaagtgaaggggtatctgcgccaaatgaaacggattctggcttccatatcaaagaaacgtggaaattagaaaattggtcaaacgtcgaaaacgagttcaaccttatttgtcagcatggggattatacatttagttttacactcactagatgcgaatcagattttgtaaagataacagttgagatgccggaagccaaagaagagaaggaattttcatttcaattttcagtcattaatgaaataccaaaagaaacaactaccaatccaaatcccataaaatgttctttttcggaaggtcaaaccaagcacacaataagaattccagtttttcaaagtgcagtatcaaatatccagaaaggatatatacatgatgacgttgttattatcgaaattgagattacatatactcccacagtcaaagtaatcccagtacaaacgccaatatatcatgtttccgagcccgaagtcatcccatatgttggacttcgtaaccaaggtgccacttgttacatgaattccatgcttcaatcacttttccacattcccgcgtttcgcttattaatatataccatggatagtaccatgcaaaacaaatcagatgatcaaaacatctgcttaaatcttcaacgattatttggccttatgcaattatctgattcgccagtctcaaccaaatcattaacgcgttcatttggttggagtgattcagatagttttatccaacatgacatccaagagttttgtcgagttttattagataatcttgaagagaagatgaagaagaccaacttggaaggtcggattcccgatttatttcgtggggaatcacgttcattcatcagatgtcgtaatgttgattacgagagttcacgtagtgaatatttttatgatttacaacttgacgttgtgaattgtaattcccttgaagaatcatttgtgaagtatgttgagcatgaagaattagatggcgacaacaaatatgatacagaagaatatgggaaacaagaagcagatatgggcgtcgaattcattgagtttccgaaagtattacatttacatttacgaaggtttcaatatgactttaattataatcggatgacgaagataaattcatatttttcatttccaaagactattgatttaaagccatatttaatacagacagaagagaatcaagacgaagattgggaatatgaattatttggtatattagttcattctggttatgcatatggaggacattattttgcatatttaagaactactccagaagaaaaatggtataaatttaatgattcgagtgtatcaatagctactgaagcagaagcaattgataataacttcggaggtgttgataaatatagcacgagtaattatgaacgtacatattcggcatatatgttaatatatattaaacaaagtgaaatccaaaatatttatcatccaatttcgaatgatgatataccgaaatcaatcatagattattatcatgatttcttaacaaagaagaaagaaaaagaagaaaaaagatatcaaatacaaaatacattacatattggtttagtagatgatacaatattagaatataatgcacaaaataataacttttcatttaagacaaagaaatttttatgtgaaaaattcgatgttaaacgttatgataaatgtgaatatttatatgcacaagtcgaacaacaaatcaagaaatccgagtttaagttatgtttaattgaacattataatactattaaatgtatattacctaattcttctaatacattaaatcaatatatatcattatattcaagtaaagatgtgttaatatttgtatattattataagaatgaattattacatgaagaaactccaaatgatgaattaatatttgaatatgattctgatgatgaagatgattattttagtaatacaaattacaagaaaattattttgttcgtttatacttatttatggaataattattttccgatacattacttgttttcagtaataatttcaatcgatgatagccctgaaaaaattttggaaatttatcgaatgaaatttaatatgccgcctgaagcgcctttaaaatgtttctttattagtaataatgaaatagaagaaaatgttaatatgaatgatttgttctcgaagagttctgcaatgatcttaatacaaccaaatcatataactcaaataaatcgtaaaattaaatttaaagatatctcaaagtatgggaaagtaattgataacaaatcgacgtatttaaaaattttaaatcaaaaccctttaaacccaataaattatttggattattgtagaaatactttcgaaattaaagtcacatatttaagtaatgaaaaaaaagttaaaaacgttgtagtgcctgaaactatatcatttttgaaatttaaaatttttttggcaaaatgttttaatattaaattcgattataaattcgatttaatattaatttatttgacagcaaaacaagagtttatagaaagtgacgatgaaataccatatgaaatttgcacgagggcaaaaagtattgaattccacttcttcagaaaaatatcaattgaatgctttacttatacaaaacgattattaatatacttcgtcttagcaaatggggaaactaatgacgttcatgtgatttatccaaaaagattaagtattagagctatcattcatgacatacgtcaaaaattcgaattaaaacttaatcatcctcctttaagacttttattaatgcagaaaagaaatgtaatcgaaagaatttgtcctgaaaatagctttgttagtgatataccacataatcctttacgtttggaatacattccagatgatcaaatagaattaaatgaaggtgaatggttaattccaacaatgaatgtttgggattatgatgatacaaccattaaatttaaccaaagatatccaccaaaagtatttaaagttattcctggtgaaatgttcggcgaaacgaaaattagatattttcaatgtttgggtatacaagaagacagatatgacgaggtgaaagaaattaggttttattataatgatgcaaactcattacaattactttatgataattcagtgttgtcagattttagtccttatggtgcaaggttaagagtggtattccccatgtcttctcaaagagaaattagtagaccatctcaaattctccctcgaataacaacttccttctcaacgaggagttcatccgtcaaaatttacaattgaaaatttgaacaaaaaacgatcagaccaatcaaacaaacttactcaaatcgaaagtgaacttcctcaaaaataaacgtataaaatatttttatgtgcggtagattcgctttaaatagagcacttgcacaaatcagaagagttgctggtgttcaaaacgtgaatacaaatggaaagacttttactccttctaataacatttccccaggatcagttgcaccaattgttacagctgaggaaatttctcttttattatggggtactcaggttttaactaacacagttattaatgctcgcgttgaaactgttatgaaaaaattccaaaatgatatcactcaaagaagatgtgttgttccagctgatggatatttcgaatggaacaaggagaaacagccatatttcttccataagcaaaatgatgaaattatgttccttgctgcattttataatcaaagaggagaatttgttattttaacaagagaagcaacaaaacaagttaactctatacaccatagaatgccaatcatctttggaattgatcaattagcgttatggtcaagtccaaaatgggaaatcttgatcaaagaaaatgaaccaatagtttcattttatcctgtttcaagactttctcttcgtccaggatatactggtgctgaatgtattgcaccaattaaagttgaaacaaaagttcaaaagtcattattagatatgcttaaaactaaagaaacaaaaccaaaaatagaagagattagtagaagtacaacagacaaagaacgcagtacgacagaaatttaatattacataatattgatattaatttgtaaaatttaattaaaactgtaatttattttcttgtatatatcttgaaacagtaaattttgttgtgcttataacacttttgtattaaaatattttaattgaatcagatatatcgtttttctttgttatagatgctattattaattgaagttattgttttactcactgaccgtagatgatatttcaccttctatgaaccgaaagcgaactattattcagaagatggaaaacttttttcttttcaaaaacacttttgatcgtgcgcacgtaatttttatcaaaaagttcggaataaattcgattttttctgcgtgttatcgtccaaacgtctggcaaaaaacctccgccgtttaattttaaattgcactagttgagagccaaaaacgcagaaaatttgaatgaaatgtacagatttgacaaatttttgattgaaaagaagttgaaataataaaaagtttcattgtttagtaatgccttgcaaaccaagctgctgtaaaaacgcactcattatgctcttctcaataataggagttctcctttcattagcactgatgattgttattgttgttaagtttggaatgatcaaagatctttatgataatcaaacattctttattatcttaattgtaattacttgtattggcgttttcgttctttttatgtcgatttctggtggttgcgctggttccaaaggtttcagaatttctgtttccgttttcctttatatttatggggctattggagcagtatttgccattctaatatatatatacaagggtggcttcgcacaagatgttgtaacttacttgggaatccatttctacaatgataaactaacagaagcaattgaaaaagcatttggctgttgtgcaatactttcgttaagaacagaatgcttgtcattagaagcaaaaagatgtgtttcttccattccggatgatattgagattttttcatacgtttcgttgggtgtcttcttcgctgcttttgttttgatgatcatagcaggtgttcttttagattgcacgtcttgcggatgaacaaaattaattaaaatttcaccatttgatttcatttcacatttctctttatttatgtaattgagtttttttaaagcgggttatcattaaaaggacaaatggatatcaatttactgcaaaattgtttcctcaagaaattggaactaatacagaagatatttttcgaaattattttgaactatttgacgcatcgcttacaaaagcacagtaaaattaggaatcgtcattacttaaaatagtgaaataacaacttaaaaaaaaataacagatttattcaataacaaatatcgatataagtttgacacaaagtttgcgccttagcctccgggtgatttggcttttccattttatgtgtctgggggcttatgaattcatttataaaaatgataattgtacgaacgaaaaatgtcaacattctctttaacacaatctgtgttttcaccattgcttttcccgtagaagttaagtcaactctgaataatccattttctaatggataaactaatatgtaatatttatttgaatttgataaaaatatattttcattaaaacctctgccactttctatccaaacaataactattggattctcaagtattaaattcattttcttgattttataaggatcatcaaaagttggcttaaaaagtgtcggagtttggaacgatatttcatataacaagtccgagtaaagtaaaacattcaatttactatcgtttgatgtaaagctgtcataaccgctcttcataacggttaaatttcctaatgaaactaaaaactcttggaatcttggagaggtttcttctaatgtcattgtaagcaaatcagattgctttgaatggttttcatccgtgaataataaacctactttcaaatgtttctttgatagattatcttgaaatgattttaaaaattcctttgtttcttgattcttaggtaaagataacaatgtttcgggttcaagtggatcaagaattccaagtaatgtcattggtgttgatggttgtaatggtgaaatttcactcatttcaacaacatttacaggatctgatacttgacgcatgaccttttcatacgatgattctatgcttttaagtgatgccataatttcattaatcaatggaaaagaatgtaatgaatttgttagatcagatcttaaatttataatattcatgacctcagccaaaggccttgtaaagttctgttgaaagtctgggacaaattcatcagttaacttaattgtttccaaatcttcgaaaatatttggtaatattttttcgtctgatttaaatggcttaaattcccatgaaaatattccagaatcacttaagcacattaagccatcttttgaaggaatataataatttccaaattgagtcaaaaacacgttttttgtttccgcatcaaagatttgattgaatgggtataacccaaattgagatgttaacaacaaaagtgacaattcaaatttttgatttttgttttctttgttctccattaaaaaattcaaaaaaatttcataaactttggacttatagatcaaattataattataaattaataaagatgaacaatataatagaaatgtattataccaatttatgttttcaatattttttaaaactaaacaaagtctgacaattttttcaatgaaatcggaagtttcggtttgatacaattctgagattgaatgaaataacggcaacgaactcagtaaagcatacaaaactatgtcacttttttggttaattccttcgataattctgtcaaatgaatttataatgtaattattcactttattatttgaaagtaaaacgaaagaaatcaattgaacatatgagtgaataattaacggaaattccttgaatgaaattttatttaaaatttcaattactgcatcgaataaattctcatttttataatccaaaacatattcgtaatcattaattaattgatctttttcatcatttaacatcgatttaacatcattaatgaaatcttctggaaaataaaacgttttaatgaacaatggatatgatgtaatgaatccaattattaaatttgttaatttaattttttctttttctattaaacaaattaaaatcggaattaaaaattgcgaaccagaaaaactattttttatgaatttgatcgatgctttaaatgctttgtaacgaatttcttcattttgatttaataacatctcaataacaattgaatataatttcgttaatgaatttatatcaaaacaatttttatatgataatttcgttattaatttatataaaatgttaaatgatataaatgaaatttcatttttttgatatgtaataacattaatcaaatattcaaacgaatataatattaagttatactcgttttgttctatttccattggccaaacatttaattttaccaatgaataaaaatatgataataatggaaaacagaaattttcatttgacatgtcatcgaataatgaaatgtaataatttatcattgttttgttacattctgtaattcttggaatagatataaacgaaagttctttttgaaaagtttcgaatttttgtatttttaacgatatttgtggaatcggctttaaattcgactcattaaatatgttccgaagattggaatataaccaatcatttttgtggttgataatatgttcattctttttaagttgtaaatatttatcacaatattcaaataattcatcgatttgcatttcgaacattgttaaaaatgattcgactgcgaatatttgtgaaaaatgaacagcaattgataaatataatgtgttattattaattaatatatgtattaaatcttttaagtcgatttgtcttattgtaataaattgtaataagaaacaaaataaaaatgaaacactgacacttttggatgaatattctttaaatatgaaaacaaaaaattccgaaatttgttgtatgttttgtaaagaaaaaatcgaatcaaaaaaggtggtaacaaatcgttcggcaactgttattacaactttgttctctggatccggatcttctaatatttggataaatattttgatgattttaatggctttgtccatcgaatcattaaataattctttgatcttgacaagcgatgttaaaaatgttaatatcgcaattaagtcgcgtttgttaagtgtgggaatggttgcctcaaaaaagtatatgaaaatggataaaatcgctgaagattgtgatattggtaaaatgtcatttttgatgtcattgaattgattaacaaaataataaagttgtgaaacaaaggtttcgggtggaggacttttgaagccaacatctaaagcacattttggacatgattctgctatgctatgataggtgatggagagaatgtatttggaaagaatatgaacacatgtacgaggaaaagctgaccaattgttgttaataaacttaagaataaggttaagttgtgattcagcagattctaaggtggacgttgatggatcaggattatatatgtgcttaacattttgaaagagagatataagactttgctcttcttctggatcacgagaaaatctgttatatggaatcataaaagttaaggaatcatgaaataaatctaaatttggttcatcgactaaaacaattaactgaagaagtaggttgagagctgttgtacgtatgctttcaggtgaaagtggatgcatcaaaattgagaaaattgtatttaaagtgctcgcattatgtagaattgtactctctgttaagtaaggaaatatttttgaaaatgaactaaatattttattgaatattttttcaatttctttgtctttctttgacttatttcgaccattttgaggtgattcagactgaatacttataaattcaaggactagattcagaaactcagcaaagctatttgttataaattgttttggtgcaaatgttttatctttaaggataaattttagttggctcgaaagagaaggcatttgcttgtcactttttcagtagttaagcaaatcgacctagtcaaaaaaatcatatcgtctgatatttagagcagttttctgcggtgatatttatgaatttgatagcagtgtcaaatatttgtcaaacaaaattgaagcaactgaacgttttcaagaaaaaaaaatgaggcaagacttcaatttaatcatgactaaaaaacatataatctagctctgtagtattactaagcaagaggacagtgagttcactgtatttttttgaattcgtttcgaaatatattttcatttcttttgttataacaatgattttcgatatattaacatgtcatcataaagatgctcaagcaagtatatataactttattattaaaagttataaatgaaattttcattcacaaatcaattgatttataatatttcaccatattttccataaacactatttagtgcatcataaattcataatgagggcaatattactgtttaaatttaaaaattaatttcaattatattccacatcccatgtgtaccaaaattatttaatgttactgtgattatgtaacacagatataaattaataatcatgcctttttcaataaatgtctttctaacaacagggaaaataagaaaacttataagttgacaattaattgacaaaaataaaacgattcaaaattttctgacatattttattgaatgcaacaggatccattttgcaataatgtcacagaggcgcttaacagaaaatctcaacacccttatatgactttaatcgtatctattgaaactgatcaaaacatcatgaattatttttgggataatcctttagttcatgctactgtttcagaaaatttcatcattttgagaatatcacaactttcaaaccaaacagaaataacacaattttcacaactttttcctgtttcaaatattccatctttatttgtatttggtccaaattcaaatggggttacctattcctggtctgacaattatccatctgctcaagaattttataattatttcaataaaaatgaagaacaatctgataatatcaaatcagatatttccgaccaagaagtaaaatccaatcaaaaaactaaaattgctgtatactttaataatcgtgttgtcactaaagaatttccaatcaattcaagacttcaagaattacgtgaatggatcgagtcagaattcggaccaggattttcaatcttcttaacacataaacgaaagagcattgatgacttggatgactctttaacgattaagcaagcacaaatgtgtccatcttcatttttaagattaattccgaaatcagataaaacaacgcaagaaaatatgtcaatcaatgagaacgaggacttgccatacataggcaacgaagaaacagcagaagttccggtggaagatgaccaaccacaaaatacattcacgaaatatttgctgaagtttctttcgatttttaacccttttgatgacgttgttgaagtcgaagatttcttccaaagcaaagaatgaaataaatatgtaaataaagcattgtttaaacgactaatgtaatttaatattgagaattgttggttcttaaaaaactgaagctattaattttgtatattcgcgcttacgagttattctttttcaaaaaatatttacaagttttggataacaattatggatgcaagcaacaatttataaaattatataatttttatataaagagtgaatgatcttaaccacaaaggaaatagatttttagtcgaaaatgtacacaaagtgggaccctcaaaaaatttgtcaatatattttttcaattccatccattggagtattttggctatcgtcggaaaaaaaacagttatcaaatttgagacgcactttttctgataaaaaaacgttggtttgaaaacaaaaacaattgatgttgataatcgtgtcgataaaaattgggcgaaaattgtgtttgatataaataattaataataattaccataaaaacttcgttgttgctcggtgaaaggaaagacataccaaacttaaaacagaacatttaaatgaataaaagcattcggttggcgctgtatcaattaataccatatcatattatcccttacatttttgtgtatattgataaaggttttcaatttcattttcaaattgtttatttttatcatgtctaattatattatacaattgactagccaaaaaattggttgcattaaaacggcgaatgagatcgtaggcattccaaatcttgcttctttattcattttgtctttttgatttgaagttaaaaggggaaacttgctttctactagattatcgattctcgagactatgacaatgataaaggctttcattattaatccgatatattatatttttttgtattctaattgtaaaagtcgttggacattcatataatttctttgcatgaaacttgcatacgaatttcgtatattatatattgacattttttctaatatagattcgaatcattacatgaaaatgggcaaatctttttaattgattcatcttttattgttgtctttatttcattatattcagtgatgtttcttcctttcaagttacctaaaaagttaatgaaatcagttggtgtttcatatcattcgtcatttttgggcgatggatttgtaagtcctaaactttctaattcgtgatttattttgtctgaaatgcttaatagagcataagaaaaatcaaaatggttatcatttaaagtttcttctggatggttactttttcatttgaattaatgaacatcgtttcgttttattttaaaataacgttctaattatatatatatataccaccactcagaacgttaatagcatataaggttagtaataatatagataatagtaataatataaacttgtgaaaataaatcggcattgaggaaactcaatgaattttttgaatacagaccgttaattattagggatgaacaaggctgagaacataatcaacctttacaaacaaggattcagccaaaaacaaatagcagacatactgcatgttggaactcatcgagttggtgatacaattcgacagtttacctcaacgaatgaaattccaaaacaatcaaaacgtggaaggcctcaagtaattaataatcaaataaaagaatatatcgaaattaaaacacttcaagacgcatcattaacatcagttaaattatcacaacaaatagaagatatttttcataaatcaatttcaccacaatatgtctcaaaaattagaaacgaaatgagatttcagtatcgacctcctaaaacagaacagcttttaaacgaagaacagattaatgcaagaaaaaaattttgctcaaaaatgttaacacaaacacaatttttggataaaattgccttttcagacgaatgtagatttgtattaagtaaagacaatagatgggtgtgggtaagcaaaggagattatactccaaattcaatatcaagaaatgtaaaatttccccagtcaattatgatttttggggtaatttcatgtaactataagagcaaacttgtaataatacaaaaatctgtgaactctgagcaatatatagagaatatgattaaatctgatttcatcaatgggatgaatgaactacatggaaaattagattgggtgtacatgcaggacggagctaggtgccacacatctgttgattctattgattggttggaggagcgactcgatgtgattactgattggccacccaactcccccgacttaaatcccatagaattactatgggcaataatgaagcgtattgtagctgaacaaatgccgagcactgtagaggagcttaaaaaactgcttgaaaaaacttggaatgaacttgacatggaattaattaacaagctttgttcgggtttcgtcgaccgtttacgcctctgcttggaaatggaggggcagtcgattttaagattcttaggattagcgaaagatttaaaagaggctacactaaaaaaaagagactatacgcgatggacagaagaagaggacatgttacttcatgatttggtaacaaaaattgaacatcaaaaatcatcaaaaattgatttcccaacatataaacaaaagagatccgatttcatgcaaaaataggtggtacacatgtgtaagaaagaagcaggcagaaatattggaaaaaaaattaaaaaatttattaataaaaattgaataaaaaagagattttcgaaattaaatcgacaataattcagttgtcaattttgagaagtttacatactatcttatcatttttcaatctatcgtaatgccgaattattttcaccagttcatataataatagcaatatttcttatagtaataatatgtttatgattggtacaataatgaaattctttcaatcttacatacaagatgattttttgatttaaattatttttattcaattctgatcccattcaatttttttaatttaattttatatgatacaaaacggcacttattttattcaattttattcatttaatttcacttggcgtaaagagtcactacttatccaaaaaaacaaaaaatttgaaaacataaatttataataattcaatggaaacgaccgtcatgccctggaatacgattcctcgcaaatattttgtattatgggactgaaaataataaggtgtactcaatagacttccattaaactttaagaataaataatactatgaataataattaattttttgttgttatgaatttttcatcatttttttcacaaaaattatcatcaaattatatgaaaatcatacaatgaaatatgatataaaatattcgatttatcaaatttaatgcgttaataataataataatatatgaaaacaaaatgaatttaggaaatgtttatttcaatatttaaatatttcctcttttatccttgtgaatcttttaattttattatgtcgtcacatttatgatgttgaattttgtctgcaaataatcgaataatttctgcatttttcttttctgatgctatcataagcgctgttttatatgtttataagtaattccaaatgtttatatgaaatttcatattttttaaaaatattttaaataaaacaaaaaaatatttttagcatcgatatcaatattctcttgttcaagaagtaatttaacgatttctgtatgaccttttgaagatgctaacataagtgctgtataaaataatttaaataatttccaaatattattttgaaatatcaaattataaaaataaatattaaatataacaaataaatatctttatcattaatatcaattcctttttgttcaagaagtaatttaactatttctgaataaccatatatagatgcatcaataagtgctgtttcaaataatttaaataatttccaaatattattttaatactaaaaattattaaaataaattttaaataaaacaaacaaatatctttagcattaatatcaattccttcttgttcaagaagaaatttaactatttctgtataaccattttttgaagcatttgttagtgctaaaaatatttaaaaaaaaatttaaaaatttttatgaaacgatgaaatattttaataaaaatctaatgaaataaacaaacaatcttgctaaaatcaatgtatctattgttaattcaattgttataaagttccacatttccagaaaaacccgaaattttcaaaaaatcaataggaatatgattactttcgagaaaatattgagtaatatataaattccctgttatgattgaagcaatgagaatattttcatttattttcattccttctttaagtaaaaatgataaaagttcataattatcatgtaaaacacattttactcctaattcttctaaattcttaatttcttttaacttattatcataaaaatatttaaagatatcatttcgatgaaattttattgctgtttcatatgccccttcaaatgttgaatgattttgttcacataaatgaattatttcttcatttccacctgcaattgcatatttacctgttttatttactttcgaaccattcataagtaaatatttaaaacatttaattgaagaaaaaaatgctgcataatcaattaatgtaacatttttatgattaataaatgaatatctttcataaagtgatggtttaattctttgattgaagtcaaaatttgtttgtgatgatacttcttgaagtttttctatttcatcattccgaattattttcgcaatttcattctgatttattccttctttaacatatttctgatgaagttcccaattattcgctttaagtttttcaaggtttttggagaaatattcagaaaattgatagcgatagtttaaaacgaaatgtgctttaaaatgtgaaaaaaataaatttttcatatttttagtaatcgatgagttaattaaacctttttctatcaactttccgataagataattagattcttgtgagttatttttccgaaggaattgagaaaagacgtcaattattgaaacttgatttttatttacatctcgttcaattaaattcaaaaactcaataattatatctatatttttcagtcttgttacaaacaaagtgtaaatgaaacggcagatgatcaagttgaatgaatacgttcgtgaattatcataaaattcgcgtaatgaagaaacagatgtatcaagattgtttgtatttatgttataaattatttctgtaagtgcaattaagtctggaaaagaatttatctttgatgtactcattccaatgctattaaataacactgaaaaaaattttaatggacatgtgatatgaatttttatataagtattaatatataagaacaaaacagtcggttgacactctaaccgtaatttcttctcaaaaattatcattcaatttcatctatcaaagcggctcacattttttcctagaaaatttcggttatttttctgatgtttattctttacatatatcgtcattcaatattgaaaagtttattattagaaaaagtttcatcttcgaattaaatgatttacttacgtactttttccttcttatccttcgcgctggttattttttactatatcatgtcaatcagcgagctcttatatataatgatttgtttcattttttttatcaatttttttctttttttatcttctctttattttattcttaacttattattcttcttttatcaggatccagtataaactgccctacttaaaatttatttttttccaagaaatctcggcggttgaatgcattacttacgattaaaaataaacaatatttcttccatatgatgtactatttatttcttgaaatattaagatttttgataaaatttgacagataatcaaaatttatattgaaataaattgaaaaaatctttctattacatttttacaaaaaaataaaataaatacattttgaattgaaaaaataatagttttgaattcaatttttttgatgtattttgcgttttttgttttttctctcttctttttctaaattctaaatttatttcagaaaatatattatcacattattacatggaatttctcatattaatttcaaaattgaattatgctttcatgatgatttattcatcatttctcttaatttttttccttttcttctactttttcaatttcttctttttcaagacccggggaagatatcttcggaaaatttataaaaatgtaaaagaaccattttttttattttatttttatatagaatttaattatctgtcatattttatcaaaaatcttaatttttcaataaataaaagatacattattaggtagaaatattgattatttttaatcgtaagtattacattattccacgagatttcttgagaaaaaataaatttccgaagagaccgtttatgaatttatcgaataatcgttttttattcaatttagtgtgccgcacctttaaataagattttcttttctttgttaaatttgatgcctttgaaaattatataattttcctacaaatcaatttttttatgataatataaataatggttattctaggtataataatttaataatttctttcctatcataaatatcaatcaattgatatatcaattatatagaagtccaatgattttcccgttgattgatgaataatttttttgaactaagaacaaaataattgtattaaactttgattttaatcttcatatatggattaaaatttcttcttacattatttatattatctctcacagaaactcgacttattaaaaacacacatcacgatagaaagtgggtaattaatgttatgtttcagaattatatttaaaaattattctaaacattcaacacagcacttatgaaagcatctaataatggtaatctagaaatagttaaattacttcttgaacattaaggagttgatattatggttatgatctatgtttattataaaatcagtttaaccgatttaaataaaaagtgattgaacctcaaaatatcttctttaataaacaatattttttaagattaataaatacatttattatgaaaatagctatttaaattcaaattgtaatattatattcagaatttaaagagagaaagaaaattagtaaaattgattatttataaattcgagccttttcttcctgcttataggatattgatctaagttattttttagatattaacttcaatcatttccatgattttgttctcgttatttttgattttgtgcgtaatctgtagttgatatattattggttttttcaataaaatatgatattttcttaatcatctttttctcgaagtcaatacaaattgtcatgtgaattacattattaattaatattaaaattaaattaatttattttcttaataataattttgtaaaaatagaaaagagagatggcggagacactttttgagctttgctcaaaaagtggcattacttgtaaaaaattaataaataaaaacatagaatgaatctcatggtgaaatccattcacatctttaattttatttggaatacttaaattttgaaatatgttaataggtaatatatgcccgaatgtgcattcacatatcgaaaataacttatatactacaattcattaatgaataactttattatctttctgccatcccaaaggcagctcatcatttatctcatatacttgaagtttttcattaaaaaatatttcattattcaaccgaaacgcatccatcttgcccaaatcgttttatgaaaatattctgaatcttctcagatccctttccgaaggaagtaaaacctggttcaaaaagttgaaaatccaatttttttcaaataaaaatgacggttgaaaaccgctataaatgatgagattggaacaattgctaaatgaaacttgttcgatttcaggatatgtaagaaaacataaatttttatcatttattatattcattttccattttagagcatgtccattcgaggctaataaaaaacatatctgcaattattattatttgaaaaaatatgatatattaaattagatcgaataaaaaatcggtttgggtggtaaattctcatctacttgatattttaattatacattctatagtctttggtaaatattaaaaaaaaaaaaaactaaaataattcattacagaattatcaggaagaacgagtaatggaatgggttttcttcctttaatttgttttagtttgaattgaaacaattcacatagcgatggcattaaaaaaaaggttttctttttggaaaagtgctgagcaaatttgataactttttttgctgccccaatcagagtatttcctttaaaaattatatggtctttaaacatgaatgtttataattttctataataaaaaaaaatgatcattcattaatttcctatagaaagtttataatttcatttcacacatgaaaatacacaaccatttacatatttaataaattttctatttattaaaattacacatagaggcatattcccaattttatatcgaatcaaaaaacgtcttgcgaagaattacaacaacttccatcactacattttcagtcaacaaaagttttttgctttgtatatcaagagcagatgttacagccaaacacttttgtgaaggctgtatttaagagctgctgtagccttgttcgtatatgaaaaaaaaatatctaattttcatattaatatataattatcttccataaaatcttgagcaaatggatcttcttcaatactcagtggtttgtcatttaatgaaaagttttctgatgttcctgctgtaggaacaataatttcactattttctttacttgatttattttgcttatgtctacgtataataataaacattatcaatataccacaaattattattattatcactgcaattggaatacttattgcaatagcaatgttcgttttgctattatctccatcattttgtgtaaaaagtgtgaaaaaattagaataaaaaacaaaatatttggaataaattataacagtgtatttataatatatagaatcgacataaacgtaactgagaccggaatatttcatttgagtctttgatatatatgagtaaagaattattgtttgagtaaatgaaatagaatgaatcgaaacaaaagtatgtgataaactgttgtcatattgattaaatgcatttgatttatttgttgtacttgatttagtgataacattcgaatcagtaaatgcatttgatttagaaaaagtattggatttagtaaatgatttggttggctctggaattggtattttgatacttgctatttcaccaatgtttcctgcattatctacagccgcaacgtgtacatagtttccgttttttatttgttcttttattaatttgataaaattattttttgtttgagataataattcacttgaggtagaactattatttggagttattttatatttatatattttgattcctgaagatacttcaacttcaacctcagccgttgaagcgattaaatcatcattattccttgagtatgcttcaattttatatttatacaatgatccaacatcagttcctttgatcataactgtatattcttcttcattataagaaatattaactactggtggctcaaaatcttgtgctgaatgatcctcaataaaattatcataagtcctttgctttaaataaaatattgtatttgcaataatttgaccttctattggccttgaattacttaaacctgattgaatcactgccgtattattatttgttgttaagtaataaccatgaagaagtccgaattcacctctttctgtattaccgtatgatgcccaaacatctcctgtagatgcaccagatgcagatatagaattcaaatatatagttgatacttttgaaccaattttataagggtagttcataagtaatccatcttgtataacttttgcattgttcgtactatagcccacataagatggttttccgccattaacagttgaatcagctcctgatactttaattccaaaaagatcccgaattgcaagcaggctttgagcattacttttgatataaaaattatcatcaatggaatcatatccagtaaatacaccataccctttttttatatattcagcaataacatttgtggctgttgttgtaagaatattataaccagaactatacttcgctgaaccaaagaaaatcacatcatagtcatatatgaaatttggttctactgaaatattagattcaaaattatttattgaaattggtgtgacatatattacttgttcgcctgttcttggatcaactccatttggattgaagattgtggtgctggtttttgttgacatagtgccaccttctaatatagccttaagggcagctgatgaaggcaacgaatactgtgtaaaatcattaccaaatgtgaaattaactaaagatgtgttatagtcgcctttatccaaatttgtttgaccattgtaaccatcaatttgacttgggtaaacatttagaacatttataaaagtcccttttatatatgtgctaatttgtccccaattggtcaattcaccattgagattacctttgctttgaaaaattttataatacacattactctctgatagattcgtccaagaaagatatgttcctcctcttttatatgcatatgatgaattacaagttgccctagatgtaaatgtaagtggttctgagagtgcatgaacaaggaaatagatcataaaaaccattgaagcaacttttaaactaaatcatttttgaatgagcgatcaaattttcatagcaactgttctgaattgaatgttgttcaaaagtgtttcggcagttatcaggctttctttgaacgattggtacgaataaaacataagtggagaaacttcaaataccgggagtcaatacttttttgactacatgggctatactgtaaattgattaccccaagtctcaaggaaattctgatggacaatattgagatattataacgaatttgttgattatttttgttatgtaaattgacagaaagggcgacaagtacgtttattttttacattttttgacaaaatgaaaatatctttccttttaaagatattatttagatattattataatatttatatatagaatatgtgttgaacattttaatatatgtgaataaattcgattcaatatttttgttgagttataagaataattaaaaaaataaatgagttttctccgatacgtacaaaagaaatcttacagtgccatcaacgaacaggtttaaagccaaaaagacgatcaaatattttttttagttaaaaagtggaaaatttttagcttccaatggtcaaatttttgttcatagctatataagagtgttcctctatatatagtagaggtttgataattttcatcaagaattttttatttttaccacacctatgatatgcatagagaactatttagaaaaatagctaaaacttgtccatcagcttttaaaagatattctaaatataaatattatacattgaataaattgaaaatattccaaaaaaatggaacattgtgtcggtacttcataaggtattttttttttttatcatagaaaattttataattgctaaacattactattgattgtgactagtcatcatattcacctccgaaaagtatggcaaaaaatataatttttatgttaaagttgagtgaaatcatgacttttttgaagacttaacaacaattacgaaattttggagagaaaaaaaatggcagcgacaaaaaacattgtgtcaaatgcaaataaaatgttagagaaagacaggtacaccaaattcagcagtaaaagttaaaaaaatgagaatgaacttattttagtttattaataatattttgtaaataaaataaagtgtttaaaatcctttcccatcaataaagcaaatctgagtacaatgtttgaatataggcttaatgatttattgtaaagatttggttcagagcgacgtcgcaaaatccgtggccgttacttacacaacaacattgctgctaacattctgtggtttatctgaaaaaaattttcgatgcgattcagttagttaagatcggcgagtgatccaactgttgaagaaaaaaaatgccgaatataaaaatgtcaaatatattaaaaaccagatgcttcctcaacaccaaaaagaatttgtatcatttattgaatggcaaatcgaacaaaaaatatttgatattaatggtaaatatgtttctcatgaagatttaacgtttaatatttttttttggaatttatataaaattaatgaaacagcacttcattgggcaacacgcaaaggtcattctgaagttacaaaagttcttcttaaacaaaaaggaattgatgttaatgctaaagatatttatttgttttatttgaaatttattataataatttgatatttcaaaataatatttgaaaattatttaaattattttggacagcacttatttgggcatcttattatggtcatacagaaatagttaaattacttcttgaacaaaaaggaattgatattaatgctaaaaatatttacttgttttatttgaaatttattttaagaatttgatattccaaaataatatttggaaattatttaaatcattttggacagcacttatttatgcatcttcaaatggtcgtacagaaatagttaaattacttcttgaacaagaaggaattgatattaatgctaaagatatttatttgttttatttgaaatttattataataattttatatttcaaaataatatttggaaattatttaaattatttaatacagcacttatgttagcatcttcgaatggttatacagaagtagttaaattacttcttgaacaagaaggaattgatattaatgctaaagatatttatttgttttatttaaaatttattttaataatttggaaattcaaaataatatttggaaattatttaaattatttaaaacagcacttatttgtgcatctataagtggtcatacagaaatagttaaatcacttcttgaacaagaaggaattgatattaatgctaaagatatttatttgttttatttaaaatttattttaataattttggatttcaaaataatatttggaaattatttaaattatttaaaacagcacttatgtttgcatcatttaaaggtcatacagaaatagttaaattacttcttgaacaaaaaggaattgatattaatgctaaagatatttatttgttatatttaatatttatttttataatttgatatttcaaaataatatttgggggttatttaaaatatttaatacagcacttatgcatgcatctgaaaatggtcatacagaaatagttaaattacttctagaacaagagaatattgatatcgatgctaaaaatatttttttgttttatttataatatttttaaaaaatatgacatttcatataaacatttggaattacttataaacatataaaacagcgcttatgatagcatcagaaaagaaaaatgcagaaattattcgattatttgtcgacaaaattcaacatcataaatgtgacgacataataaaattaaaagattcacaaggataaaagaggaaatatttaaatattgaaataaacatttcctaaattcattttgttttcatatattattattaacgcattaaatttgataaatcgaatattttatatcatatttcattgtatgattttcatataatttgatgataatttttgtgaaaaaaatgatgaaaaattcataacaacaaaaaattaattattattcatagtattatttattcttaaagtttaatggaagtctattgagtacaccttattattttcagtcccataatacaaaacatttgttcttgagtcgaagtacatcgttacgactgcgtcctgtaactcgaaagtccttaaaatcctcaaacacggcaaacttaacaatgtcaacttgttatttaagtcggacactgccaacacgtaatccttatgtgcaataatcatttcgcaccattgtattttcggactttgaatttccaattcttcaattttatttaaatccattccatatgaaaatatttttaaaattttatttttaataatttcacaacatatcaatatacaaggcgatgcactaatttttaacattaaaatattataatctaatgaataactatattgataagaaccatttaagaaattaaatgatgaaatttgtcgtgatttataaccacaaattaatgcattacttacaataccgatatcaaaatcaataatcgtcgctggatgtgcactaatttggaatttcattgtcgctggttgtgtaaaattccatttaataatagaataatttcgtgaagcggtaacaaaatcattcgtactcgtaacttttaatgaatttattaatgaatattgtcgttgtgaattaattaatttaatagttaaattattaatatcaatttgaaacatatgaaatgtacaatcattacatgttgatataattaaaatattctttttttaaatgatatgaaattgtcctttctgaaataccttgaaatcctgttaaacaataactaatatcaaaaatattttcatttttattattctttaatattaatttacctaatgatgtaataataattaaaatattattgaatgtcgttcgaagaaatattggcttcgattttatttcaatttgtaatgtcggtgtaaataaagataaaataaaattaatcgtagaaaaattaattttcattggatgtggattcttaaagatttgatttggaatagtaccaaaactttttactaaattgttgatataaaattaacttttctggatcttctattacttgtttagtcatattcgtagggatatgtataaggatgaaatgtattattagctaaaattgcttctttcccattttgtttatatccaaatattaaatcaatccatttaggtaaatttaaacttacataatcactttctaatgctgctcgatgtttctcaatgaaatcatacgcatttttactccatggtggtaatataacatcattaattttacttccatctgatttgattcctaaatcaaaattatctgaattaattaaaaatcgtggggtactataaaaattctggtattaattctcgataatctgttaaatctggtgatgtaatagattcccataaatgaggaattgatgaaaaaaattcgacttgatttatcaaatttattatcttgcattttaatattaatacttgtaaatggttctaatcgtattaaataatatgatacaaaaatatgaattagaataatgaactttatataaaaatttgttttcttcatccatttctgtaattaattcctttaaatgttctaatcgatcttcatttaatgctccaataggtttacttaaatctcgataaacattcggatcatttaaatcaatagtttcactcgtataatcttttaatacccatggaaaaactggatattgtgttaaatcattaaaacttcgtcctgaaaataaattaattatgattaaatatttataattagaaatttctccattaacccatttttcagtaattttttcttgttctaataatgatgaattcgatgtttgtaaatattttaaattaggtaattttaattttttaagaattttaataactgtttccttaatattttgattcggaaatattattaaataacttttttgtgtagttaaaaaaaattctaaaccacatggaatatgatattgatttctttgtaaaaccatatataaatctttaagtttaatttctattaatcgatgtttaatattattattaatattatctggtgtgaaaaaaacttgattcttattaagataaaatgtaccttgaaatgaattatttaatttaatatgttgtgctggtgaagcaaatgaatatgtatatgtatcttctttagaatcatcaatatttatgtcattttcattattattattattattattattactattatcttcaatagttgtagtctctgttgaattagttgtccctgaatttatttgtttaaatgattgtaatctttgtaatgcttctgtttgatcacgtgaatcacgtaataatgatgcaatttgatgttgatcaaaatgtttattcggtcgtaatatattatgtctccaatctaaatctaatgtcgatgataatttccaatgttgttctttattaatatgaatatttaatgaataattaatttctaattcttgtaataaatctttatatatcttttggatatattcttgattatgtaaattatataaatgttgttgtttaatggtagaaattaaaatattattatatttagaaaaaattgttttattaaatataagttcattattaaataaattatttatcgtagtacatatttttgtaaagttttgcatcatttgtgtttgtaatggaactgttaaaataaatatcgattgtaaccattcacttgatgtaattccataaatttcaggaataggttcttcaataactttttgtttaggaaatccattgattaaatctaatattaaaatttctatttgtttatatattgttggatttttacaaccaataggatataaatacattaatattattgataaacattcaattataatatcataattattaattaataataaatgtgatttatataatggtaaaaattgattaatatatttcgaatcaattctaaatatattacccattaaaaatgttaaagctgaaaataaattgatattattcttttgaatattaatttgtttatcatataatgaagaattaatcgttttcaaactaaatattaataatttaattgataattcaatatcatcccatgtaccatttgatgttcgtaatgataatgaaaagaatatatcaaaattcgtattattattattaaatatatcattaataaattctaataaagtaaaatcactatcaaatcgtttaactaaaaatattcgattttgaataccatgtctttgatataaatcattattttgataattttgatcataatttggtataaagaataaataattaaatatttcaggaaatacattcataaatatattttcatctttaatttcagtattatctaataacttcaaaaaaatcatttttaagtaacttactgtttctaattgttttttatattgtattatatgtaaaaatgaaattgtattttgcaataaattaattttttgttttattactatataactaacaatatgtgaaaatatatcaattaaagttttattatgtaaagctattgaaggttttgaagattgtgtatatatataaaatatatataaatgccataaagaattaattaattgatccaatgatttttgtatcaaaataaatgaaagaaaattattcaaaaattccatacatttatcactaaaatgatttgaaataaatgctattaattgtaataatccataagaaagttcaggattactaaataataattgtgttgattcatcccaaattttgatagtttcattttcataattataaaatttaatatataaactaattgctatatctaaaggataaggtatagtttgtaattgattcttttgatataagttttgtgataatattatgaatcttaatccataacaacgaatttcttcattaggatcagaagataaattaattaatgctaagtaataattttgatgtaataatatatttcgactatcaaagattttttgttcaattaatttatacattaattctaatgattctaatcgaatttcaattttcgtattatttaaacaattttgaaatagataattcatattagataaagaaaatttctttttaacatataataataaaaactcatataatattttacgtgattcacttgatttaatactaataatgaaattaaacaaaaagataaatcctaaattttgtaataaattaacagatgtattattttgtaataattttttatatattttctcaactaatatttgtattgttaatttttgatgatttttccatatgttaatattaaagaatatatattctaaaatttcattcttatgtgaaacatcaattaatgaatcatataaagtatttaatgaatcgaaaaatgttaatgagaaattattacgattaactttagttaattgataagctaataatttagcgcaatcattcgaaaagaataaattttggaattcttcagaataacttattaaaccagtgaaaagtgatattaatgtattaaagaatgaagcattatctgtttctgctaccatagttaatactggcatatcaacttgttcgaacaaaggtattaataattgaaatccactcatgttaaatacatttccaataaaattacaagaatatggtactatatcaccttcaactaatgctggattcttaaatttttgagaataatttaaacagatattattttgtgtcattcttgaattatataataaaactaaagaattttctaaatcattttctttggaaaataatgtattaggtaatgatgggaataatttactattagatgatataaatgaataaaaataatctaatggtaaattagttatatctttttgtaaattaggtttgataaattgattaaataaatagattacactaatattacatgttaatgaattaccattttgaaatcctcgtgcaatataaaaacattttattgtatcagctctaaaattatttgcggataatttatcaagtaattgtccatcaacaaatatcttaaattcattgttatgatatgctaatgtaaagaaataccatttacctgaatctgatgaaaagtttatatcatgaacattttttttggattttttatttgtttgaatttcatatgatattatattattctttaatatgatttcaatcattgtatcattagctgtttggaatgataataatcgaggttcattactataaaatcgtattgtgttatctaaataaaatcgtatcattaatgtccatgatttatttggtgtagaaaatggattcgtagttttcattcctgtatttaatccactaaaatggataaatgatgaaggtaatgaagatttattatgtaatacattttggaaacatgttaataaattataagtccaccaaactcgatgaccttgataaggttttaataaatcaaatgactttaaaaatgtctttggcataaacaaaaatgatgttgttcttttaataatatccattgttttaacaattgaagtaattttattaccttcttcaaagatagataaatctggataattacgtatataatctaataaaataatcaaaaaattcgattgacaaatatgtaaacaatttgaaaatgattgttcacatatagataatataaattggataattatcgaatgttgtggtaaatgacatgtagaagaatgtaaaaatgataaagctttcggaaattgtatttcaattaaatctggtaatgactttaaatatatatctttttcaaatactattcttaaaattatatctataatattatcatcaaatgttaattgtgataataactttgaaaattgatcaaaatatcgattaggtttacaatacataaatcgttgaccctttaaacatttaaatgttaatgtagaaatccataaaattatattttggataattcgaattgaattttgaccaattttatcaattaatgtttgtgctttttctattacaaatggaaaaacattcagtttttctatttgttcaatcattgttaattgatattgtgtagattttaatatataaaataacttttcaactaatttaatccaacgttcatcttcaagattattaatagattcattaataacatctttgaaataattaaagaatggttcatattgtgtagtattaacaaaagtaatttcttggatatcaatattcttaacaaagaatgaattaattaatatcgtagtaacaatttctgttgtttcttcttcaaagattaaatgaaacataaatccaatgaaatatttcgatgatgataatacataatttgcaataacattattctttaaacttaaatgtcccaataaaaagttttgtctaatttcagaaatttgtcttttctcttcaacatcatttgttaagatatgaactctttgtaatttatattgataattatatataaattctaaaaatggtaatgttaccattgcttcaaaaaattgtggattagtaatagttaataaagaattatacaatttcgatattaaataaccaaattcgagaccagttccattaaaaaattgtaaaaatgtttttaatatataatatgaatcacttgaatttgcaacttttaatgataaatacattaaataaaatattgacgcacgtaatttatcataaaaatcatttgttgtcgaattaaatactgatgtttggaaaatcgattcccaaaatttctcttttgttaataatggattaataattgatttttcataatatattaaaaatgataaaatcgtatataaaagtgataaattcgattcattaatatcatttttaaatgacataaaaagttgtataactttcgatggtaccgaagaacttaatacaccttcagcaagtttttgtgttgtagataataaacgatgtgaaaacttattaacaaatataacttcgctttgatctaattgcttataagttaaatcatttgttaatacacgttcaaatgttttgttctttatccaatcaaatttcggatatttaatttcatcattttcatcaaatttaattgtgttaattttaggtaattcattttgttgttgttttgttaaaaatggataattcttattataccataaaattactttaatataacattgtgataaataattttcgggtactatatctgtgattttacatactgatatacaatacctaaataaataatcagataaaaatgataaataatcaaaataattcggttcaacattttctgctgtcgctaagtcaataaccattcgatagatggatgtaataaatggtaatataatatcattcttaaatttctctgaataatcaggtggaatcttatcaaatacttgcgcagctttacatgatatcgtaaattctgtttgcgtatgatcaggaactttcgatatagccgaaaaatattttaaatatgcaactaagtattgatacgcttcataaaagtcatcaaaggtttcgatacctatgtttaataatgaatttactgtcatgttagtaaagttacgtatggattgtttcatcgttggagaatatgtcttgaaatttaagttttggaatattttggttgtaagaaaactatatacactcttcattgggataaaggcttcaatggaatattcaataggtaatgcaaaagaaacttgaaaggctgcaatagtatcactaaatgatttaacattctcatcattatcaagtgctaattgaaagatcttttgaaatgataagctaatggctataagaaacttgaacaatgtaggaataagtgggtcaaatgcatgaggatcatctttaagaagattaagattattgactaaaagaactgcaagttggaaataagctggattaggaattaaacctaagctaagcttttctttgatggtggaaatatcaaattttttcccctggaatggtttggttgaataatgttgatctggaatttcgggaaaaattgtgtcaaatccttgaaccccctttaaatcaagatttttaggcttagcctttttgaaccaatgcttaatcatgtcatcaatggtttctcttctggaatttgacttcttcatcattttgtctgaaaaaaaaccgcagttctaaaaacactttttcggtttaacctaaaaaagtttagaaaagctctacaattttacatcgcaacttttttgttaatgttcagaaaaattcactcaattatcttgacgaatttgatggtatcgggttttgataactttattgatgattgaaaagttccgatagacatttgcccaaatacaaatatcatatgacgattcggaattcaatgataaaaaaattgggtacctaaacgaccccttcgtgcacaaaataatctgattcaaagggaatcaaaaacaatttacatcatggactcagcttacattacaaaaagttattgaagaacctattcctgaaatttatggaattacatcaagtgaatggttacaatcgatatttattttaacagttccattacaaacacaaatgatgcaaaactttacaaaaatatgtactacgataaataatttatttaataatgaacttatatttaataaaacaattttttctaaatataataatattttaatttctaccattaaacaacaacatttatataatttgcataatcaagaatatatccaaaagatatataaagatttattacaaagaattagaaattaattattcattaaatattcatattaataaagaacaacattggaaattatcatcgacattagatttagattggagacataatatattacgaccgaataaacattttgatcaacatcaaattgcatcattattacgtgattcacgtgatcaaacagaagcattacaaagattacaatcatttaaacaattaaattcagggacaactaattcaacagagactacaactattgaagataataatagtaataataataataatgaaaatgacataaatattgatgattctaaagaagatacatatacatattcatttgcttcaccagcacaacatattaaattaaataattcatttcaaggtacattttatcttaataagaatcaagttttttttcacaccagataatattaataataatattaaacatcgattaatagaaattaaacttaaagatttatatatggttttacaaagaaatcaatatcatattccatgtggtttagaattttttttaactacacaaaaaagttatttaataatatttccgaatcaaaatattaaggaaacagttattaaaattcttaaaaaattaaaattacctaatttaaaatatttacaaacatcgaattcatcattattagaacaagaaaaaattactgaaaaatgggttaatggagaaatttctaattataaatatttaatcataattaatttattttcaggacgaagtttttaatgatttaacacaatatccagtttttccatgggtattaaaagattatacgagtgaaactattgatttaaatgatccgaatgtttatcgagatttaagtaaacctattggagcattaaatgaagatcgattagaacatttaaaggaattaattacagaaatggatgaagaaaacaaattttttatataaagttcattattctaattcatattttgtatcatattatttaatacgattagaaccatttacaagtattaatattaaaatgcaagataataaatttgataaatcaagtcgaattttttcatcaattcctcatttatgggaatctattacatcaccagatttaacagattatcgagaattaataccagaattttatagtaccccacgatttttaattaattcagataattttgatttaggaatcaaatcagatggaagtaaaattaatgatgttatattaccaccatggagtaaaaatgcgtatgatttcattgagaaacatcgagcagcattagaaagtgattatgtaagtttaaatttacctaaatggattgatttaatatttggatataaacaaaatgggaaagaagcaattttagctaataatacatttcatccttatacatatcctacgaatatgactaaacaagtaatagaagatccagaaaagttaattttatatcaacaatttagtaaaagttttggtactattccaaatcaaatctttaagaatccacatccaatgaaaattaatttttctacgattaattttattttatctttatttacaccgacattacaaattgaaataaaaatcgaagccaatatttcttcgaacgacattcaataatattttaattattattacatcattaggtaaattaatattaaagaataataaaaatgaaaatatttttgatattagttattgtttaacaggatttcaaggtatttcagaaaggacaatttcatatcatttaaaaaagaatattttaattatatcaacatgtaatgattgtacatttcatatgtttcaaattgatattaataatttaactattaaattaattaattcacaacgacaatattcattaataaattcattaaaagttacgagtacgaatgattttgttaccgcttcacgaaattattctattattaaatggaattttacacaaccagcgacaatgaaattccaaattagtgcacatccagcgacgattattgatttttgatatcggtattgtaagtaatgcattaatttgtggttataaatcacgacaaatttcatcatttaatttcttaaatggttcttatcaatatagttattcattagattataatattttaatgttaaaaattagtgcatcgccttgtatattgatatgttgtgaaattattaaaaataaaatttttaaaaaatattttcatatggaatggatttaaataaaattgaagaattggaaattcaaagtccgaaaaatacaatggtgcgaaatgattattgcacataaggattacgtgttggcagtgtccgacttaaataacaagttgacattgttaagtttgccgtgtttgaggattttaaggactttcgagttacaggacgcagtcgtaacgatgtacttcgactcaagaacaaatgttttgtattatgggactgaaaataataaggtgtactcaatagacttccattaaactttaagaataaataatactatgaataataattaattttttgttgttatgaatttttcatcatttttttcacaaaaattatcatcaaattatatgaaaatcatacaatgaaatatgatataaaatattcgatttatcaaatttaatgcattaataataatatatgataacaaaatgaatttaggaaatgtttatttcaatatttaaatatttcctcttttatccttgtgaatcttttaattttattatgtcgtcacatttatgatgttgaattttgtctgcaaataatcgaataatttctgcatttttcttttctgatgctatcataagcgctgttttatatgtttataagtaattccaaatgtttatatgaaatgtcatattttttaaaaatattttaaataaaacaaaaaaatatttttagcatcgatatcaatattctcttgttcaagaagtgatttaactatttctgtatgaccatttgaagatgctataataagtactgtattaaataatttaaataatttccaaatattattttgaaagattaaattattaaaataatcattaaataaaataaataaatatctttagcattaatatcaattcctttttgtttaagaagaacttttgtaacttcagaatgacctttgcgtgttgcccaatgaagtgctgtttcattaattttatataaattccaaaaaaaaatattaaacgttaaatcttcatgagaaacatatttaccattaatatcaaatattttttgtgcgatttgccattcaataaatgatacaaattctttttggtgttgaggaagcatctggtttttaatatatttgacatttttatattcggcattttttattggcattttttttcttcaacagttggatcactcgccgatcttaactaactgaatcgcatcgaaaatttttttcagataaaccacagaatgttagcagcaatgttgttgtgtaagtaacggccacggattttgcgacgtcgctctgaaccaaatctatactataaatcattaagcctatattcaaacattgtactcagatttgctttattgatggtaaaagattttaaacactttattttatttacaaaatattattaacaatctgaaaatatttttgggccaagcaaacgctaaaaagtcagaataaagcattgatttatattgtatttgtaagtccaaatgttgctgaaattaacggtcaataaacgatcgccaattttcaaaactttattgattcaaaaagtcgaatatgtcaaaatattttgaggtggctgttattatttttaacttatctatcgtgtttgaatcaagtaaagtatttaatttcattggtcatctacaagaaagtgacattgaaacaaactgagtaaggagataaaaattccaaaattaacaaatgaacaaatttagtatatcaaaaataataacaaatgacgtggggtgctggtatatttgataggtatggagcgacttcgagtaaaattttaaagagattcaaagtgacaaatccacatattgacaaatagataaagttgctaaaaaacaagaacaattcttggttgaatataaaccggttcaaataattcgacattacgatagattgaaaattgacatgaatttttgtattcttgtcaaaattgacaatgagattaatgtcgaaatagtttctaaaatctcttttatgtttttgtttatttaccaatatatttcatgtaacgttttagttctttaaggaggtaattatcttgtcttcttcttaatgagataatcatcttgtcttctgtaatttttggtttagcacctcttctttatatatttatatttactggtaatggtattttaccagtttcattgtattcatttattactcttcataccctaaggctacacacatgtaggatttgagttatttgttggtgcgtacaaccattttgataaagatcaacaattaatttttcgaccattttttttaatgaacggtctcaattcaaaatattcaatgacttgactcaatgtcgaattatttgaacaagtttataatttttaaattattagaagcagaagaagaattatgatcattttaaaaaggcagttacataaatataaaaagaataaagtttttagattattaaggtcaaaagaagataatcagatttagtgtgtagataaaatgcttgaccaattttcgtttgactattaatttataatacatccggtaggaatggttttaagaaatctttcgacttatatatgggttattgacctttgaattcgtggagtgccccagcatctgaatttgttcaaaaagctctatcgtatttctatcataaaagtgatatcaatgtaagagaattgaatagtttacatcgaatataaagtattgaagaagatcaaaaatattttgacgtcaaatatgtaaactatgcaaaaattggtaaccgtttattgaccgttaatttcagcttacttaactggtggaaaaaaatcggcagtatcggttccactttttgaacgaaattctattaaagtatttttcgatctgaaaataaagtccttttaccacgtactctccttccttgtttcaaggccatgtaaatgtgatacagtgcaatgcattattgatatttgggcatatggatttttggcaacaacaatttcacagtttcattattcgttcaatcacttagagattagatctgatgaaagttttttgccttcttaaagacaatctcaattgagtaaacataaaattattaccaaagaaatgaattgtttaatccatacgtgttttgatttctttcgtaattatctgttctggtgttacaatataaacaattccaccccaaccactgagtccatcgcgttcgatagctgatatcaaacatgttgaaattgttttaaataactcatcaggattcattcctggcctccatagactttcacaaataccatacaatgaatcacttgatgttcctgcaacagcaaaatcattcggttctgtcatagcaccaatactatctgatgtcgcaagaattggattatttgtacctggttcaagtccagctataattggttgaacgaaatatggaccaaatcgatgtttgtaaagaagtgacttaacaagatttatgaaacgttttggatccaaaggacgttcttcacgtaattcaagaagatttacttcatgtctaagtttctcatgaactgtatcggcatcagtcataagaccacttaaaccaataaatattgaatcatttatttgaaatattttcttacaatttatcgatactgtttgcatttgtgcgccaagtcgtttgtctgatgcaatggcaacacaatgatctccaatcattgcaaccattgttgatccattttgtgaatcaattgatccagacattaggatttatgattgacagactttgtttggccaactttcaaatgacccattaaaatacactcaaaggaatacttaaacatatattattatacactatttttttaagtcatcagaaaaatataaaaatttccaaattcggataaaattattaaaatttaattttctaaaatcacttttcgttttatactcaaacaaaactacattcagaaacaaacattttgcgaccaaataaaaaacatattatgaaaagaaataagtaaaaaaaaaattatgaaaaaaaattatttgtcacttttcaataatgaattattttctcattcaaaaatatatggcgcaaagtgacataaaacttattatgttctgtttcttcctgatatcagttcattcaacagtttatctggaagaacgtttcggccctggatgggaaacacgttggaagaagccaacgcatgtacgaaaaggcgttcaattaggccgtgttcgcgtcacatcaggaagtttctggggcgatgagaaaaagcaacgcggactcgagacaatggacagtaaacggaattatcttctctacacaaatctcacgcacagaatggacacaagagataaagatttgattattcaatacacagttcgccttccttattatgttgattgctctggccaatacatcaaaatattgtcatctgatgttgatccaacacatttttctaatgagacggattatttgataatgtttggaccggatatttgtggcgcaacatttagaagaacacattttattatcacacacaaagggaaaaaatatgaaacaacacgacatgttaattgtatcaaagatcatcttacacattcatatacattaatcattcgtaagaataatacaatcgaagtacgaattgatggggaaatcgttgataatggaacacttgaagaacgattccaaattccatctgctgatttaataccagatccaaatgatattaaacctaatgattgggacgacgatgaatggatcattgatcctaatgataagaaacccgataattgggttgatgaagaatttattgcagatccagatgcattcaaacctcaatcatgggatgattcaattgtttgggcaccgccaatgatacgtaatccacgttatcgaggtgaatggtcaccacgaatcattaagaacccaaattataaaggcgtttggacaccgaaaatgatcaatgaaagtgtagaaaaggatccaacgtttggacatttctcatcaattggttatctcggacttgagttctttcataatgcgccaggttccatttttaataatttcttaattacagataatgaaacatatgcacgagaaatgctcgaagatgtgttcttaagtattagggaagcagaagtaaaaaacttcgatgaacataataggaaattaagcaaagaaagagaattagaaaatattagaagagaaaatgaaaatcatagaaattatgacccagatcaaattagtgattcattaagtgatggtgattactttaaaaagagaagagaaatggcaaagaacaaacgaaaacaaaggaagatttcccaatttgatgatttataaacggagttacccgcccatttttaataaatctaaatgttgtttttcggctcttaataaatggatttcattatcatcaaaatttaggatttcttctgtaagagaatcaatttcttgttttaattcatcattctctttctttaattcttcaatttggatttcaagttcttcattagacaaaaaagttgtttcattattattcattaaatgttcagatagttctttgatttgcttaagaagtgaaccattttcaagagttttggatgtttgcaactgtgatatttcatctatatccaacgtttggactttaaaatgggctgattgtaatgacgtttgaagatctctttccatatcgatctgtcgctcaagttcagttcttttcatccataatcttcgaaataactctttacccttttcaagtgtttcacttactatcacatgttgttcattcgcgttatcgacactcataaaattaatttgaacatcaaaaaatacatcaaacaacggttttttccaataattttcttttttcttataatttaattaattatgttaattaatatagcaataaacctaataactcattaatatcttttgtttacaggcaataatatataaaaaacaaagtatgataatttatcaacaaatttcgaagaaaatattttgcataaaaaaaatcttcttagcataataaagtaatagttaatgaatttaatgtattttatctaattggatgattaatgatatcaaaaaaaaaatcagaatgataaagaacaatatttataaacaaacttagtcaaaattaattcattttgaatgacatggaacacaccgatttgattctttatacaatactaaaagtgcaaggtcaagttcttctgggtaattcctctttatgttgttgacccatgcttgtgttaattttggaagaggtctctgcccatataaatgtaatatggatgctgcaactgaaacaattggatgtatgtttaagtaattttcatttctcagaattaagcagagatccctcataacaaaattacaaatattttctgtattttctgaattatcattttcaatgtcacgaaaaactggttgtgttgcattaaagtatttgaaaggaagatcaatatctgggttccagttcacgatgtttaggaacataatctcgtaatgaacaatttgcattttttcttcatctgttacaaatggacagttataatctctcggtccaaatgtttgaattattttttcccatccaactattttttggatttccaaaatgcttttgaaaatttcttggaatattaatggtaacgatcgataagcatcttcaattttgcatgacaaaaatacagatgataccattaatacatataaatgtgcaggctctctatctatttttgcaaagtatttgtgtaaaaaagtaaacgattttgcaatgcatggagaaattgataatttcaaaccacgtcttgcataagttacagctgcccatgctatttctctttcctcagtagtccagaggtgtggagtatattctttcatctaagtcacactatgaaatgatatgtgcgataaaatttgagctgcattaatttacgtaaagaatacaaaatggtcgactttttgaaaaggattaagtcaaaacaaaaattctgataaacatttggtcatcaattaaaaagtgaaatgaacgattctttttttgatttttgaatagtttacaattgacaataaatttgtggaaaatattcaattcaatgtaaaatatagaaatgcataaacactgtaaacttttaatacactgagtgaaaggatcattccaaaaccataagatcaattaatcaaaaaagtaaattgcattgctgtaaaaaaatttttatcgaattaatgacaattcgaatcatgaattcatatattaaaaatcaaaaaaaaatttaaaacattttttttcatgactctttcaaatgtagtataaataagtagtccttgcttggccaattaatatgtagattatatttattcagccatagcggatgttcaccattgtgatcattattaattactcctttttgcatcagattttttcatcccacatagccattatttcaataaataacgatcggatacgattgttatgcatttaatttcccattgaattatcagtctacgatatgtcacgtaaagcagtcattaagcgctgtttacaaaggattgtgtgtatttctcggttatgccactttacaaaagaaggttaaaaagtttattacttttcagtcgttgagtattcaaaataagcgcttccctaacaaaagagatgggcaagttcaaggaaaaatttcaatatccttccttacttgctgtagcatttaattcttggactgatcaaacatgtccacaactcgatttttcgacttttttttctgttaagtttaatcataaattgatcaaaaaaagttatatctggtcaaatcctcttatttcatccacacttttttgtggcacaaccacagggcaaattgttgcatatcaaatacattcacagaataatgaaatattaaatgtcataccaatttgctttatttttgggcatgactcaaaagtaacgtccataacaaattatacacatcttttatatgatccatccattgcctctttgtcaatagatggaacactttcaattatatctgttcaagattttaccattattttaaatcatcagaaattattttcagagggatccgagtttttatcatcgcatcaaaccaagacttcattaatgattgcttcacaatcaattggcacaatagaaatagcagatatcaaatcaggaactcttctttcacgaatttctggattttcttctcttattacattttttaatggccatggacaacttcactgtgcttcatgtgctgatggaacaaattcagttttttcattttttgggaattctgttgtttgtacatactcatattgcttaaatactgattcatctttttgcgattctattttatccccaggccttgattatattcttcaagttacgcctgataaatggtttatatattactccgatgaaattctttatcaaaaagaaattgaatttgaatttgattttttttcagaaggtcgatgggtcaacgatacaactttttatatcaaaaccgttggcggtgtaatagaaatttgggagctcccaaatttggaaagtattcaatattcaaaaacgaatatttttgataggattacaaccaaaagttcattttttaatgtttattcatttgatggtaattctaatagaacaattcgatcacaagtaactaaagaagggataaaaattgatttaacaaaaataaatccaccaaaaaaaatattaacatttaatggtaaaatgaatcatccaatatatatcactagtgaaggatttataatttattcgccttctaagtcaatattaaattttcattcatctaaaaatgaaaatgatattatatgtgatttatcaaaatgttttacaactaaatatcgttgtaaatgtgcaattagtagtcataataacttaataaaacatgaagcacgaattgatattaatgataatgtttatttggatgattttaataaaccaattggaacacataaaaatgcaaatttattatattcgccaccaaatggtaaaatgtttttttcttttgctattgatggctcaattattgcatggaataatcataagttggcagaatttcatgatttatttgagccaatcaaaaaagcgaaatataattcgaaaagaaaatggataatattcattgcaaattattcattttcattagttgatacacgaaatttaacttcgataatggttttttctgaaattagttatccgataacagatataatatattataaatctttgttttatttgaaatgtgaatctccttttgtttatgtgtataatattaaaggtgagttagtatcgataaatcggaataaggaaatcttaaaaatgaaatacattgacgataaagtcccaattaaaaaagctatgagtgcgcctgctttagataatcaacaatcatcattagaatataaagaaccagtttttgcgcaaatacgaaacttaataataccgaattgtcaaacatttgcgttaatatttgatgctatggatttttttgattcatttgattcctttgataatttaccgattcgaacaaatccattatttataccattaaaacttttatggaaatttcatataggaaaaggaaaattagatatttgtgatcaagttaatgtattagatacatttacatatgctatagccggtgataattatacggtaacattaccattatataataaagaagatgaagaagcattaaacattgcattttcgatatcgccgaatctttcagctattcaagcagtaatatcatcatcgacaggacaatgcttttctgaatcgaagaatgataattcattatcaattatatcatttatatcacaatcagttacatcgaagttattaatcgaagctgtttcaccatcgattttcatgttagcgaattggttaatatcaccaaatgattcaatgcgtgaaatagtaatcggattaattaaaatgtattataattctttgacgtgtgaacaaggattagaaataattaaaaacatccaaaacttgtttaatgattggagaattatattaccatttgcattaattcattgtaagaaatttaagttatcaaatgaattcgggttaaaatgttctgaaaatttgtttccttttttattcgaaaattccgaaatcattgatttattatctgaatcatatcaaaattttcgagtttatattaatgatataaacaaattcttcgaagaaatgattaatggtatatcaaatggttatatatatgaacaacaaattataccttttgcaataatatcaccaatcgaattcttcgataaaataattttaattccacaatatttacatttcattgaaatgctctttaaaaaatggaatccgaatgatcgagatttaattctctttttcattaatcatattataagtgtgacacaaaaaaattcacaaattaatttaaacgcaatttttaaaattatcgaagaaaaaattccatttttcacttccgctaaaaaatttgttgtcttcggtgataactatggtaatataattgtttcgtcaactgaaactgctttgataatttggaaaatcgaaatttcgaaagaaccaatttcattcgtttcagtttccccaaatggaaaacgatttattgttatttcccctgctgagaaaatgctgacgtgggtcgaatcagcaataatattaaagaataaggagaaattcgaattgtcaagttcaataagattcgaattcgatggaataccaacaaatgcggtgtggaacggagatgataaagtttcgttgttttataatgataaattaatacaagaaatttgcgcacaaaaaacttcgatatttcagaaaatattgaaaaatacttttaaaaataatgtgtaataaatataatatatataacgttttgatttttttatgaaattattgtatgtttgttgtgtatcgaaataaattttaatttgttaatttattaaatctttaatttcatgtacatgtattcaaatgataagaaatattcataacagaagcataatatattacatatatatgatataggataaaattgattcactttcaacataaagatacatcataattatagtaaattttttctgtaggttaacgatcataattcaaaaaaatcattccataaattatgttaatctcattatttaaacatttgtcaaaccattcagtagatatataaagtgcaaatgaaaacaaagcaataggattttcaatggcaaaattctgaattattcaattaatttattaaaaaaatttatttgtaaactatttaaaattaatttctgaccactttcgattttttgtgaatttaaactttttgaatacactttttggttacaaagaaatgaccactccgtttgacttcattttgcctttttaaagttaatgccaaaagaagtatgcagtggcttctctttttctaccctgatatgcagtattttatattgtttaacagttatattttcacttacttctgtatatttttcgatgatagtaattactattgtaacaataccaatatttgttattcttatttctgatatcagtgcgagttgtttgacgcatagtttatatacaaatcaagcatggggtaagaaatttgttattactattgttaatgttattcttcttggtcctgttattgaattatttatatacattgtaataaagattgttaaatcatttttttcaaacatatggtcaaaactaagtccaacgaaagcaattgcaaaagcaaatgaatatttacaagatccttctgtttcaaaatgtaattttttcattcaatgcagtctttttggtctttatcatattggtgctatagtacttataattttagattttatcagacattcttttacaaccgatattatatacaaatcaacatatttgttattcatcggtttgattcctccttttattggtatcgtaaaagttttttttcatgcttggaaagtctttatttataggaatatcaataaaaaatatgaatatacagcaattgataaatcattattagaagaaagtagtgaatttgaaattaatataaaacaaaacaaaacaaagtgtaaatggtttattattcctcaagagctttatgatccatcagatttaatgaatttagatgaatggataacatttttagatagtccagaaactaatttatatcaagaatggtttttttcatgtaaaaatgatcacaaagatatagcgttcgcattaggtaagaaatttgcagcctacttttgctttttattacaaattggtatattttttgatttacatgaaagaggaatggctgatttaaatagatattcttataatattgcatttcttggaatcacatttccattttcagctattgtattttttacagttccatttttctgcgatgaaaaatttgcgaaaatgccgacaattcataagatcaaaaaagtaaaacttatcatttttattattctcattatttcagttgtattaattgtaatatttcaacgaaaaatttataaaacaccaaatgtatcacaattagaatataaacaatatgataatagaaatgattttcatatattaactcagaaaccaccactttgttcatatcgaattggaagtttagatataattcaagcatcagcactaaatacattaaaatatataattgtaaatccaaaagttgttcaagcaacacttaaatatataacaagagaaaagtttaatttaactgttattgaaaaacatgaagaaccaaaagagccaagatattatgttaatgaaattccatataacttagaaattatattaaacgataatcaagaatattatgaagtatacggaactaatctaacacttcaagatattggtaatttagaagaacttttaacacgtaaacattcatcttctcttattacttcaattgtaccattctatagggcaatatattattttctttccaatttatttgtagatataattcgaatatcacagtatctttttgctataactacaatatcacaatttgaaggtgatcaatatgtatattattctaaaaatatcattaatgatacaaaacattatgtaatatctcatggcgttcctgcttattttgttaaagctttcgatgtaaaaaatatgagaggaattatgtttaataatgttgcattaaatcctgaatatgtacatgcaaattattcaatattaaaaaaacatcataagcagccaaacatgattaatatatattggaataattctttcatttatgaaagtgatcctttaatcgaaaactcagctgctatatcagtgccgtattctccatttcatttatcaaatccattcgaagaaacatgttatatggctgcgttatgttcaactgatcatcattgggattcttattgtacacaagtgttatctgatgatggagccaaaaatgggactttggaatatggtaagttaagtgattttgcaaagaaccattattcttgaattatataaacgttttgttaaatttattaatatttttttttctattgtttatcgaaaaaatcttaatatcataaaaattttgaaatatacttataaaatcaattttttacatgatagtaaatacttcttttgagagccatttaagtaataacaactttgaattttttttttcatgtaaatgtgtttatagagttaataaatttttatttaataataaatttaacaattaaattttacacctttttcagctgcatttcagccttttgtataatttccttaaacgccttctcatctatgtcatttttcggatcataaaattgcttcaaatgttccacagcgaagtatataattgcctttttcttttgttcaaactcgaactttgcattttctatcatatcattcattttttccttctccgcgtgcatttccaattttcttttcatgtctgcgaaatttttttctctttcagcttttttctttattttttccattttatcgatcagttgattcttttcttcttcgagttctcttttttctttttccaaattatcatttttcgtttgcaaaattacgatttgttgtttattcttttcgatgttttcatcttttcttaagttttcgtttcgtagtttttctgtttcgctttgagtttcgcgttgcatatttcttattgcgtaattatgattttctttaatttgttcgatttcagttaattgtttcttttcattattatttaatgcatccacaagtttattattacgttgtttaagtatttttatgaattgttttgcattttcaaatttaatatttatttcttcaagtgatttttgtaatgaatttatgattcgatctttttctttatctttttcattatcatttattgaatttaatgttttaatttgtggctgtgaattagttttttcggattttagattcgaaatgatttcttctttatgctttaataatgtttcaagttcagcaactttatatatatgttcatcaagtttttcttctgcttcattcagttgcttacgttgtttatttgtttcatgttcatagttttgaattattgtattaaattcaagttgtttactttcaacatgtttctttagttttttgtttaatgatttataatgtttacaatgtgataaaatcgaatttaatttttccgtttgcgtggaaatttgtttttctttttgaagtatttctttctttaatgaatcttcttgattacgcatatctttctttatttgattaaattgatcttcgatgtttttaattaaactttcaatatattcacttgtaatgttttgttcatcaaaatttccgtttaataaataaattgcacttttgattacattaagaattttggcgtattgtgtttcagtttctttaattgtagaatttaacttttctattatattattgaagtatgttgctatagtattcatagattgtttgatcttatttgatgtagatatcgaattatttgaaccaatttcaaatactgtctttgataacgaatttggaaaatctgtacaattccaaacatttgatggaataacttcaacaactggtttagtattatgtgttgctgattctttttctattttatcttctaattcttgtattttaattttaagatttctattggcttgttctaattcttcattatgatttttattagagagaattaagttttcatttaaattcttttcatcttgaagcgatgtaattttatctttatagttcgcaatagaattatcaagagatttaattttttcctttagttgagtattttcattacgagatttatcaagattttcttttaagcttttacaattgtcttcaagcatttcgatgtcatttttcatctcatcgattgttacttttgctgttattgaatccttttcaagttttgatttttcttcagtaagatgtgtgattttaagtttactcaacttttgattgtctttggcttctttaacattttgtgaatattttttaagttcattttttagttgtttaatttgttttttctggttagcaacttttatatttaacttattattggaaaaagctaattggtgcatttcttcttgatcatttaattcactttctgttggcgttttatctttgatatcattttgttgttggaaattgttaatttgcttttgaagttcattattcatgtctgttaacgtttgaatcttgaaatcatagtctgtttctttgattttttgatcattttccattttcctaattaaacttttaagtgagttaattgtagattcagaattctctttgcttttttgtaaatcaaaaatcaatgaattaaatttttcttgttgagatttgtttgctgcttttgtttcttgattgtattgctttagtttgctgattttgcgcttaagtttttttatttcagaggtttcagaattatcaataacagatttttctggaatttgtttattttgcatttcttcaataaataaaaatatatcatcaaacgtacgaattggagtgttagtaatttgagcagttttttgcatgaaaatttcaatcattttagaaattgagtctttttgagaaattatattccgtaatttttcattaagggatttgatctttctctcatattcattaattttagcatcatattcatcttgcttttggtccatttgcttatttaaattttcaacttgatccctaatataagactcggcacttgccttctctttttcgagtttttcatggagctctttgttagtttctatgattaattcaatctttttattttgttccataatttttgttgataaatcactattctgtgctttcagttcattatttttttggaaaatttcatcaatttcctttgaaaataatgccacatcattaagttttaatgattcaatttcttgttctaactcttgatttttttgtttcagtttagttatttctgtatctttttcttcgatttgtttctctaagttcatatcataaccagaagacgtagtaataaaatccatttcaggttctttaaaagatcgtttattaattccaaaaagtaaagtgtaaactatagaatttatttcaacataaacccaacaaaaatgctttgtaatcaaaccaacgattcttactatatcttctcattattgtagacacttcttgtttctgtaaaccaaactcactttctaaatatttcattacgttttgagcaggtattagtccatccttatcagtatctaattgttcgaaaataggctttaatcttgttattccatcaggataacatctcttgatcattgccattatttcaaacaaatcagatttcggaaatctatcaggttctgcttccattaattcttgagccaattcatcagcggcgtcaattacaaaacaataataattaataacaacttcagctccaataaagaaatctgaagcttgaaaatatctatttccagcattaacattcttatatttgcctttttgtaagaatttcccacccttaaatccagaatttctttgaactgtttcgaatactgctaaagtatcatcagcttcataaaatgcaattacaaattttcgatctcgatcttgcatttgagggttcttaaatcttgcagagaaccttaaaatatcattgctcttttgtataagtttaacaatatcttttgtaggttgtttaggatgtaatgacaaacaatttccaaccgaatcttcttcatttccccatccattataaggtggaatttggatttgtgttgtgatttgttggtttgtttgttctccatcaacattgatttgtgtccaatctttctttccatattttttatccaaaaattctctggtaaatttgtctgcgtcatatataaggaattcacggccaaaaacatttattttttggccaatatataaatcagaatcggtataatattctgtactatttggcttttttagtttggtcttgcttaggaattgagatacaggatcacgacctgagttttgtggtaaaacttggcgaatttcaatcgtatcatcaacaaggaaatagtgtaaaataaatttccgtttttcgccaaaaagtgacttgctatcgtcccataccacataaaacctaagaactttaccgtcaaagtctaagaattggcgtagatgtgttttgtcggtattaatatgtgtaactcgtgtagggcgttcagtaagtttccttttaatagagtacaaatcatctggtggttcttcaaatgctccaagttctcgaccaattgacttgaaatatttctctgtgaattcatcacatgagtaaatacgatatgtgattccatatatttgaatattaataccaacattaaaatctgacaaattgtatggtgtaccataaacttctgcattaggattgagtactttcattcggcgaagtagaacaccttgttccattcctgaattacgtactttagattcttcaatcattattgaattgtcttcaacatatacataaatttttacataacgaacacgttcttcttcctcttgtgattctgctatgttttctttgaaataagcatagaaacgaagtacaatactttttaatgctggtggtgttggaacaaattcattagaattttcttgatcttgtaattcaccagttttatatttaatttcagaaaatgttagatgacgactatgttcttgaacttccttttgtaatgtctcttgtcttggtggctttgctgtagttaatccattatttgaaactgtgaaatattgccctctcctaaaatctgttctgcgaagattatgtggggtaaaacctggtaaatttggttggcaatacatatgatattaacgtgtataaccgagaatacgttaaaacgagaacgtttatttacagctcatcagcaagctctgcctcccaatcgattggtgggtaatcaccaactttaacctttcctgggcggacaaaaacaccgtatttttcatcacattggaaatacctgtgacctttaacagaaccatcattctttccaactggctcatctaattcaacaccaatccaataccctttggcaacatccgttttgccaacaaatcgtacaatgccacggttatgtgagtgatcagccatttcaacttcacatctctgtccaacttcaattccttctggagctttttcttctttttctggaacttctcctttgacagcaatacccattttacgcttcatttcgcgaattgtgccatgtcttttatcataatcttcatcagaaatttcgaactttttaacagttgatacatcatttaaatctccaaattctgattgtcctgtaatatcgatgtttacggattcatcttttgcaagatcaccaagtgttaatgattcatctgtaactaaaacaccattaactttgatcttcattgattcttgtgtaaacccggtcatagcataaaatcttgatcttaatgattggattgttgatgtgctagaaagctcaatttgcgttgcaagtccttcatttgcacgaatgtttgcgtggaaattcatttagtaatttctttaaagaaaatacaaacgtttaaaacatgtatccggccaattatttattcaataagcgtagccttttcaatgtaaaacgatcaaaaccaccccaaaagatttttggtgtttgaccgtcacttttcgtttgtggtcggccaaatatactgttaattttatttattgaaaaaattgtatactttatttgttaattttgaatggttaacagggaaaagtattgaattttaaaattccagctggaaataaaaggtgatataattatttaagggttaaagtggaaattgttatatttcttataatttttccttggtggttaataaattttttctcttatgtttttatacaaaaatatttattttttcagtccgatcaagctgtttagtggtttgacttattttgacaataattatccataaactgttattagggataccctgtaaatttcatataaagtaaactatataaatcggattttgattatataaatggccagttggtcgtaacatcaaccttgttttaaactcatagaaattaaatatttttaattaagaaatcgaaaagccatatcactcactgattagtgtaagatcaaagaatagtttacacattcatgatcaaagtattctatcattctgaatttaccctttaaaaatcgattgagaggatttggaggttcggtctacggttgtgtaattgatcctatagatgaaatatttatttaccatatttcagtccgatcaaaattttcttattgaaataaatgattatgatatagataaagatgatcatttatgattgatttcatataccattttttctcatttaaatttatctaaaagttcaagaaattattttatatgataattcatgaggaaattatataaaaaatataatgtctagattaatataaaattaatgataataatgagcattttttgcttaaaaccactatagcgccctgtcactttctttatattgcaagccaaaaaccaaaagcatcaatcaaaaattcaagactcaaaatgactaataattattcacctttttttgtcagaatcttttgataatattataaaccactcaaaaaatattttgcccatcagcttttaaaagatattctaaatataaatattagacaccgaataaaatgaaaatattccaaaaaaatggaacattgtgtcggtacttcatgaggtattttttttttatcatagaaaattcatcagtaaaagttaaaaaaatgagaatgaacttattttagtttattaataatattttgtaaataaaataaagtgtttaaaatcttttcccatcaataaagcaaatctgagtacaatgtttgaatataggcttaatgatttattgtaaagatttggttcagagcgacgtcgcaaaatccatggccgttacttacacaacaacattgctgctaacattctgtggtttatctgaaaaaattttcgatgtgattcagttagttaagatcggcgaatgatccaactgttgaagaaaaaaaatgccgaatataaaaatgtcaaatatattaaaaaccagatgcttcctcaacaccaaaaagaatttgtatcatttattgaatggcaaatcgcacaaaaaatatttgatattaatggtaaatatgtttctcatgaagatttaacgtttattattttttttttttggaatttatataaaattaatgaaacagcacttcattgggcaacacgcaaaggtcattctgaagttacaaaagttcttcttgaacaaaaaggatttgatattaatgctaaagatatttatttgctttatgtaaaattttttataataatttgatatttcaaaataatatttgaaaattatttaaattatttgaaacagcacttatgaacgcatcttcagaaggtcatacagaaatagttaaattacttcttgaacaagaaggaattgatattaatgctaaagatatttatttgttttatttaaaatttattttaataattttatatttcaaaataatatttgaaaattatttaaattatttcaaacagcacttattagagcatcttatgaaggttatacagaaatagttaaattacttcttgaacaaaaaggaattgatattaatgctaaaaatatttatttgttttatttaaaatttattttaataattttatatttcaaaataatatttgaaaattatttaaattatttaaaacagcacttaatttagcatctttaaatgaccacacagaaatagttggtttaattaaaaagaaacttgaaattaaataatcttataaagtaccttttaaataacgtacataaagcatgaaattgtaagaagaacttaattttttcattagggaaaatagttcttgagaagattattttgtatatctcaaatatattattttattcataaatttctctttgagcaaataaaatttttataaattatttatttattctttatgtgattaatccttgtgaaatcacagttgtagtgtcctgttcattctttttcttttttactttgacgaaacatataattacaattatagcaacaactaaagcaatggaaattccaatgattgaaccttttcttaatccatttttttatatccatagattatttgaattatattttttagactttcgtccatagtacaattataaccatttttatttaagaatttaaatataatatttgtgttatttggtaatatcaattgttctttttcattatttttaatatttaaagtaacatttttatcacgtttagtttcaaatattatattcattccttctagcaaatgaattttcttaatttcaccattagaatgttcaaattcaatgtaattgttactaattcttattattggaattggttcttttgcatcattcattaaaacattatttggttgtataaatgtttcattatatgattcataatcacaaattaagttttcaactaataaattataattatttgatataatgtttacatttataatatttaagttttggaattttatgttttcttttgtttgtattatttcatcatcaaattgaagatccaaatctttaatagttaaatcataaccatttgtattagttaaaaatggaccttttaacttaatattatgttttgtatcttctttattaagtaattctaaattaaatttatttgttaaaaacattgatgaaatttcagctgattgatcaatataaaatattttatcattaacataattatggattccatataatgaattcattgatgaataaacattcgtaatattacatatgtctttagaacaattattatcattacataaataaagtggtccatccattggcatattagttaaacatatgaaaaaatcatcagcaacagggtaattattagaaatcattaaataatgttcttgtttagaattaacaactaattttttagatactatcaaaaaatcgaatgttggaacactcatagtaattcttgctaatgaaggaatatatttatcatttgaatccatttcccaaataagtgaaaaaatattattcggttgataactatatatagtaataattaaattttcatattcattttgtggtgaaactttgaaatatttaattgcgtttgctggaatatttgatatttgatattgtgaataaaatggaatttcttggaattggatattacaaaattgtcctgtaaatccagaattacattttaattttccattttcacattttccattttcagatgttatacattcatttgtatttatcatttcaataaattttggatttgtatcaatatcattttgtgcaaatggaccaactgctgttattatataaggtacgtctaaattttcttttatatctatatttgtgattacatgaatttgatattctccaatttctaattgtgattgatagattataactttttcatttaatgtaaaatgttctgtgttttgtgttcgattatttccaacataaattttattcgaaggtgatattactattaaatctaaatcataataaattggaaggaatgtgtctgaactaagaggaatatcatgtgaacataatacaattcgaagtgatacattttgatttgtaactttaatttttccgatatgatgtgtttgaccatttatcatttttgtgacactagaaaaccttaatccaaaattactattattaaatggaattactgttgatatatcaattaatccatgaccaataaaacaatcaggtgtagaacttaaatcatttcgtgaagccgaagcaattaaaattgatttcaataaaagtgaatttacattaattttttcatctaaataatatccatcttcaaaatattgtgaaattaaagttgctgctccagctgcagaaggtgttgcaaacgatgtacctgaatctagacacaaatgctttttataatcttcatcatttgatccatgatctttatcaactgttcgattatttaaagcagaagtaataaatgaacttgatgcaattatatcaggttttattaaaccaacaaatgttggtccaattgatgaataacctgcttttgtaatttttgaaacatcttttccaatatatccatatttatattgaattttaagattttttccgacttttgttgagagtttagaattatttggtaaaataaaattttcaattgtaaccaccttaaaattttctttaatattaggataagattctagaggaaaatcaataacaaatccaaaagtttgataatgtttttcctgttcaatataataggattcaaataaaaacgagtcatttagtataggaaatgcagaagaattaaaataatataatttctttgttccatttggttgttttaaatcggtgatttctgataaataaaattcatccaaattcataactatctgataatttggttgttcatctttaaaatacatttgaaacttttcttcaccatctatagcatatatttcgagattactataatcaaaaacttttgatgctccacctattgtaagcacgttttttgctcctccaggatttctaattgtaaaatatttcccatgaccatcattaccagcaccaaataaaactaaacaattctctcctattgaagaattataaacaacttcatcaataaacatattataatccattgtcgattcataaggtaaaaacccccatgaattagaaaatacatgaggatttcctaatgaaagagtatataaaaaaagatctatgtctttaaggagtcgattatattttggtaaataatgaccaagataaataagtttagcatctggtgctataccattatatgaagatattttactattagggtttaaagctttgcccgcaagaattcctgaaacttctgttccatgatcattctcatgagcaaatttataaaattcttgttctgtttgataaaagttttcaacatataaaattttccgatgatttggaattatttgacgaaatttaattggtacatttggatcataaaacatagtatgataataatcaaaacttgtatccatatatgcaattgtttgatttttacctgtgatacctctagattcaaaatatcgagaaataactggattaccatgaacatcagctgtaactgttgaacttattttttgagtaaaaccactcgaaatgctatttaatgttgttggaggattatattgattaataaattcaacttcaggaatttgactatagaattcagctgattttaatggatctttaacagagatgataacaatttgatgtgatttaaaaataatattatcagaagataaacatgaaaatgattgatcaaaaacaccatgaagaattaaattatcagatttttctatttgagtaagattaagtattttatcttttggttgaagaatactaatttttgcattaatgcttaaaagataagagatttgatctgaggtcaaatataatttataaacattttgatataacattccattcgttttacgaatatcaatactatggtttgctaattgaataaaatcaatatttgctgggatgagtacatatgcccatgtattactatttgattgtacattttgatttatagaatcaaatttaattgttttaccattgaatgttttgatttgtgttggttgcacatccaaaagtttcaaacaaaaaagaaaaacaaacataatgaagcgaactaatttttccggttttcacacgatttaaaagatgaatttcaatttcacataattttgaatgtatttggaggactttttgagattttttcagagggggatggcaatgtcgacaataaggatgaatatctataaaattatataagtgaaaatgttcttccactttaaaagacattcatatttgattcaaaaagtggagatgtggcaaggtgtcattgaaacgaatgttgttgatgtttgtaaatatgagtgtattactagtcatatgttgtgcgtgttgccaataattgttggggatgttatataacatattaaaaaaattggcttcattttatcaaggataagattcatttttgtggaatctttttttcgcttacactgatccgagcacacacacaagtttatggtaagcataaattacaacaatattaatgttaaagaaaatatatttagaagtatgtagaacgacaaaaacatgaacagtaaaaacaggaatggattttctgcatcatgctataaaagtcacgtcgaaaaagaaagtatttctttatatagtataactgatgaataataatgtagttagtaatatatatgatttgaaaataaggaaaacaacaaatttttcgttaaatagatttaattcatttcttaacgtctctcgtacccttgttttgtctttctatcaaaagtgatccttaatgaggttccatttagagaacaaatattcttcagcaaatgaactaaaatataggtattcattagcgaaaattatgaaaacaaatttttatatgaaaattctttattttttgcaaataactagtgttttttattttggacaaaaccataaaaaaatggtgccgtgcagggtgcccctaacgaatattttagaggaatcgtatttccagggcataacggtcgtcataaacggtctaatccgtggtaaaaccccgccgaaaattggaaaacccgccaataatattatccccgccaaaattgatatcgcaaaacaattatttgaatctcttatatcagctgtgcattcttttggtatttatacaacgatattatcatcctttcttaaatatctccaaattatgagatcatccaaatgtgaaaacttaacaaacaatttccctcattattataaataatttaaccttgaaagctttccaatttattaatatttttccctttgaaataacgataatatttatgtttcctttttctaatggaaatcaacacttatatttattctaaaatatatttttcatctataatcctttccattgccaaagtttcgggcaaaaataaaaaattcataattatcagatattatagaaagttaaaacacaatggttttttaatattatttttgaaattttggtggctatatttgtgaactaatgtactttatttcaaatcaataattaatatttgtacaaaatttttttttattaagcaatttgttttttgcatataactttttttatgaataagaatttcttctcaatttttgatattttattccttctcgagagtcttaaaatttttccaaattaaatcaataaatcaacttggaaaatatatccatcacttggccgctgaaataacgttgaatgatggaattgaattaaattttgtaatttgtttatatattcatcttcagttatatttttatcgacaaatttacagaacaaatctttgatcattgaattcctacccattttatgttcaatatttctagaaatatgaattcgacaataaaccagaattggattcgaatatacttatttgattgcctctatttgagcgattaatctatcaacaataaagattctaatagaagtaataactaattttaataaattcatgacttcagtgaaacttatttcttctttcgatgtcatgattgatatagcaagcatttgaactttgttattctcatcggatacatgaaaatataaaaagggataatgaaatctattggtgcattcagtatcattatttattacaacaatatctcttgcataagaaaagtattttattctcgaatttatcattaatagactatcaaatttattattattatcatttttccaaataatgtcatattctcccttacatttttgtgtatattgataaaggttttcaatttcattttcgaattgtttatttttatcatttctaataatattatacaattgtccaggcaatacattgggtgcattaaaacggctaatgagatttgttagcattccaattcttgcttcttttttcattttttctttttgatttgaagttaaaagggtaaacttgctttctacgaaaagattatcgagactatgacaatgataaagattttcataattaatcgaaaaaattatattttttcgtatttttattgtaaaagtcgcaggacattcatataatttctttgtatgaaacctgcatacgaatttcatataatatacattgacatttttcttatataagttcgaatcgctacatgaaaatgggcaaatattattgattgattcatcttttattgttgtctttaaatcattaaattcagtgatgtttcttcctttcaagttatttaaatagttaatgaaattggatggtgtttcatagcattcgtcatttttgggcgatggatttgtaagtcctaaactttttaattcgtaatttattttgtctgaaatgcttaatagagcataagaatcaaaatggttatcatttaaagtttcttctgatgggatgctcactattttgttgttcatttctgtgcattcgacaaatgcttccatgaccctatccattattaatgtttgagtggatggtttcttcttcattaatattaataaacgtcttttgattttattctaaaataacgttctaatttaatgaatataaatatttgtcacaactctggactttaacaacatataaggttaatataatgtactaaaaataaatatacatattaaataaaggatccataaataaagtttctcatctattatgtagatattgatatttggttttttatataatgaataaaagaacataatacgaatttctaatgtattgtacgtacactactacgtagtatttatactatatataatataatataatagttttaatatatatatattagtaataatatatataatagtaataatatatataatagtaataatatatataatagtaataatatatataatagtaataatatatataatagtaataatatatataatgataataatatatataatagtattaatatattattatgatactgatattagcatatatcatatcgaaagctaatcaataattcatttactttattttattcactgataaaaaaatataatttacaccatcatttatttattttttgatattgttcacacgataatagatagtagtttggtgttgttcacacaactatattaaaaattaaaataatatcagaaatgtagatgttgatatttgctaatgtgataattatatggatttcttatttgctatataagttaacgaataccaatgtgataatattatatattataattacatatagttaatctttcaatttattaatatatatactgatatatatacatttatttgatgaataactattttatattcattttttataaaaattactatttattcgacaacgaaattgttaatcttaatttttttttcatataagatacattttatgatcatgtgatatcacatatgttatgtatttcataaataatatataataaattcaaaaaaaaaatacttattatacgattcatacatatttttaatgatacgaattaatattcaacattattttcattatattctatttcatctgtattcatatacaattttttgctgcattcatatattaatattgaattttgataacacgaaaaagttcacatgtttatgattgagacaataataaaattctttcaattttagatacaaattcgagcaagataacatttctgaaattcaatttttttattcaattttgatcaatgctaaacggcaattactgcgctcaatttaattaatttaactttatatgatgcaaaacggcacttattgtattcaattttattaatttaatttcatttggcgtaaaaagtcacttatcgaaaaaaaattaaagaatttgaaagtataaactatacaataattcaatggaaacgaccgttatgccctggaaatacgatatctctaaataacttctgttgtcaagatacagagtgagtttgaatttgcttcaaagaaacgttaatatgcaattatttaatttacatccattcaagaagaaaaaagtcaaactgtacgaattttattaattaactaacatatcgattttgtcgatcgcacttttcacgtaaccatatattacaacgaaaagttcaaaattttgactcaatttatacaaaagcgtttcttcacttattgcatcgtcatcgatgatttcgtgtatttctcttaaaatttcctcgaaatattcttgaaactcgtcaacatcattgttttctttataataataatgtaaaatatccaaaattcccatcaaacaataacttttcacgttgaaatcacttgaaagatattgaacataaatttggaaaagttctttatcgaaatcaaaatctttacctggattctgatacatagttaaacatttaatacattgtacgccattaaaaaatggttcaatctctaattggttaataaatgtattcatttgttcaataccaatttcattttgaaattgttctttaaattgctgaaataatttataaatagaatatcgaacttttgggtattgattataaattaaaattttgaataatatgctcggatattcttgaggtaaatcggtaaatatatttagtactttatatataatattcatttgtttctcatcaattacaatatcagagatgataaaaagttgttgaaataatattctaaaattaggagttatgtttatgcgttgttggcaataagtaataatttgaaatgaataaaaaacaacatccaaatgatgcttaataaatgattcaataagtgcatcgatgttattattgttggtttcactaaataaaagtgatgattgaagtgcaaaaattaaactttttgaaaaacgcccttctgtacttttagtatgatgtaaaaaatcttcaataaatttaaaattaaatttcttgcgatattcaatacttaaatattgcataatcccaatgaaattaaatgttgaataaataagtttttcattctcgcctgaacaaatataaatctcaagagtgtttagaaatttttcatcaagaaataaatctaaattagaatttggaaaaagtgaatatatagaaagagtatcaagtgcggtagaccgttgttcttcattaaattcgggtgaaatagaaataccaaaaatgtttcgaagaggaaattcattcaattcaaatggaatcgtttgttgttctaaaaatttttgaagatatttcccaatatcttcaagtgttgaaactaatggatctgagacaaaagaataccttagaggcttttgttctcttagatgagtgtgaatacatttttcaagataaataactaaatcttgaaaagatcccaaaacatgtcgtcgaatatgatggttttgttctgatgcagaaggaagaaatgtacgtaaatttcgttgtttttgtttggtgacatcccacgctttatatgtaatcataaaaatctacaaaaatttgatttcaatgttttttgatcggccaaatgttgttcttcaatcccatttacaagtggttatgtcagggtggttcagactctaattaacgttttccatcgctatcgttacagggcacctcaaatataactttcatttaaagttgctagcagaatcgtccttcagaaattttgtaatcactttttctagcatgtacacttaaaatatccaaaaacatttttattaaaacgattaaaaaagttggcaaattattcataaaattgttttattgtaaaaagaagtttatataagagagtgaatatggacttttataacttacatttcgatttgttaaatgcgccatttttcagataaacatattgattatatgatgtaaaaaaaattgtcacaataattattcatttcaaataataaaatgaaagaaacgaaaagcaaaaaccaacatattatacagaatcatcttgggaaaggttttatatatatcttaacattttttccgatgagtttattggaactttaatctctaaattaaataacattactaaaatcataaaaataactataattttaatgtttattttcgttaatgttaatcattttgaaaaagaaacggatagaaataaaaacaaaaacccaaaacaatgttttaattcaaatattaacaataacaatttttcattagtaacaaaaaataaaattaaaaagttttcataaatgaattttttcgttattcaaacataataagaaataattaaaataaaataaaatcgaacatgagtgatattatacttccaacaggtaaagagaaaattgatcgaagaaattggggtcaatatcgaaatccaggtgatatttataatatgaattttcatgatatttttggtagtataatatttcttatattttttatattattaatattattattaatatttggaattttaaaagggaaacctttgttattatttcaatcatgggatgaaaatgggaattattgtgggattgataattataaattaattaataaaattcataattataattcaacgagatttcaactttataattttcttgaatatccttatttattatttagtttaccacgaaataatgggaaagaatatgaaagaatcggtgaacatcaatattgtgttaaaaaatgtccaacattaaatacttttgaagaagcgatcacagattcatgtaaagattcgattcgaatttgtccttcatattttaatcaagaacaacgtattcaagaacgtaagaaaggaggtaaatgtatttgcccttatcctacacaacaaatattaaatcgttgtattccaattcttaatgaaagtattaaaaaatcattttataaattttattccaggtttaaatcaaaaatataatttcatttattaaattatggttaccaattttattatcttcattttttatcaattattatatcattcttatttatatatttattaaaatattttacaaatttctttatttattttatatgttttatgtttcctttaatatttatatgttttggaatattattttatatttataatgataataatgataataataataataaatattattataaatatattccttatatattttggtgtattggaattattatattattaattatagtatttttaatagataaacttaataaaactattaaaattattgaaatttcatcccgtgcaactatttcaaatataatttcattttttataccttttatttcattaatattaatattaattttttatttaataattattttatcttcaatttttaattatacatcaaatgattttattattaaatataaaaataataaattatatttaagttatttatttaatgatattattaaatatatattaatatataatttctgttattttatatttatcacgattcatttatattttattaatttttattcaatctcttcatctattgtttattggtatttttaatcaaaatatttcaaatatatgtaattttaaatgttttttatggattttatttatcttttactaaatcacttggaactattacatattcaactataattattattccctttttatttattaattataatattaaattttattgaacaaagaattaaaaagaattcattaaatattagtaaatttattataattttaatgaaatgtttaacatgttgtctttatatttttgaaaaatttcttcgttatattaatcgaatcctttttacaatatcacaaatttataatagttcatggtataaaagtattaaaatttcatcaaaaatattatttaatgatattttattaacaatatctttaaatgggattacaaattttatcatattttctttaaaaattgttacatcaggaattaatacatttttcttcttttttatatattaaatttataataaaagattttattcatgattggattttatcattatttatcatatttatattaagttatttattttgttcatttgtatttggaatgttaaataatataattgatattatatttgtttgttatcaaagtgatattcatttaactaagaaaggaattaaaagagaaatgtatatcaatattgaatcaaaacaattgatagaaagtttaaaacaagttgaaatgaataaaaataaagaagaacattcagaataatattaataaaaacatgataatctttattttatttaattttttataggtggtaacactcacaagaaatgaaaatattttgttaaaaaaaaaaaaatagttttcgaataatatgtgatttgtttataacttcttttgaaagcttttactttagatataatatattagttgcaatatgtgaatcattttattcactttcattttacattttccctaatattccttttaataattcattgttatgaaaaaaaaaaaatactttttcaaagtttatttaattaaataaaataatatccgcatttgtttttctttaattttatgtttcagatttattttcatttttgatatgttttcgttttgttcttattcgtttccgaattttaattggacgtttttcattttcttttgtttcaatttcagttttaatgttttgaaatatttcttttagttcttctttcttttcattgtaattaattttcgatattttgatttgtgttttaagattttcaagttcattaaatgttttcatcttttcattgttaatttgtgattcaatgttagctaattgtttcataacagtacttaaatttttagatgtttccaaaagttctttggaaattatcgaattttcactttctttagtttcaaattcattttcaattttatcagtttttgaattcgcttcttcattaaacgcaaaacatttgttattcaaatcttcttgtttcatctcaagttcttttaaatgttgaaatttgttttcttgaacattttcattttgatttttcttcgtttcaagttcttcttgcagaatttcgatgttttttcgttcttctttaatatatttattaatttcagttaattttttttctttcttttcaatgttttcaatttcttgaatttgtttcttcttttcatttgtgttatatttttgcaaattatatgaaattcgtttttgaatttcttttacacatttataattaatattattaaagtcaaataaacatgaaataaaattagaattatcacaaagcgctttttcgatcatcattccattttgaattagattgtttttaacagatattttttggaatcgttttgacttcccaatcgcttcaaacaattctttcgcacctttatcgccaaattcacaaagttcaacatcaatatatttaagattcggatgttgaataatagatttcgcaatttcaattataccctcatcatgcaaaggattattagctaaaagtaatgatttcaatgttttattagggaaaaattctcttaagaaatcatttattccattcgtatcaattaaacaactacaaacgtttaatgtttcgattgtgttattataacttaaagcagatccaatagcagagattcctcttccatataaagcgttacgtgatatattgaaattacgtatggatttattggatgcaagttgtgtaacaagcgatgtagtaaatcgttgcgttatttcattgttcgatatattaagttcttcgattatattattattagtcaaaaaattaataaaatatggagatgtgtcatcacgaaaatgattattagaaagatcaagactgacaatgcctgtgccgataagactggaaagaataaaatttacgcctttggatgtaagattattgttggaaagatttagaaatcgaagagttttgttgtgcgaaagtccatgactgagaattgaggcatgatcagatgtaagatctgtcatagaaagattcacttcagagagaactgtgttgtgaaaaagcatagaacttaatgaattagatgcttcaacacctatcgaatttcgtgtagatgtattcgtgctactaatgtcaagatgaataagagtcttattatcaattagagatttaaatatatgtgacattccaaaatctctgattttattcgatgaaatgtctaatgatataattgaatgattttgttgaagaatttttgatatttcaatcgcaccttcgtctccaagtgaattattggggagaacaataactttgaagtttgaatgtgttaaaattatctttgatattactttaatagtttgaggaccaatacctaatccgtcaaattgaaatgttttatgttttgtttcttttttatgatgattctgatatcgaataaaacttttttttgagaattcgcaattagaatcttgtgactttgcaataaaaatttgtttgagttcttgtttagaaattggggcatcaattaaattttcatcaggtttttccattgagtaaaaacccaaaaagatattttaaacgttctttttatccaaaaacaaaaaattccaataaacacactaaaacccataaaaaaaaagcattatacgcatttcaatagtttcctgaataaaacaaatatttatccataaagaatcaatgtattgacttatacctaataatgaataaaacgattaatcataatttatcctaaaaataaaagaaaatcgaaaaacaaaaaagagcaaaagtcttcactttaacaaaaatattaaatttaagaatttcaagataagatatttaacagcaacgtttttccgttggttcatttgtcataaggatcgagtttaataaaaacatgataatctttattttatttaattttttataggtggtgacactcacaaaaaatgaaaatatcttgttaaaaaaaatagttttcgaaaatttggtaataaaaaataattatcatatattatgtattgcatatgatctagaataatatgtgttttgtttgaaaattatttaaaacggtacttattgaagcatttgaaaatggatatacagggattgataaaatgcaaaaataaatatcaataataaacacaaaattatatttagggtgaaatatctttgaataaaatatttcaattgttgtgcatcgaatatgagattgtaaaaataattaagaaagcaggttaccattttaacttaagttaatgaagagtaagaatcttccctttttgatattgtccatcagattttccacatgtatttatgcattcaatatatagcttaattcatacatctattttcggtttcacctcccacgactttttttatttgagcaatgtacgtttattaatttttggaatgagttcactttcccgcaaaaaaatgccgataagtaccaactcctctcaaatggcgggcttcaaaatttggtaaggcaaaaacaacatgcaatcatctttatttcaattcttttcgccaaagaaaagcacaacaccttctacatcaccagttgccaagaaagctaatgctataagaacacttaaacgtgtttctaaaattgcaaatgacgatcttgactttgaacttgatcaagattttttgtcagatgaacttgaagatgaagatgagaaagaatttgataaagttgttaccgccaagaaaatcaaaaagagcaataaagcagctgagaaagcaaaaacgcccaattcaacatttatttcagcacctaaaacgcccaaagcacaaccttctaagagtgattcaaagtcgccacttatttcaccatcatcgtccatggaaaatcttcgtattacagcggaagatgaagttgaacttccagattggcttacaacgaatctccgtgatgccaataagcgacggccaagtgatcctgattatgatcctaccactgtttatattcctcccaaggcgcgagatagttttactccatttcaaaaacaattttgggaaattaaagaacataattttgatgccatcgttatgatacggaagggcaaattctatgaaatgtttagtgttgatgcaatttttgctcgagatgtcttaaaacttaaacttacatcacgaggtaaagaaccaatgtgcggagttccagacaaagcgtttagtgaatgggccattaaacttattaacaatggtaaacgagtatgtaaagttgaacaaatggaaacagcaattgatcaaaagaatcggaaaggacaaaaagcgatcaaacgagaacttgttcaaatatatagcattggaactattgatgattttgaaatgcttgaaagtacacagccatcatatttaatgtcacttcgctcgtttggacgtaatattgctggtatttgtttagttgattgttcgattggatcatttcatctcggtatagttagtgaagaagatctttcggatttattaatacgatttgaaccagttgaagttatttatgacaaagaaacgatttgtccggaacatctcgacattgttaaaaaactttgcggtaattcatgcgcacatgcgaaaagtggagttcaatggtgggatggacaacttgcgatgaatgagatccaaaaagttgcgtcgtgggataacattcccgagaaattacaagaatttccgaaagaagcaattgcagcatttggaggatgtgttttgtatttaacggaacacaaaatcgcgaagtctcttttatcacttcaacgattttcatcacttaatgaagcgggcggaacacgttatctttcacttgattcaagcgcattatcaaatcttcaaatcattggcaaagacgaacattgccttttaacgattcttgatcgatgttcgacaccatttgggaaacgtcgtttacgcttttggattatgcatccgttgcgtaatattaaatcgattgaacaacgccttgatagtgttgaagaacttatggatccgaaattttcgacattaccgaagtcacttcaaatattacccgatttagaacgaattctcacacgcgtttattcgaatcgatgtagtgttaagatatttttagaatgtttaaattcattaattaaggcgtcggatatcttaacagcatatgaagataaagttcatacgtcacaacttacattattacttccagttgggaaaggtaaagcagcgcataaacaaatcgaaacatatattgaatcacttgatctcaagaagtccacagaaagtaatgaatttgtagttaagccaggaatatttgaagatattgatgaaattgatcaacagattaaaacagttgaagatgaacttaatgaacaattacaaaaaattcgacgtgaattacgatgtaaagacattgaatttgttcatcaattaagtgaacgctatcaagtatctatacctaacaaagtagcgtcgagtgttgatgatcgatttatattagtttctcaaactaaaggtgttaaacgttatcgcactccagaaattaatcaacttatcagtaagttagagaatttagaaaacgaacgactaaaacttcgaagcggctgtcaaaagcgttttattgatcaatttgcatccaaaagtgaactttgggattcgattttagaatccatatcagaaattgattgtttatatagtttatcaatggcatcgcaacgttgggaaggaacatcatgtcgtcctaagtttgttactaaagaatcggaagaagcaaaaggccattcgttactttcggtgaagcaaatgcgtcatccatgtattccagggcgatgttgtcctaatgacattgacattggtgacaagaacgtgattattgtcactggccctaacaccagtggtaagtcaacatatgcgcgtatgtgttgtgttgctataatattagcacaaatcggatgttatttgcctgctgactcagcaacattaacaatattcgaccaaatatttacccgaatcggtgcaggcgatcgacttttttctggtcaatcgacatattcagttgagttatcagagacaggaagacttatgcgtaattcgacagaagattcatttgttgttcttgatgaacttggacgcggtacatcgacattcgatggaattgctattgctacagctgttcttgaagaattcatcgaaaacattcgttgcccattggtgttttgtacacattatcatatccttacacaacaattcaaagattatccaatggttcgaaacgcatcaatgcaatataaaatcggtgatacacttacgctgttatatcgattgattaatgtcccttgttcatcatcatttggatgcgctgttgcaaaaatgtgcggaattccaaaagaaattacagacgaagcacaaaaagtagcagacgatttcgaggcacgacacaaagcattgcatattattggggaagaaaagaaagtcgaagtgaaagaagcgaaaccagaactaaagaaattggtcgaagagtttaaagccgcggcttcaaaaggaagtagcgcagaaaaatttgtcaaattgttacctttgttagacgctgttaggaacatagatttgaattaaataaaatgagttttgtatattaaattatgaaaataattatttttaaatgttgaaatttgttttcttgaacattttcattttgatttttcttcgtttcaagttcttcttgcagaatttcgatgttttttcgttcttctttaatatatttattaatttcagttaattttttttctttcttttcaatgttttcaatttcttgaatttgtttcttcttttcatttgtgttatatttttgcaaattatatgaaattcgtttttgaatttcttttacacatttataattaatattattaaagtcaaataaacatgaaataaaattagaattatcacaaagcgctttttcgatcatcattccattttgaattagattgtttttaacagatattttttggaatcgttttgacttcccaatcgcttcaaacaattctttcgcacctttatcaccaaattcacaaagttcaacatcaatatatttaagattcaggtgttgaataatagatttcgctatttcaacatatttgaaatttcaaaaaaattattcaagttttaaaatgtggaaattctacacagaaacaacggttatacattaatttgaaaaacttgataaaaacggcgcattgaaaagaaaacacaaaataagagctgacatagctttgtcaaagcaagataaactgtgataatttttgtttaaaatttatcgataatttgtttcaaaggtgcgtattgatcttcaggaattaatttgaactctttagcaaatattacaaaatgtctaaagcatgtgttcaaatgagcttcggccccaattctttgtatgtgctcacggtggtggaaataaatatgtgcatagattctgaacattcttttgaatatattcactaaaatttctctgaagtttttgggatatggagttgctggatcactaggaaatacagactcatcgtcaagatacttttctaccatcaataaaacattcgcgatatattctctggctgggatcatagttggtttcttatacttatcattgtcttgccaataatacttatacgcgggaccagcggtcatttcagggcaagattcagttgtgcaattatcaataattgaagagaaaagtaaattaagctgattgaaaaactctgaaacatgtgccgctgcccactcttcaaaggtgcgatttgctggaagcttaacagcctctttcaaatctccagcgcctagtgtggccatttgcgaaatttctttgagctgatgtttttgatcagcaccacgaacaggcctaaatgttccttgattcttgtttctggagttaatattaaaacatacagccaattaaacatacagaataagtgaggcctccacttttcaatgaaatgaatactatagaattttgtgagatgaattttggcattcaattttctgctgtttatagcaatcggtttttaatgaaagcaatttgcaaaaagttttatcgtttcttcaattttcgttgggtttccatggaaaccaaattgaatttgcgaaaaaatctctattgcaaaaaaattaaacaatacttatataaaatatttaacttgattatgataaatgttgcatgatcgcattcaattactttttatgctattccacttcaataacaatcaattaacaaaacacaaatgcgtctttagtggaataaactaggaaaatttctacttagtgaagatgttaaaaaatccgaattatgagaaattgagctttgtgtatacaatcctaaaatgagtcgtatttatcacatttttattatgcataatttatattaatgttataactaggaagtaaaagtccaacttctgtgccccatttaaatattcatcagaatggagaaaaaaaaatgatcatttgttcaacatcaattttaaaataattattttgaaaaaatttctgatgtattcaaagttttttaacaaaataaagtctcaaattaaatatttagattcaagcacatgaataatatttacttgaaagtaaattgaagcgatttagcatcacttaatttaacgtgcgttaatctgatattcactaaaattctttaaaagaaataacatcaaatgaacaaaacaacattcacacacatttatatatggtttaacaattatttaaatcaaagtttaagtgaatctggatcaaaatcatcatcacttgatgatccgcaaatttcgaaaatatgtttttgaaagcaatcaggcggtgccgacataacaaggtcttcacattcagcatcatctggtggatttctgataaatgttggaaattcaccaagttgttttttcatgtgtccaagaagtggatgtattcctctgatctcagggaagaatggatgtgatttctttggtgtgattggaggattagtttgatcttcaacaattttttgatttggattaggtgtatttccaggaggttgcatattgttactatgattaattattgcaagagatgataatagagaggctcgagaggaacgcatgaaatgtaattgtgcaaaaaaaacatttgcattatttacaacttcagtgcatggatgtggttctctaatatgaaacgcaggcactttggatggattttggcctattttcattatgatatctgcaatagaatcacttgcatttttgatatttaattttttaggtttgtaaacttttttatgagtaagcatttcaactgagcatggagcgtctgtcacggaggaagagagagcatcacgtgcaggattcaatatatcataaagatttatcccattttcaattgctgaaagttctgttaaaattcttcttttacgttctattaatttttcgttttcagcttttgctctatctacagtagcctgtggcgttgggaacgaaaaaccatattccatttgaagtgtatatcagaagtacttttgatgtaaagtatataatttttgatcgatgcatacagaacacatgtgattcgtatgaataaatcttatagcaaaataaataaatatcagaacgaatgggaaaagttactattgatatgtcatataatttttttcttgagtaaagaaatatcacccaaacttcaagtttaataatggataaatttgattatcactgtattcttttaatttgctagttattcaaattatatatgtattatttggtatacaatataaaatttttattttcttgaagaaacaaagaaaatgatttttggttaaaaacatattatatttaaattcaaacaattatttattaattttcacaacagttttttctttttcgatcgcatctatgaactctatatgttcgctatggagtctttctgcatattggtttacattttcagagaactgtgatatcagctcaacaatttgtgggttcattgagtgtttctttgattgcgcgattaatttttcgtagttcattttaattttctgcaatatcaaaaccaagttttgcttgaacgaagcattacaattattaaatgaaatcgattttgcgagttcattttcgttgaatattttcaaaaccgatttcacaaagaattcgaattgtttaacgtattcaacgtataaatttttcggaatattattatttatactaaacataactcgattttcattatttttagttgaattttgggttttcaaaactccttttaaattagatgttgatatataatcacttacatctttaaagcttatgaacgaatttgtttcttccatatcatttttatattttatgttatatctgtgttgaagatttattatattgtttttttcatcttctgataaatttaatttatataaatttcgtttattcgtttgcgatgctgttgcatgtatacaagcagttgctgcatcatgtaaatcttgcatcatttcggatgtagttttaatgaattcgacaatatctgaacgtaatgaaacaagtgggaaatgcgatttattttggatgagttctattatcgaatgttttaatttaaagattcggatatttaatggttcgattttgttcgaaaattttgtgatgaataaagtgatttgataaacaagtaactcaaatagttgttgaaatccttccataagtattttacgtgctttaatttcttggttagaaaattgttccattttttctttatgttgttgtttttgttgtttgagcttttgatttaatattttctctgtttcgaaagctttttgttgtagttgattcgttttatgattcggcgattgaagtttatattgtaatgttttgttttctttctttaattgttcattttctgtgattattgttttggatttttcaatttcattttgaagtgattcgattttcttaagtaatatttgcgtttgattacgaagttcgcgattttctttttgtaaaataatataattttcatttaaatttaagttttcggcttgcaaactaatcgaatcttcgcgatttattttattggtattcattttagttgcagatgaagttgttgaaagtgtttctaatgttattagtttcgattgttttaatgccttttgaagtaatttgtttttttctgttaatttttgattcaattttttaagtgcttcaattttgttcgatttattgtttgttaatatgtttaattcatcaatttctttaagaagatcattcgctttttctactaataaagcattgttattattatttgtcttaagtaattcattttctttctttaattcttcaatagttttctttccgttttcgagttcaacaaaattttcaatgtttttattttgtaatgtttcgttttccctttttaattcatcagtaattttcttctctttttcaagcgcaatcgaattttcgatgtttttcttttgaagttcttcattctctttctttaattcttctgtagttttcttctctttttcgattaaaacagaattttcaatgttcttcttttgaagcgtttcgttttcctttttaagttcttgattttgcttcgtcatattctccatttctttcgcaaattttctttctttttcaatcgttgaagaacttattctcttctttttgagtgtttcattttctttctttagttgatttgttattttcttctcgttttcaattgctttaagattttcaatgttttgatttttaagtgtttcattttctttttttaatttatttgttaatttcttttcattttcaattgctgttaaattttcggtgttttgttttttaagtgtttcattttctttctttaatttatttgttaatttcttttcgctttcaatcgcttttgtattttctatgttttgattttgtagagtttcatttttcttatttaattccgaattttgattcgaaatgttttcgatttcttttgttaatttcttttctctttcgatgagttcattattttccgaatttttctttttaagttcttcattttcttcattaattttcttattttgattttgtaattttttgatttcatttgtaaatttttctctttctgcaattgataaattcggctgaaattttggtgacattgaattactttttgatgtttgtcttcttaacaatttattttcatctaataattttatatttttctttttaagttcatctatttcatttgaaatttgtttttctttttctttaagtgatttattttcttcattaatttgattatttttatcttgaagttctttaatttccttttcatttaatattttattacttttcaacatttcattttcttcaataagtttttgatttgctgtttttaagtcacttattcctttaatgttttgtattgatattgattcagatgccaaaagatcttcttcagttttttcatcatcacttgataaagtaaatgtaccaaatgttttttgattactatatttcgatgtacttaatgaaatttgttgaattaatctttgttgtaattcattattttctttgactaatttttcattcgtttgttgtaatgaaattaattcattatttatttcagctacaatttgtttataattcggttctattttttctaatttattaactttctcttttaattcattgttttcttttattaaattttgtactttttcgtcagattcgtttttcccttcaagatcacttatttctgctttgagttcatcattctctttaactaatgcttcgtaattagaaatggcactatcaatgtcatttgctttgaagcatataattaatgatgaaattgttttatgtaaattttcattttcgtgcctttcagcaaataataaattattcgcattttcaagtttgtcaagaagtgatacattatcttcttcattgttttgaagatttaatattttcgattttaattcttcgttttcttcttttaatttgtcaatcgtgtctgttgcattttcgagattctgtacaagtcgttcaacttcattaaagtcaatgaaggacaaattttcgttgttttgattctcttcagtcagttctttgtttttctgcttgagtgttgcgttttcttcatttaatgattttaatgagttttgcaaattttctatcaacgcattgtttttattgagatcctcattctcttgtgtgagtttgttgatcctttgattgagttctgtgatttggaattgaagatttttaatgatatcttgcttattttgtgaatcattttcaagaacttcaagcttagcgcgcaaagacgtactttctagagccgcttccgcctcgttttcaagctgagctgatgcttcagctactgcatcaaccatatgattcgctctttcatttatttcattttgtaatctttgattttcttcaatggccttggaaagctgctcttgaagttcttcgttcatcgttgatgaattttgttcatcttgtgataatttggcaattaatttttcttgatcaaaaaattcttgtctaacactttcttcaatattgtgcgattttagaaagctatttaacctaagttccatgttacttagaagcattcttaatgtaaaattttcactttctaattcgtcaacatgttgttgatattctttggcaagaacgaatggagaacttaaagtttgatccattaatgattttttggacttaggtgttgaagagaaatcaagaggagaatctgacatgaattttggccgtttaaaaataaaatctacaccctgaaaaaagagaaattgcatctgcattacaggtttcaacatgtgaaatattcacaaaggtacgctacatattaagaatttcatataagtttataacgcaaaattaataattcatacatatcagttttacataattacgagacaattatttcatatatgcctttttgattctcagctccatagttcttttaatatttgtgaaattaagtcaaataattttgttaataaatctttatttatccatacaacaaacagccaaatgtttaacagtacattaaaactcaagattgaaaaacttgcaaacaatgaacagaaacacaaaaattgttattgacacaaaattgataattgtacgatgacttctatttaccaagataagagatccaacatcgtacagtctactcgaaacaacaacacatatttctttgccaaatccttctgttgacaaaggaataaatctgaaaagttgtgaagcaagaaaacatgtgaatgagagtaaaagtattgtagggtctgtagttttgattaatgatgggagaattgggatcaacgaaatagttacctttgagtgaagaattggaaattcgttaagtgttgaagaaaagctgaaaaattttgtggaataattaggatgaccatttatgagagaacaaataataaacgttgtgattgacgaaaccatgaagataccaactgtaaggatagctggtaaatctggtgctgtatcactaccaattcgattattttttaaccatagaaatagaaatgaaaagaaacaacaaaagacaatatggataaattcaatgcaaatgttagctgctagtgagcttaaaatgcctgaaatgagaatcaaaatataatttaaaattaatcgctttgaaaggcgcaatgacaagacaataataaggaagttaatgcttgtgaaagaaaaggcgatgtcaaattgtgattttgatagtatgaatctgagaagaatgaataagtagctcgataaaatattgcaatttaataaagctaaagagatgattatggacaagataccaaattcatgtaatataaacaagatctgttgattttgaaataaaaatattgccaatttattatttgtatttgcatcaatttttggtgttacatctattgcttctatgtttaaatagcatttaatggatgtgcatattaagagacagatcattactaaaatctcaagaacatgaggcctcattttgctacttttgcttacaacgtgtgcatccacgcaaaaagtggagtcaaaagtgaattttttgagtggtttacttttcttatgtgggaattaacaacttttattatttaaaatatagtttaataaacataacaatttattgcttctttgacctactcttaattttatatttctccactgcttcatccttcgctttcctaaatggtaaaacccatttaagtacctttttctcgtccacttgttttggtttcaatttccttcttaagaatttttctattttcaaatattcatctttatcttcaagtgttacaaatgtcagcgcagcgccttttcgtcctgctctacctgctcttccgcatctatggacatattcctttggcgttggaggcaaatcatagtttataaccaaatcaatgtttggaatatcgattccacgtgctgcaacattagttgagacgagaattcgtatttcgccggtacgaaacatcgatatttgttcttcacgctgtggttgcgtcattttcccatgcgccatcccagcactgaagccagcattctttaatgcgtctgtgagaatttcggccatgcgacaactcgagcaaaaaacaacaacggacaattggcggttttcatcaaggatggtagcaagcgtcgcttccttacgttgggcatgtactggaatcatctcttcttcgatgacagttggaagttgttcttttgagccaagtttaacaaatgacgtatcgctgattgaaagttctgcaaggcgttcgacgctctgtggcatggtagctgagaaaagaagaagttggcgttggtgagatgagctacgaatgatgatacggatatcatcataaaatgatacacctgccatttgatcagcttcatctacaacaatgatgtggacagtagaaagattaaatccatgggcttctgtaagaagttgagagagtcgaccaggtgtggcaattattatgtttggttcttttgcaagaagtgccatttgttcaacatcatccatgccaccgtaggctgtaacaatagtagctttgatttttttgcaaagaatttgacaaacttctgaaatttgaagaacgagttcacgtgtaggtgctaatatgacagcatatttaggtgggatttgtgcttcaatcatacggtggataagaggaagcaaatatgcacctgttttaccacttcctgtttttgccattcctgcaacatcttcccctttaagagcttttggaattgttgatgcttgaatttctgttggaactttccatcctaaatctgcaactgcttcacaaacttgaggacagaggcctaaatctgcaaaagtttgagtttccatggattttggtcaagaccattgaagaagtgttcaatactttacaaaatctgtatgatatgacatgtgatatgaaaatatatcaaacatttattaatttatatatttggctaaaaatattgccgatttatcaagatcatttgtcattgacaccaattcttctttggtgaatacgaaattaaaaattgtgccgttttttgtgaccatgatatgtgcaaattctacaagtctgtcaaaaactctttggacaagaggagaaagttctacttgagatattttacaaagctgatggattggacaattttcgcccattgctccaataattgcacacactgtaataatttggggtggaatttctacgaatgcatatatcattaaagaaagatctaagaagtattcagcacatttctgatattgtgttccattaatttggattagaaatggttctaaaaataactgagcagttggataattaaatctacctttaactgcttttatgacttcgagttctttttgaataaattgatcatctgtaaattggttttgacaaatacatgccgaaaaaattggaagttcaaaatgagatgtttccacaatttttgccattagccataggcaaactgtagccgtcaattgaatgtcttctgtctttacattaatttgtgtaagtacttgatcaagaatataaacagtattgtataatgtttcttttgtaaaatgtattttatatacaactctttcaagccattctataatgcaaactctggatttaagtgtgagatcagtttgtttattagcaaataatgatgaagatattgtaatgttctttgcttcgtttaatgaattttcaattgcttcttttattggtgatttttgttggtattccatttcaagagaatcattgaaaaattcatcacagaaatcgtcttcgctgtattcacactcatttatttccattggattgcatgtcacaaaccgtaatattactttgaatttttgaatagttaccgttttcttttgagtttttatggcattatcgaccacttattgtgtaaacaatgtttaaacatcagagtttgtgagtctttccatgattttaggaataagccaagattagaaaattcatagatggcgtttacttgggaagttttcattaattgatcaatcaattaaaatattatatacgtagctgttttcaaattggattaaatggattgcattgaggctcgatttgtttcacttggtttcctgcttctcgctctcgtaaacaaaggtgatgtcaaaggttggacggttatatgtttgggttcaataaacggttaaaaatgaggaaaaggattggaaacaaaccaatccccaaaattcacaaacctgcagtaacaaatcattcaaaaccaagaaaacttgcaaaaagagaggttccaaaatcagaactgaatcttaatgttgatcaaacattaagtatttcaacattgcgtcgtttaaattcagaacgtgatgtcgtcattaaaatgagtcgtaactttcaagacgtgccaccaaaagaatatacaaatctatttttatcaaaatgtactgaatgttcaattatttgtgatttttcatctccaaaaattgatgctaaggccaaggtaaccaaggctacattgttaaagcaactagcatcatgtttttcaatcccacatctcatccgaaatatttcacttgagtccatgaaagaatttcacaaaatgttatctatcaacttatttcgtacgttaccaaagatgcctgctattaatgtagttggtgcacatgactcaatgttggattctgcatggccacacatcagccttgcctataattgcttattagcctctttgaactgccgtcattcctccaatatatcaagtagttttatctataatttagttcggaattgctcgtctccagatgatcgcgaaagaattgctgtacgcgatatattacatactttatataccaaatacatgaatctccgttcaattgtgcgtgataaagttgctgctcattttgcaattggtaattgctccactgagattctcgaattttttgttagtgttgtgacaggttttaattctccactaaatcccagccacattacatattattacaacgctatacttcccatacatacgcttgaaaattatccaactttccaagcgcaatacgttcaactcattttacgatacatcacaaaaagtggatttttgcttgacagaaccgttaattatcttttgatgcactggcccaagtcctgtcgtcaaaagcaaatacttttcttgtctgaaattgaggaacttcttgagaactttgagattaatgtgacgcctcagatggcaacatcagttttcaagctcatttcgaagatgacaatgaacttaaattctgatgttgctgagacagcaattaatattttgatgaaccctaaggtatcatttttactgaaaactcatgcatcaactctatacccaataattgtgaaatatgtttataaaagtgcaaagaatcattgggatgagtgcataaggacaaacgcatttgtgacattgcagggattgtcagagctcgactcgcagacatttaataaggtaaacgaaacattgaaagtgaggaaagctaaaaaagcaaatcagttcaaggcgaactggacagaaatatttgagggcgctaaggcttttgataggaacataaagccgatttgatcaatgtatgtaatgaaataaatgtcattatgaatatttttttttaatgtattatatgttcagattcattcaagttgtgaactatgtgttaggtttcaaacattttattgtgaaatataaaaaattgaaatttgctttctataacacagttaacaatttttaaacatttattgagtttattttcgattataaatcattcaaacgaatcaacatcaaaggctatcctttaacctgaacttttttcatttgtcaaattttgcatttcattttcatgaaagttgttgttattagtgccactggtttcattgtatgcttacaaaggacatcattgaagcaccaaggctgtgtgttgttgttggtgcaggaacaatattcaatcaaaaaagggaaagcaaattctcaaatgcagattatgcagtatggttgatgaagtgtccaatggcaaacgcctcaccgttggcgactaggcaaagaaacaaacatttcacattttatagatttcgaatcattcattggtaacaactttcaaacaaagtaatggaagcagagaaaaattaaaaacaaactatttcagactttttggaataaaaccatatgaaaaggtaaaattaatcccattaaactgtttagaagcacttgcggtgaacaattcctggaccagcttcgttgtattcgtcacgtgtgataaccatttgtgggaatgtagcgagtgatgcgaggatggagccaccgatccaaactgcgtacttacgttctggtggggcgacgactttgatcttcattgttggtggtgcgaggcggaccatttccttctccatacgctctggaagaccttcgaacattgtggtaccaccagagagaacaatgttagcgtagagatccttacggacatcgatatcgcatgccatgatggagttgaagagggtttggtcaataccttcgaattcgaagccattgaagtgtggcttgaaaagaagttctgggcacctgaagcgctcgttggcgatggtgatgacgttgccatctggaagtgtgtatgagatgtcgctattcggatgttgtggcggccttgttcatttcttcgtcgaaatcaagagcaacatatgcgtgcttctccttgatatcacgaacaatttccttttcggcggatgttgtgaaggtgtaaccacgttcgttgaggatcttttggaggtaggctgtgagatcacgaccggcgaggttgatacgcatgatggcgtgtggaagggagtagccttcgtagattggaactgtgtgggaaacaccatcaccagcatcaaaaacgataccggttgtacgacctgaggagtaaagggaaagaacggcttggataccaacatagaatgctggaacgttgaatgtttcgaattggagttggatcatcttttcacggttggcctttgggttcattggggcttctgtaagaagaactggatgttcagctgggtcaacacgtaattcgttgtagaatgtgtggtgccagatcttttccatatcgtcccagttggtaacgataccgtgttcaattgggtacttaaggatgaggatacctgccttagcgcatgcttcatcaccaacatatgtatccttgttttgaccaccggcgattgtttggacatactttggacgaccaacaatggatgggaaaactgagcgtggtgcttcatcaccagcgaaaccagccttgcacataccggaaccattatcgataactaatgtttgaacttcgtcttcagccattagatgaaagtgaagttaaatctgtcacttcaatttacggactgttcgcaatggttaacggttattttcaatatttatgctctcaaatttgtgtgcaacgatcaatatcgttcttcttttatatgaaaaagctgattgtcaaaatgcttgtaatgtatgtttgatttaaggggaacgaaagtttcataaaattcacatatttttttatcattttaaattagttgaactccgttcttttattgcagaaaattatcgaaaacagtctttttataggtctataaaatataattccatattaggcttgcacaaaaacaaaataagcaaacaattttaacttaaagaaatcttttaattgaccaaaatataattggaatgtcataatttgcgactttgatcattcgattatatcatttataaattttgcttaaactaacggtcgttcttatggaagtaaaccgtaaaatcagcacaaaaagttgtatgttatcggaatttgaaacaattcatacaaattatgccgatcaaaaaattctcaaaaatttttgagaagaaaaatttctttgtgataagcgccttaaatcagggggtgtatcgtttctattatatcccactttattataaatatttaatcataattaatttattttcaggacgaagttttaatgatttaacacaatatccagtttttccatgggtattaaaagattatacgagtgaaactattgatttaaatgatccgaatgtttatcgagatttaagtaaacctattggagcattaaatgaagatcgattagaacatttaaaggaattaattacagaaatggatgaagaaaacaaattttttatataaagttcattattctaattcatatttttgtatcatattatttaatacgattagaaccatttacaagtattaatattaaaatgcaagataataaatttgataaatcaagtcgaatttttttttttttttttcatttatgggaatctattacatcaccagatgtaacagattatcgagaattaataccagaattttatagtacaccacgatttttaattaattcagataattttgacttaggaatcaaatcagatggaagtaaaattaatgatgttatattaccaccatggagtaaaaatgcgtatgatttcattgagaaacatcgagcagcattagaaagtgattatgtaagtttaaatttacctaaatggattgatttaatatttggatataaacaaaatgggaaagaagcaattttagctaataatacatttcatccttatacatatcctacgaatatgactaaacaagtaatagaagatccagaaaagttaattttatatcaacaatttagtaaaagttttggtactattccaaatcaaatctttaagaatccacatccaatgaaaattaatttttctacgattaattttattttatctttatttacaccgacattacaaattgaaataaaatcgaagccaatatttcttcgaacgacattcaataatattttaattattattacatcattaggtaaattaatattaaagaataataaaaatgaaaatatttttgatattagttattgtttaacaggatttcaaggtatttcagaaaggacaatttcatatcatttaaaaaagaatattttaattatatcaacatgtaatgattgtacatttcatatgtttcaaattgatattaataatttaactattaaattaattaattcacaacgacaatattcattaataaattcattaaaagttacgagtacgaatgattttgttaccgcttcacgaaattattctattattaaatggaattttacacaaccagcgacaatgaaattccaaattagtgcacatccagcgacgattattgattttgatatcggtattgtaagtaatgcattaatttgtggttataaatcacgacaaatttcatcatttaatttcttaaatggttcttatcaatatagttattcattagattataatattttaatgttaaaaattagtgcatcgccttgtatattgatatgttgtgaaattattaaaaataaaatttttaaaaatattttcatatggaatggatttaaataaaattgaagaattggaaattcaaagtccgaaaatacaatggtgcgaaatgattattgcacataaggattacgtgttggcagtgtccgacttaaataacaagttgacattgttaagtttgccgtgtttgaggattttaaggactttcgagttacaggacgcagtcgtaacgatgtacttcgactcaagaacaaatgtttttgtattatgggactgaaaataataaggtgtactcaatagacttccattaaactttaagaataaataatactatgaataataattaattttttgttgttatgaatttttcatcatttttttcacaaaaattatcatcaaattatatgaaaatcatacaatgaaatatgatataaaatattcgatttatcaaatttaatgcattaataataatatatgaaaacaatatgaatttaggatatgtttatttcaatatttaaatatttcctcttttatccttgtgaatcttttaattttattatgtcgtcacatttatgatgttgaattttgtctgcaaataatcgaataatttctgcatttttcttttctgatgctatcataagcgctgttttatatgtttataagtaattccaaatgtttatatgaaatgtcatattttttcaaaatattataaataaaacaaaaaaatatttttagcatcaatatcaatattctcttgttctagaagtaatttaactatttctgtatgaccattcgaagatgctaacataagtgctgtataaaataatttaaataatttccaaatattattttgaaataataaattattaaaataaatataaaataaagcaaataaatatctttatcattaatatcaattccttcttgttcaagaagtaatttaactacttctgtataaccattcgaagatgctaacataagtgctgtttgaaataatttaaacaatttccaaatattattttgaaatataaaattattaaaataaattttaaataaagcaaataaatatttttagcatcaatatcaatattctcttgttctagaagtaatttaactatttctgtatgaccattcgaagatgctaacataagtgctgtataaaataatttaaataatttccaaatattattttgaaataataaattattaaaataaatataaaataaagcaaataaatatctttatcattaatatcaattccttcttgttcaagaagtaatttaactacttctgtataaccattcgaagatgctaacataagtgctgtactaaataatttaaataatttccaaatattattttgaaatataaaattattaaaataaatataaaataaagcaaataaatatctttagcattaatatcaattcctttttgttcaagaagtattttaactatttctgtattactttttgaagatgctaaaataagtgctgtttgaaataatttaaacaatttccgaatattattttgaaatataaaattattaaaataaattttaaataaaacaaataaatatctttagcattaatatcaattccttcttgttcaagaagtaatttaactatttctgtatgaccatttctagatgctaaaataagtgctgtttgaaataatttaaataatttccaaatattattttgaaatattaaattattaaaataaaattcaaacaatttttttcaaacattttgttttatgtcaatatatttatgtttaataaggtaattaaacagttctttattaccagaaaaagttgaaatctctgaaaattttattggttttgattttttatctagaaaatattggaaaataaataaattcccattattgattgatttaataagaataagtttatcagattgcatgccttcttttttctaaaaaatgaaagaatattataattgtcatgcaaaacacatttcttccctaattcttctaatttattaattttttctaatttattttcataaagatatctaaagatatcatttcgatgaagttcaattgctgtttcatatgctttatcaaatgttgaatgactttgttcgcataaatgaatgatttcttcatttccacctgcaactgcatatttacctgcgttttctacttttgaaccattcataagtaaatatttaaaacatttaactgaagaaaaaaatgctgcataatcaattaatgtaacattttctttatttataaatgaacatctttcataaagtgatggtgcaattgtttgattaaaatcaaaatttgtttgtgatgatatttcttgaagtttttctatttcatcattccgaattattttcgcaatttcattcggattatgtccttccttaattaatttcttatgcagttcaatattattctctttaagttcttctgtttgcttgttaatgttttctttttctgcgaaataatgcataaaatatgcattcttcttagtttggataatttttggttcaattatttcgtcttcaatcattttttcgagaagataatttgattcttgactatcagtttataataataattgtgtgaaaatgttgataatcttataacttgattttgcttcaattgtttgtaaatatttgaaacataatttttcatagccacgtgacacaaaatatgaataaataattcgacaaatgatatatagaaaagaatattgaaattctaaagaaatgtaatttaatgaagattcaactaattgatcaatattattttcatttaaatcaaatataattttttctagatcttgtaatatttgaaggtttcctttgtaagttgttgtgtgactttgacttcctcccatacagagaaaaatattaatttacatgtcttagggcaccccaaattaaggttgaatccgttgtaaaatttgtgacaattattgaatggtttataaagaagaaaaatttttaagtttccaaaagatgtaggaaaacaggtgatttttgatcgtagaagacaccacctgtataaatgtagtgaacattggtagtttctgaatcagtggatattcctattccataaagcatcattaatttgggattgagcaaaacgtgaaacaattttttctcttattttatcagagcccaactttgcatataagctaataatatacggtaagtcattgatccagttagaaaatcatgatttttattttagctaataacatgtctgaaactcaaaaaacattttgaaccaaataaaatttcaaatttttttctaaattaaaaaaaaaatggttaaattattgcataatttcatgtttgtaatcctatctgggttttaatctaataagttgagttccaattcaaattttttataagtttacatcaaatttaccttctgaaatgttattcaattgaattatcaacaaattttgactttacaaagatcatttattttttctaaccatggatattcattgcacaaaaagaatggtataaatttattgctcccattgtgctatgttttcacggaggagctccattgcatgaattgcttcttctttagattcgttacttaattgatcaagaccagattctgcatcagaacgagtacttatggctaaattacgagcttccaccggatcacctaaaacttcatacgtgaaaacagaaaaattgaggaacaattcaagtcgcaatgaatgataaactggtaatgaagtttttgtgagctccacaacttggtcatatgtatctttgcattcctctgcaacttcctcttgctcccttcctgtacttccttcccatttatatcttaaaaaatctgcaattatttttccataaaaaatccgaatttcaggctcttttgcatatggaagtaattggcctctgaataaagctacagcttcatcattgaaattaaaaatttggaattaggaaagaaatgtattacatcttttaattataaaatatttttgttccttcaagaaaatggtatgaatattaatgatgatattgttaacgaatcagcaagaattggaaatttatatcttgttaaacattttattcaaaacaatcaggagcacatgacagaggatgacgtgaacgttaaggtagaatataaaaatgttcaaaaatgaaattcaataggtttggaaatcgaacgtatagcatttacaaaaaacgctacgtatgggaatcgaacgcaaggcgtatattgaaaaagtgacgttaaaattaaatataaatttatttcgtaatgtgtttgttatttctatataatttacatatccaatgatttcttgtcgtctgtactatccggaaaactaatttttaaaccttcaaactcttttgatatcgcgatattttcatttccaacatatgcattcaatgatataattttattatcgatttcttcacgtttctcgactaattcatcgatgattcgttatacgatatcattcttggctttcataaattcattatttgattctgcataagcaatatttatgagtttcttttcatttgttttagtaagaatgttatcggtaaactttgaatttactgattcaaaaagttttatattcttatcataaaatttaacgccaacaagaatattattatgaagtataggtttgtttgtcggtttatctatcttaactgttgtattgtgattatatttaaactcaacggcggcgtaatcaattatatattctgatatcaaataatcttggaataattttagctattaaaggtaaaaaatttatttttataaataaaaaaaataatgcggaaaaataaatcgaagaatatagataaaaaatttgatgagattaaagaatcgttcgataaattagaaaaacaaaacaaagaaatattagaaaacgcgaaaataaaaccaatacataaaaaattcttatttgctcagaacggaataacagcatttatagcgccaatatgttatggtaaatcatatctttacgttaaactcagcgcgaaacaagaagtactatttaacgaatcgttttttgaactaataactatttgttgtacatcatcaaaatttgattaaacagtaaatacatataaaaaagcaataaagaaaacgaaacttgttgcgataaaagatactgatttgttagactggattaataaatatattcggagaattttaaaatataattctatcatcaaatatatcaatttagattttaagaaaacggatgaagaagtagaaagattatttatgacaatataatttgaataactcgaaaaagaaatgaaaatacatttctgaatagttagcgaaatatcaatggaaaacttattcgcatagatgcttgttgatattagacgattttgctaatcatcctttactgagaagtaaaaagacggagatgtcaagattattgaaaaagctcagacattttaatattaacgttatcatttgtgtgcaaacaacaaaatatataccaaaagatataaaaaaaactttgtcgggtcgtgtgctaactgtacctcttttgtacccactttttgttggttattcccacaattctccactttttgaatgcgatgtgatgacaaccgccgaaaaaacaaattttttaaaattccaaaaaacccaaaaattaaagattaaaaatttataattttcataccaaactttaataaattatgcaaggaaagacataaatgcactattaatttcatacaattcctgattttgacgaaattattgagcattaaaaattttatttctatttttgaaatttacacatatggttaaattcaccatacgcacttttatatgcgcttttattaattttattaaattaaattttattattactatgtataattgatcttttcagcaagagaaattgaattattaatatgaaaatttaaacgtataaaaactttattaagtgcatacatttccattaattcttttcattgagaagtttctttacttctcttttatgcattcttaagaccgccattacgtgttcgtcttttttatattttttgcgatattcatcgataactttactaatgacttccaattcttcttttgatttcttttgcagcagaagtttcctatcacagttcagtagtccttctctaaatggatcttttgacggccttatttctctccacttcttaaacgtgtttgaattttcccattttacgaagtcatctgcgcacggcaaattaaacttcttataatagtcaagcgacttttggagcttttgcttgtcgagttcttgttttgtgtcttcgaaatatggatcttttgctaataccatatgatcgagctcataattcgtcattgttattatttgtttcgtcttcttttggagctcttcacgaatttcactgcttcgcggatgtctttttggaacttgaattacattcttaaaaaatgatgtcgcttcgcctaaataaacacaactagtggccgcaatcttaatgttactgtcgccgttaattatggagacaaatcgtggatctgtttctgttagccaaacgcatacttcatcacaaaattgaagtggtgaaagaagagataatgcactaaaaacagcatcgttagcactagtgatgtcttcagcaatgaaaagaattggagtgttggtaaataatgataaccaaatttcattacattgttcatctgtaaaataatcagtgggatcatagtctttgtaagtaaaggaatctggagtaatatttgtctcataatcccaaaatggaaaatgaacagtaatggaagaattaatattatctggaattgatttaattatggtggcaagatatgataaacgtgaaaggggctctagaggggtatcatctttttgaaactcattataaacataatttaatattgttgtgaaaaaaaaagcaaatggataaggtgataaaagaacaagcgaatagcctgttccatcatgcgtaaaaaagagtgaatagcaatacatggagggtatattgaaagaatatacttgcccatcttttaattctgtcaaaggatttgctgaggacacaaacatttgttcttcttcttccacaaaattaaaagggcgcggccatgaacttagaataataggtagatccccgactgtaaatttaacaagaagcaaagaatccacaactttcatttcctaaacgataacacttttttgttaaaccacaaaagaaagaacgatgggaaaataatgactttttcatgtgattttgatccaagactcacataatttttgacatcgtttctatcgtggaagtttgtgcttgaactgtgttcaattcggtactttatattttttgcacagaaaaattcaattgggtttaaaaagcgctttttatttggcttccttcacttcaccagaatctcgattattcaaaaataaatcaagatcagttttcatataaaaaatattttttaaaaattattttatttttctaaatattatataatatattcttattcaaaaataaataaagatcggcgccacttcatatcaaaagttgcatttgcaaatgtttttacatttattttcactttttcacaaaaattttaataaaaatgatacaagataatagtttaaaaaataaacatatctaacatacgatattactatataggattttcattgattctttgaacgacgccgagaagcaagtttatcttgccactgtcacttctaagtaaaaactggagaataatataaagccttgaaatcctaacaaaagcttaatcaaaccacctgccaaaaatgaatgtgtcagaaacaaacaaccgctcaataaaaatatttttatttaacagaactaattaattaatctgcatatatttccgcatacttaatagaaacattatatgggagatttttaataagtgattattcatatctctttacctgaccacgatttaataattatatatctatcattaaattcaaatattatattcaaattaatgaaatatgaaataataataatatttctttttgttttatctttgttgtatttttgttgtgatagaaaaaagccggtaacatcacaaaaagtttcatccataacgtactgcattaaaaaagctcatacaaaaccaaagcgttatataaaaagtgttggaatacgttaacatcataattacatgcaaaatgataaaaaggggtactatgcatactttgatcaaaaaaagcaaaggtactattaccttgatgcagccctcggaacaacaacatggaaatatccagaaaatgcaattgttctagatcctcacacccgtaaaccatttccaaatccaaatgaagtgtcaaattctaaatcacctgttgggtctgctacagaaccaagtccttttgaatcactatctccgcaagcaaatcccataatacaaactaatcttccacctcaaccatcacagccatcacaaccccagcctccatctcaatccgttaagcgaccacatccacaattacattatattccaccatcacagcgaaataatcctcgatttcaacaattatttcaacaatctaccaataactcagctccatctcgtgaccaacaaccagtatccaatgagccaactccatcactttcacaatcactttcaccccaatccatttcaccaatcccattacaaaatcaaccaccaacattatcctcatcaactaacattagtcaacaaccacactcaacaacagttactccttcgttaaaacctcaaagtttttcatcttcatcaccaccaccgaatgcaaatcattcacagtcactttattcttcatccaatcaaagtcaacaacccaaagttttaacatcgaatacctcaacaaaaccatcgcaaaaccaaagcgaaactaattcgataccacaaaaacaaacggaaacagaactaatgcaaacagccgacaacgccaatgctaatgctgttcctcctccgcctcctccgccaccaatttctgatcaagagtacaaaaacgtcgtcatcgaagtcgatcccaagatcaaaaactttgttcctcctgaacaatgcgccgcgccaaagccaccgaagcctcccgagaagactggcaagcgcaaagagcgccttcctccggtgtcatttacagatgaaatccacaaatttgttttccgcgattttgctcagcagcatttccagaagcaaaaagagcgtcgagttttccgtcgtactaaggtttcattagacaatttgatcacattccaaacgaagccattaacagctcctcttttgcaatcattacctgaaatgtataaacgcgatgcgattcgatgctttaacttaatactaagttacacaggcgcaaatggtaaaagtaatttatcagcagcatgtgaattagtatcgatattatactcgaaggcgccattgattgatgaagtatacttccaaataatgaagcaaacgcaaggaaacacgagccaagactgtttaattgcgacatataatttgtttcttatcattgctacgatatttccatcgacattaaatagtgagacatggattaaatcgtttttgtcgcaacgaatgaattatcccgacccgaaaatctccgccactgtaaagtttacgtacattcgattcacagagcgttgtagcattgggaaacaactcgacggaatgttacttcaaaacattacagagattcctttacatgtatacacgtcacgtaaagtattcggcgtgtcattatatgaaatcatgtggaaccaacgtaagatcgatccgaattgtccaatcccattagtgctatacgaaatgatcaagaagttactcgaattaaactgcgaaagtcatgtcggaatattccgtatcacaggaagtgggaaagaagtcgaccaaatgatttgcagagcaaacgaaggcgtcgaatcattccttaatgataaagtcgatgacatcgcgtcattacttaagagttgggtccgagacttagctgaacctttaataccatatacattagtatcgaaactaatgaagctgaaagataaggaatatatttcgtttgtgaaaacactcccaaaattacatgtcgtcactttgggatatttggttggtttcttacaacaaatggcaaaaaatgaaaaagtcacaaaaatggataagaaaaatttggcaattgttttcggaccaaatattgtacagtcaaaagaaattttgatttatggaaaacaaatagcagatttgggtataaactttattgcttatctaatagataaatgggacgtgtcacagtattacccattggatttggaaaatttcgtcaattcggaggatgaagaagtttggtagcgtttgtatggaataaataaatttttcataaataatttgttgtttgaataagatgaaaaatgtataattttgatgattcatttcatgttactataaattatgtgaatgaaatttacataaaagtaaaactttcggaatcatataagtgtttattttattatgaaattgtacagttaattttaaatatttatattgcaaaaatcagagtaatttgtttcaaggaaattttgtaaattgtgcatttcattccaatgtaatttaatttcatttaagttgaaaaaagcaaaacattaatttttgttacttacatttctatttgttaaatgtataattaaaataaaagaaacagaaagcaaaaacgaacatattatacagaatcatcttgggaaaggttttatatataacttaacatttttttccaatgagtttattggaactttaatctctaaattaaataacattactaaaatcataaaaataactatgattttaatgtttattttcgttaatgttaatcattttgaaaaagaaacggatagaaataaaaacaaaaacccaaaacaatgttttaattcaaatattaacaataacaatttttcattagtaacaaaaaataaaattaaaaagttttcataaatgaattttttcgttattcaaacataagaaggaataattaaaataaaataaaatcgaacatgagtgatattatacttccaacaggtaaagagaaaattgatcgaagaaattggggtcaatatcgaaatccaggtgatatttataatatgaattttcatgatatttttggtagtataatatttcttatattttttatattattaatattattattaatatttggaattttaaaagggaaacctttgttattatttcaatcatgggatgaaaatgggaattattgtgggattgataatcataaattaattaataaaattcataattataattcaacgagatttcaactttataattttcttgaatatccttatttattatttagtttaccacgaaataatgggaaagaatatgaaagaatcggtgaacatcaatattgtgttaaaaaaatgtccaacattaaatacttttgaagaagcgatcacagattcatgtaaagattcgattcgaatttgtccttcatattttaatcaagaacaacgtattcaagaacgtaagaaaggaggtaaatgtatttgcccttatcctacacaacaaatattaaatcgttgtattccaattcttaatgaaagtattaaaaatcattttataaattttattccaggtttaaatcaaaatataatttcatttattaaattatggttaccaattttattatcttcatttttatcaattattatatcattcttatttatatatttattaaaatattttacaaatttctttatttattttatatgttttatgtttcctttaatatttatatgttttggaatattattttatatttataatgataataatgataataatgataataataataataaatattattataaatatattccttatatattttggtgtattggaattattatattattaattatagtatttttaatagataaacttaataaaactattaaaattattgaaatttcatcacgtgcaactatttcaaatataatttcattttttataccttttatttcattaatattaatattaattttttatttaataattattttatcttcaatttttaattatacatcaaatgattttattattaaatataaaaataataaattatatttaagttatttatttaatgatattattaaatatatattaatatataatttctgttattttatatttatcacgattcatttatattttattaatttttattcaatctcttcatctattgtttattggtattttaatcaaaatatttcaaatatatgtaattttaaatgtttttatggattttatttatcttttactaaatcacttggaactattacatattcaactataattattattcctttttatttattaattataatattaaattttattgaacaaagaattaaaaagaattcattaaatattagtaaatttattataattttaatgaaatgtttaacatgttgtctttatatttttgaaaaatttcttcgttatattaatcgaatcctttttacaatatcacaaatttataatagttcatggtataaaagtattaaaatttcatcaaaaatattatttaatgatattttattaacaatatctttaaatgggattacaaattttatcatattttctttaaaaattgttacatcaggaattaatacatttttcttctttttatatattaaatttataataaaagattttattcatgattggattttatcattatttatcatatttatattaagttatttattttgttcatttgtatttggaatgttaaataatataattgatattatatttgtttgttatcaaagtgatattcatttaactaagaaaggaattaaaagagaaatgtatatcaatattgaatcaaaacaattgatagaaagtttaaaacaagttgaaatgaataaaaataaagaagaacactcagaataatattaataaaaacatgataatctttattttatttaattttttatatgtggtaacactcacaagaaatgaaaatattttgttaaaaaaaaaaatagttttcgaataatatgtgatttgtttataacttcttttgaaaacttttactttagatataatatattagttgcaatatgtgaatcattttattcactttcattttacattttccctaatattccttttaataattccttgttatgaaaaaaaaaaaaaaaaaaaaaaatactttttcaaagtttattttttaaataaaataatatccgcatttgtttttctttaattttatgtttcagatttattttcatttttgatatgttttcgttttgttcttattcgtttccgaattttaattggacgtttttcattttcttttgtttcaatttcagttttaatgttttgaaatatttcttttagttcttctttcttttcattgtaattaattttcgatattttgatttgtgttttaagattttcaagttcattaaatgttttcatcttttcattgttaatttgtgattcaatgttagctaattgtttcataacagtacttaaatttttagacgtttccaaaagttctttggaaattatcgaatgttcactttctttcgtttcaaattcattttcaatttgatccgtttttgaattcgcttcttcattaaacgcaaaacatttgttattcaaatcttcttgtttcatctcaagttcttttaaatgttgaaatttgttttcttgaacattttcattttggtttttcttcgtttcaagttcttcttgcagaatttcgatgttttttcgttcttctttaatatatttattaatttcagttaattttttttctttcttttcaatgttttcaatttcttgaatttgtttcttcttttcatttgtgttatatttttgcaaattatatgaaattcgtttttgaatttcttttacacatttataattaatgttattaaagtcaaataaacatgaaataaaattagaattatcacaaagcgctttttcgatcatcattccattttgaattagattgtttttaacagatattttttggaattgttttgacttcccaatcgcttcaaacaattctttcgcacctttatcaccaaattcacaaagttcaacatcaatatatttaagattcggatgttgaacaatcgatttcgcaatttcaattataccctcatcatgcaaaggattattagctaaaagtaatgatttcaatgttttattagggaaaaattctcttaagaaatcatttattccattcgtatcaattaaacaactacaaacgtttaatgtttcgattgtgttattataacttaaagcagatccaatagcagagattcctcttccatataaagcgttacgtgatatattgaaattacgtatggatttattggatgcaagttgtggaacaagcgatgtagtaaatcgttgcgttatttcattgttcgatatattaagttcttcgattatattattattagtcaaaaaaattaataaaatatggagatgtgtcatcacgaaaatgattattagaaagatcaagactgacaatgcctgtgccgataagactggaaagaataaaatttacgcctttggatgtaagattattgttggaaagatttagaaatcgaagagttttgttgtgcgaaagtccatgactgagaattgaggcatgatcagatgtaagatctgtcatagaaagattcacttcagagagaactgtgttgtgaaaaagcatagaacttaatgaattagatgcttcaacacctatcgaatttcgtgtagatgtattcgtgctactaatgtcaagatgaataagagtcttattatcaattagagatttaaatatatgtgacattccagaatctctgattttattcgatgaaatgtctaatgatataattgaatgattttgttgaagaatttttgatatttcaattgcgccttcatctccaagtgaattattggggagaacaataactttgaagtttgaatgtgttaaaattatctttgatattactttaatagtttgaggaccaatacctaatccgtcaaattgaaatgttttatgttttgtttcttttttatgatgattctgatatcgaataaaacttttttttgagaattcgcaattagaatcttgtgactttgcaataaaaatctgtttgagttcttgtttagaaattggggcatcaattaaattttcatcaggtttttccattgagtaaaaacccaaaacccagaaaagatattttaaacgttctttttatccaaaaacaaaaaattccaatcaacacactaaaacccataaaaaaaaaaagcattatacgcatttcaatagtttcctgaataaaacaaatgtttatccataaagaatcaatatattaacttatacctaataatgaacaaaacgattaatcataatttatcctaaaaataaaagaaaatcgaaaaacaaaaaagagcaaaagtcttcactttaacaaaaatattaaatttaagaatttcaagataagatatttaacagcaacgtttttccgttggttcatttgtcataaggatcgagctaaattgaattgtttggtttccaatgcacattttaaccaattcattgaatgcttcattaatatttcttccatctaatgccgatgcaagaaaatgcttttcgatatgatgtgtttcagcaaatgactgtgcatcttgataagtacttttttcatatggtaagtcagctttgttaccaattaataaaatagggatgttatcgtaatttggcaatgatacaagagaagtaaactcttcgtaccaataagaaagtggttcaacactttgtgggttagaaacatcgtaaaccagaatacaaccatcagttccacggtaataatttggtgcaacagcacgatgtctttcagagccagatgtatcccaaacattaactgtgcatttaacaccatccaattcgatggttttggaaagaaaactgaatccaattgttgcttgataagatttgtcgaaagttccattgacaaaacgttctatcatacttgttttaccaacaaagtgttcaccaataagagttagttttagtgaaatttctttcaattcgcctttttccaccattgagaacctgtgcggttacttgcgaatgtaaagttttcttttttctatagaaaatttcgtcctgttttttgggcaaatggaataaaacaagttcaaagggcacatgaatatattttaattctttgaaaacaaaacaattcattaaacatttaataatgataatacagaaattaaatgattactaaatttacaattgatctgatactaaaaaaaaaaaaaaataataataatattgaaggcccactaaagtttatttcgcttgtgtgtatgtttagtcatatttcttaaaaccaagaagacccgcacgttcacggaagcatcggcggcacatgttaattccatagctacgaataacaccacgacggcgttggcagcagcggcatccacgatcgaaagaaccttttgcgtgttcacggttgtgttttggtacaaagtttgctggcattagcaaaaaggaagaccataaccgaaaaaccgttatttattgaatagtttattcacatcgcacagaagacttccaaaaaatgatgataccattctccgaggcttcacatagaaatgaactgttaaatgttaattaacatcacatttaataaaaaattggtattaaatttagcaaatgcatttgttttgaatttgagaatttttagtccatatatgaaatgtgatatgaaattcaataagctgatgaatgatgaagaagaaatgaataacatctttttcagaaacgatcagtttctaaaagaacaaaaccttactgtagcaaatgttcttcagtatttttcaactagtgatttttatgatacaacatcaattaatgaagttttaaaaatgcaaaatagatcaatggatcaacttgacaaaacagatggaatttcatttagacttagctatgttgagcaaccacgagggctaagtcttcagaaggaaaacctaagtgatccgaattattcagcaattattatttgtccaggtcttgcaataattgacaaaatacaaagggaaggtggagaggattcattgcttgccaagtactatattgttgatggttcaatttatcaagctcctgacatatatacaattctctctgttcgaattcgttctgctatgttccacttacaagaagcagtacacgaagtaagagaaatgtttaaatggaacccagaaacaggtttccgcaaaaagttagcagcagatgaaacagaaatcctttacacattccacacatccgagttagacgaactcaagcaagagcttccggatgacttcaagctccaaaacagtctattagattctttgttagcggaaattggaatttcataattaaaataaaaattgatttaataactatgcgtttctatttcataagcaatcattttccccctttggacctttatatgttattataaaacaatttgattttatcaaattgattattattgataacaaattttttattaatgagagtgtgttataattcatttaaatcatttaatgcattctcttcgataggccagtaagtttaaatcccatatttactttgatgtaatatctttattatgaattaaaataattggaaaaaatgtatttcagataattaaaaattaagtaatttataatatatgtttaatatatcaatatcagcagaaatatttaaattttatattatgataaattacatctatttgttatttattaaaacaagtattaaataaaatgttcttttttaacataaagaatgcattttaattacactgaattgcttgaaacaagtaatctttcttttaatttttctccataactttttcataggaaaataatcgtcttggtcaccagaaaattttttcaaattcatgagttttcgaaatctcccaaaaaataaaatacctttgatgcgtggtcttgaaagtgatgatgatacatcttcatcatatgaatatagcgaagaacctaaaaatgaattttatgaaacaagtagttcatcaatgtcgacatttttaccgctgagaaatcccgtcttcccgtcagcacaaccagaaatttcagatgttaattcagcgttttcacagagagcacttgaacttcttcaaacaaaccaaaagtatccaaatccaacaaaaagattacttgcaatatggggaaaattgtactcttgaaaattaggtatctgttcatattacgttctttgtatttaccttaattgatcattgttgatcaattaattcatatgtaaatataaatattatataatctttataccacttgaatagcactgacttttaaattgaatgtttttaaccaaactttaaaaaattaataaaatttgcaaaattatatactttattttttcattatttttaaacttcatcaaattatttgtatcttctttacaatattattgtggtttgtttttatctaaaatggggaagtgtgtcataacaaaaatacgttagcatttgacgttaaggttcttgtaaaaatgaatgaatgcttctcctatgcgttatacaggtaattgctcatccatggaaggtgaaaattccgatgatagtctaaattctattcaaaaccaaattctaagtcaatcgatccacatcgaatcatttattaataattatgaaaatccagatgaaaataatttatgttttgttcttctcaaaaaattattttcatactttaaaacagaactatctatcaatttaaaacttcgaaaaactcttattaatgaaaagaataattccaaaaaaacttcccaaataatccaagaaataaataaaatgggattcccaggggtatcaaaaattgaagatgtgcctacaataataacttatcaaatccagaaattccaaaaacatggaaagaaatattctagagagattcatcatcttgaagcagaaaataaaatattatcacaagaagttaattcattaaaagaagaacattcgcatcaaatagttgatttagaatctcgaaacaaaaagcttcaagatcaaatcaatcaactcaaatatgaatcacaagaccattcacttaaagaaatgaaatctctgaaagatcaattgtcaatgattaaaaaagaaaaagactctattgaagaacatcttaaatcacaaatcgaaagatttaataaagctgaagagcaaataaaaaatgttacaataaatcataaaaatgaaattgatgctttgaatatggaaaataaagaaagatttctttctcttcaacattcaagtcaacaacgcattgaagaacttcaacaacaaattcaaacattacaaaatgacaatgccaacgaaatcacacaattattaaatcaaatatcttcaatgaaaaagtcaattgacaattcagaagaaatttcaacaatgaaaacacaaataaataaattacaagaagaaaataatttattgaaacaaaaaagaaagatctataaagcaaaatatcacaaactagcaaaacaaattgttattctgaaaaaagaatttgaaaaaatttcttcattacacagaaacgaaaccgagaaaattcaaaaagaatatcaacaaaaagaaaaacaaattcgttcaagttatgaaatagaagcgcaaaagtcaattattactgagaaagaacttagatataaaattgaagaacaacaaattgaaaacaaaagattacgtgatcaattacgccaatatagttatttacttgaaagaaaagaagaagaaaatgtaattattcgatcaaaactggaaaaacttgaaagctataaaacataaattttttctttgaattttttcaaatgagtatgccataattgtcatatagttaacttatgtaattaatcataattccatttagcaaatttataaatcttttcatttttaattgaattgcaattacaaaatgattaatcattttaatgattacaaaagtaatttacttaaattaaatatgaaataatataaatatttaaatatttattcaatgaaataataatacaattttgagtattttattgaaatttaggaacaatcacatcataaaaagccgtcactatcatcaaaatcatgttgaaatccataattttgattatctaatgtttcagttgctgtgaaaagcggattttcttgcgtcatttctccgatattaattactgagctttgtgcatcgattgttgatttataatttgaatatttttcgaaatcttttgaaaatacttcacctgaatcacttaaataatgttttctaatataaacaaatataataatgcctgctgtaataacatttgtagctattacaattccaattgctatcgatttaaccatagattgtttttcatatagagtcagagaacatttttcacaatttcttaattcattttttcctaaatattttgctattgcattttgttctaaatttaattttctatttccataaagacaattaccttcatcaaaagtaataacagctgttgaattgacatttatatgataattaccatgactttggtaaaaattaaaacaacatccataaaaatatatatctgctccaaacaaataatgaaatgctatagtatcactatgaatatctctatttactaataaaaatgatgaatctctaaaatatgccttttttgctatgtatataattattggagtatcttcaaacattgtatctctaatatcaatatttttaaatttaaactcaatagcttcacgttttaatgaattacatcctaaaaatgaagaatccctaacataaaaattggaattcggaataatttgtgaggttacagatcctaaaaatgttaaatgccgagaaattgttgaattctttacccagaaatcaattttattttgaggagtaagcatttttaatttagaaattatatttaagtcacatttaaaagtcgaatcagtaatcaaatattctataatatctgatataactataaatgtataatttcctccaataataatatttttctcacttactaacttattacactcaacttcgaacttgttttcttccgaatttaaattcatatctttaagaattaatgaatttgttgttatttgacttaaatttaatgattcgatttgattatttttgaaatttatttcttctgaattaatggaatttaatcttaaaaatgcatttggaaacatattttcatgaatctgtatgattaatttagatgatttaattccttttaatttcccagtacaaagattactaagcgaacatttttgtattaaaattttttgtgtttcacattcttgattcccttttccaataatatcgaaattgaataaaattgtttctattaaagaaaattcttttacagaatatatatcaaatattgattgtccatttaatacacatttaataaaactaatttcagagatttgagcatattgatcataactaaatattctttgagaattatctttaaaaatgcaatttttaagatttaagttaaaattagcaatctttttcttatcggaaagataaataaatgaatttccaggtctacaatcatcaaaattaaaatcactaaagattaatttatttgaaacactttcaagataaaaaatataattcatttgatattgtatatctttaaataagaatttagaaatttctaagtttatatcattaaccattctaattaaacaactttcttcttgttcacaagatgcaggattttcaaaatttaaattattcaatgagttctttatatcatctttaataactgttccatcaatatatatttcagatccagttaaagaataactcccttcaaatttgcaatcatttataacaccacaaaaattagataaatatagtgagcctccttttttttgtgctctattacttgagaaaacattacccgttattattgtctttgagttttctgaataaatagctccacctgattcagatattatattttttatgaatttggaatttttaatttctgctgttgactctttaagaagaatacaattttctcctgagttggaactaaattcacatccatcaattgaaagatcattgttattaatagtaatgattgtagttctaaacttttggaatatgcaatttgtaatttgtaaatttccttgcccttgattaaatgtacctataaaagtttgtcctgaaaatgattcttcataagattgaattatatataaaagaaacaaattaaacatttgggaaatctaacaattgttgagtttgtgaatttttctgtaataaaaggacaatttttttattgaattatgttttgaaaaccagtaaaaattatataatattaatatatatattcacattatgaataataatcatatttaacatattaaaaattcgaattttaaattaggatatttatttaatatatttttgattgatttttagcagattatcatttcttaaaaatgagtaatatttttcacatataaaagcataaaaaacataataataatcgctattactgcaaaacaaatagaaatgattttattttattttttatttttttggaaatctcttggaatattattttatataaaaccattaatagtcaaataatcatttcattttataaaatatataattatgctgaatatgtgtgataaaatcaaaataaagaagttatgtgtgctaaatttttttcattttctcctattttgtatgatgccctatcgtaatacttaaaaatcatgtaaactatttaatacataacttttttaagataacgataaaataacatgcccttgtttgaccttgagaaaacttatcatatttgtatgataaaatataaatttatttcacatatgtatgtcatcacatgcatcattattttaagcaaaactcaaagaaaaaaaaaaaaaatgggaatttgataaatatgatttttaaagttcgaatggtttaccaggttcagaagaaattgcatctctctgatctataagagattgaattgggttaattcttgagctttcaacaaattcacctgccaatataatttcatcaagaagcatatatgcataatggaagccaaaaatgatatctacttcacgaacatttccgaagaaggagtcaagggtttcgacatagaagtggataatgtcaagaatcattgattcattatcatttacatcgacgcacataacgaagaataaacttgcgtatctattatatacaagcttacgatctctccattcgataaaagtacagaaatttgttggacgagataaaattgaatttgtaacttcgcgtgtaatcttatctttatccttctttgtttgtggttcgtaccactttgttagacgtgtttttccttgcctgttgaagatgagaaagaagtggatcattaaaacaataaaacaaagactttgttcgaatatgacggtttgattcaatttatagggcactccattctcgttataaccgtttttctcatcacctgccgaaatgtacccaaaagtcgatgctgcacatgatttacttagacatgtaccacctaaagatatccagcagagattgatcaatataatttcgttggataatgatttagcaaatgatcttttgtcaacagttgatactccattttctgtagcttatgataatatttcatataagcaatttattaaatgtgattacaatcgagattgtgattcatatcggtcacctcactcaaatgtttatttccctcctcttgacgaaggaatcttaccttcagatcgacttcgcgagatggaaatcaaggcaaacaaagtttttcaaaactacaggcaaaggtattaccataactctggaatatgttctgtatattgttgggatcttgatcctgacaatgaagaatcatttggaattggagtttttattcacaggtcgatggattctgaattaagtgattatacgcatattgctggtacaattgatagtagtgatgtattaagtgtaactccaaatattgatgggacatttcgatacgaagctgtttcttcttctcttgtgacgctaactgttgatactgatatggaacctttaacgctttcaggatctgttgctgatcaatttgaagaaaatcgaagagccacaacagacattgatcatcttgttaacgttggagaaatgatagaagcaaaggctgctaacttctatgaaaagattaagcaaatctacatcaccaaaatgaaggaaattctcggatacacaaaaacatcaagaaactccgtatcggcccattcaattcaaagtttgcaagcgaacgcaatcaatcaaatgttcggaaggaaataaaatacttttgtaagtttgttttgggaataataaaaaacttattgagataataactaaaaacgcagaactacttggaaaaaattattcaatgaagaaaaaattattcaatgaacatccttgtgcctgaagatatttgttgccaaaaatacagaagacttaattttcacatttacacgaaattggaagttgttaaaaattaaaatcccttaaatgatagtttcttcaaaaatgcattatatgagtgaaatacatatatataatttaaaatttgttcattaaacttagtatatatactttttttatgggttgtattaaagattctatgaatgacattcttatcaaagtagacagtttttcacatctcctttagttacaatactatttaatttttgagaaacaataagcacttattaggaaataatacagaaacagtaaaaatgtttttttaaagtaaagaatacttgaaaaagaggatagaaaatataattatagaaacaatttacaaacattttattaatctgtgaacgcttttttgaaatattttttcatttcatttatttccagttttgagtttgaccttaatttcagcaccagatccatattttcctcaatatattcgaacaccgccaaaacgtaaacatcgaaatcgcttgaaaactccactttcaacgcgtacgccacaacgtttttctctttaagtatcaacgaaggcgacacattaagtagatttccgacaattctaattatttccggtataacttcatcgtcaggaacaaccaaatggtccacaacttcttcgtataatttattccatttttcgccgaaatcttttttattaaaatcgattttttgaaaccattttagaagcgaaattggaatttttgctttaattatattattttgatcacatttgatatgtaaaattggatattcaacaaaaacatttaatgcaatgaattcgatttgtataatttttgttgaatcttcttcaagtttcataggtaattcaacatcaacaatttcatatttaaggttttcatttgtatcaattttaatttctgttatttcgatctcatcaaaagattcgaactttaatgtaacaaatgcttttggtgacgaaatgataacatttgaagttatctttagttgctctgaataaaatataatatcagaatcacgttcgacgtcttcttcttcttcttcaatttcattttgcgtaataaattcaaagttattcgatattaatagtttcgacgaatttaatattttggtttggaatgtttcgggatattttaacaaaatcgaatattctttacatcgttgactgatatcgaatgaatcagaatttaaatattgttgaaaaaacgaaatcgtttcttcttgaaattcgggcttatttaatgctattttaaacaaagatgttataataattcctttcgattgttccgaaaaattgtcaaacgaatctttaatttttgttgtgatgacttgaatgtcattattattaatctgatgacaatattctccatataaatatgataataaacgaaataaaaattcattaaaatttgtttgattactttctaaaattaaattcgttaatttgaatatcagataattcaatactttacactgagctataaattgatttataatttttaatatttcgttgaaatatgattcttcacaataatcaataattgaaattaatttgtcaatggcccaaatctcatcaaatgcataagacaaaattaaatatgatgattttatacataatgattcatgtaaataatttgacgaatttggaagatatgataaaaactcggatacaatatcaagaccaatttctttaaatgcgcatgtatataataaatttatggataaaatatcaagttcatgatcaccacatttgatcatttgatataagtttgaaagatatggttggactaaacatgaataatgtggattaatttcaatcaaaaaatcgagcttttgaagagaataaacttgaagaaaatggaaattggagtttatgttttgaaataaaatttcaatgatttgttgagtaattgaatcagaaatttcaatactaaccgatatttcaacaacctctgaaaaaattgtgtaaaaagtgacgagtgaatcctcgcttccaagaaatgatgagttcttctcgatgattttgatgatgatatcttcaagcgtaatcaaatcagctggattccaatcggtttggaaagataaaattcgaaaaagtttggatgctaataatggaaatggaagattaaaaaaagtatactcggctgaataatcatttttggtaaaaaaagattgaaggacttcaagtgcaagagagaatatttcggattcaagaagatttggttgaatttgtaaaatggaataaattaaatgagaaccacataaacgaatgccataattggagtctttaagaagggaaggaattttggcagaaatacgatcgacagaagaaagttgcattgtactttgatataaattcgttaatgtaagtaatgctttttttcgagcatgttctgagtatttttgatcaaaagcaatctctgcaataattggacctacagattctgcaagttcagcaccgcctattgatgatatcgcagataatgtaaagcatactgcaaactcatcttttttattatttaattggcgcttaatttctggaattattgagtttaagtgttctgaattagagccacaaaaaattgcagctgccatccatccaattctttggaaacttgttttcttggaaataattaattcgatgacttgttgaagaccaaagttaacttctatgccattaagaataataaaacataattttgcaatatatttttttcgatcatacgaagataattttggtgatataaatgccttcttgattttaaataattctaaatttattctgtcgtgtgcttgtgcttcagaggtgctggtagctacctccgttaagaaattatgaagtcctcgtatattcatttccaaatcgatttagaaatttagggcaccccaaacggaatacacttgttggcaaaaaccctcttttgtctatgttgagaagtatctaccttttatgagaacagaattgaggtatataaatgaagaacattattatatgagtgcctaaacaataaggattgatatcaattatttgaatttgcaagaaaaaaaagatttcgattaaatttggtaaaaaaattcgacacttaaaaataaatatgtacattttacagtacatgaaaaacttatttggtttttgcacaataatgtataattttactctgtaattaattatctaataacaacatttcacttgaaaaacgaaccgaaataagaacttcattctttttatcccgtgatttgtactaagattgctatgcttttctaatccggttttatttttcttgttgaaattgttatgaacgtttaaaattactaaaatgagaacaggaatcaatcccaataaacttagaaaagaaagacttttaaaaacaggcatgccaaactctgatgattcatgtgatgaacaacctaattctacacttgatattcaagaactttttagaaattttttcaatttttatcaacaaaaagatatatgttcaatgtcaaaaatcgtttcagcacttcgaaagctcgcacagagagagccatttcatatatttccagaatttatgcagtacaatttatccaaaatactatgtttatcattaactattccaaatacaacccttcacgttaagcttttgcagctattttgttttgttttccgttatcacaaaccacaattattagtccccttattaaaagatggatttttagtctctttaatgggttcaatagattttgatgatgaacaaacagttttcttatctctccgcataataatacttctcacaatccattctaaagaagtatgtaggcaattacttcaaccaaattgcatggaaatcttctttcaaatcacacaagaagacacatatgcagattctattagatctgaagccactaagattttggtcagtttgtctgaaacagatcttactgaagaagatataaaaaatcttttgatttactccagacagatactttccgataaacttctgatttttctatgggccgatagtattgaaattctttacaacataatttgtgatttgaacacttcatactttgttatgattacacaagagtttgcagaaatacttaattgtcttcttcatgggcccgatctgaaaattgtagggaatgcattatcttgttttaattcattttttgaattttgttctcatcggattgaaattgattatggaattatagtttcattatgtttatgtgaagataaagaaatatcacaaactgcattacaaacatgtgataatatcatcaaagataaaatgattgatgaattattagaatttaatttctttggagtaattaaagaaattagtgaaagtggttcatttcaaaacaaatctttggctgtaaagataatgtcagacataatcagaaattgttcaatggaaataataattggaacaattgattataattttattgaatctctcgttgcaatgtttgagcttgatgatttcaagctttttaatcatgcaatcggtgtaataacaaaacttttaagaagaacaatcgaatatgacccaagagatatcttttggtgtcagttcgaaagcagcggtggtgttgaaatcttggaaaatttgtcatatgacaaagcgcatttgtttttagacacaatttataagtttaggccataggtattatgtaaatatttatataaatcaatttgtttatactgatattttcaaaaatccgtggacggccgatagaaaattatattgacgataattgattttcagaacaatatcaagcagtactgctttgaattttgaaaataatgttcccaacgatagaatggaatgaatgaaaaatcatcggatttatattcaaaaactgaagtgtttgggaaacctttctgcaaccactttatcagtaaagttaaagtaattttgtgatttataacattaaaaatcgttaagcttaacaataataaatatcttttttgcaagtgaatacactttaaacaactttcgatagttattacagagtggttccgactcctaggagatgtaccttcagaaaatttgtaattactttttcaagtatatacacttaaaatattaaaaaatttttatagtaaaaattattcgtctagattcggattattcgagtatattacttatatttatataaattaaatatttcgaaatttgatcgaaaaattattttataattttttgatgattcatacatattaatatgcacaataatattgctaagtatgctattaggttttttctaaaataaatattattgattttgagaaaaagtacatttattatataaatttacatgacgaaagatcatcaagactctaaaaactcactgtttttattctgttaaaaattctatataagaatttacattaactatattttattagtttgaaatatttatggatttctcctcctgaatttcgagaaaaagtagtattttgcacgacggtttaaaaaccgtaatttatcattcaaatattttatggttataaactttttgtatggaaaataatcgttgataaaagaaaacatgttttatatgcattttctaacaactatttctcaaaactcagcagaagaattctaataaaactttgatatgatttcaatcaaatcataattataatcatatttgaaaatgaaggggaaaaaagggtcaattttattttatttataatttaaataatgtgttttttgttgaaaaataaatatattgtcactttttataaatggaaaaacaaagagaagctaaaaaacaaaacagatcaaaagaatccacatcgcaaaaatacattcaacaagtttatcagtcaataataatgttaatattatacgaaatatataagttaatcaaaatattcgaacaagatcaaatattggaacaagtccaataaagcaaactcatgtaaaaaacataccaaagatattaccatattttaatgaaattgttgaaaatgtatatagtagtccaaaagggagaaggtggactgtaggttcactaattttatgttcaatggttcatttttattctccatcgtcctattcaattttcaaagagcaaatgcccctttctgcaatttcaacactttataaaatacttagttctgaaattttgaataatgaacttttgttaaatgaatctaaattacctgatctattgaaaatttatgaagagaaatttagatataataattctatgccaaaagaaaaggccattattgctgttgatgctgttagtgtaacaaaattttaaaaaattttcaaaaatgggacagtttcaggtatgttaaaaatttttaatgttacccaagaggaacttaatacaattcgaaactcttatcaaaaatttgaacaatttattataaataactccaaaaattctatgaattctgcatttgttttccaacctcagccaatcaaccattcgaatccttgtattttaattcatgtaattccttcaaattgtagtaaagccaatacagatattaccaaaaaattagatgaattaaaaatttttattgaaaatcatactaatttcagtataattgaatatcctgctgatggtgataatttctatcggaacttttcaagagaacaagttttgaatgaaaaaaataaatcattgatattatttacacttattaaaataaggtagatattggtttttaaaaaatttaaatcaatatacaccagatatcaatcaattcaaaaatgatttttgcaatgaatacaatttacaatcaattattatgtcagacgaaaaaatcacgaaaatgcatgattctttaccaattaaactatttggcagaaatacattaataaaatctttcgacaaatctcacaacgatcaaattttttaatattttctcccatggtcactttttattatttcaatcaataacgatcacatttctgtcaaaagtagatgtaaatatctgaaacttgcattgatgtattttaaacaattttattatatttatgattataatttaatgattgatacaaaaggcactataatcagcttattgaaatttttaaaatctgaacaaggaaacattactttaaatagacttagctcaaattttttgaaacattcttttaatgttttaagaatgaaagctcgaaaccatgattctatatgtaaatttattaatgacattaaaagggttaacttcatcaggttacacaaaagaatgtacattaaaacagtgactagacacagaattaatgaattcggaaaaattatcgaacttgatggcagttttaatgatgaaaatttaaataatttatcaaattcaattgtaaggtttatatatttcaatgtgaaggatccactttttgaatccaatattttcttctcaatctaatatacaaggaagacaagaaatggatcaatctggaagaaaatattgtgcttggacaaaaaaagaagaaaaaaaactcaaagatttaaacagcaactttggtggtgatatcaataaattaattgaatattttcctgatcgctctccagagtcaataaaaaagaaaataacaagaatgaacgttaagtaaaattcttaactttacttcccatttttgtgagaataattagtcggaaccactctgttgtaagatctcatagaataacggttgcttaagtttgcggaagaatgtttcttatattaggtaaaatattgtcacatctaagtacataagacgattattggtatggctttgcgctttaaatctttacactctttcaaaaaacaaaaaaaaaagtaaatgggccaaagagtttaaattccaaatgccttgagaagttcgtggaagtcaagttttccattcatatcggtatcaagaaccattatatcttgttgagcttgttgcaacgtaattgggataccaattaatgttccaaactcaatcatttcgtaaacgtcaagtaatccatcatgatcaacatcaatacaatcaaaaatcaatttaaagaggtacgtagcatcagcagcagacttgttacaagcatcaatgtattcaagaaattcatcgaagctaagtaatccatcattatttttgtcgaaaattctaaaaatggcttccacaaaatatgggtcaagttggttagcttgcataaattgggaaaattcttgtttagaaaggaatccgtttttgtctgcgtcaattgcattaaaagacgccattaagccattgatttgttcttgagaaaagttataatttgggatatgatccatggaaaatgaatccttttggaaaagatatttaaattgcaactcccattttttgataaaaacgcaaaaattgaatttaatttaatcgtagactttattatttttgcctttgtgctttctatgttaattaacgatttatgcttctaaaatcatttgtaaaaaccagtgtgtttactatatatcatacaccattttggatttagaaaaattattttaaatatgaaatattttgacactataattgacataatagtaactattatgataacaattacatagccttcatctgttttcatatatagccatgtcaggaaaaaagatcttctttgattgcaattgcaatggtaattaagtacgccgataaagaacgacttttgtgtaacggccaaattgaatgttgatttcgcacaaaaatatttttaaatttgaataattaaaaatcattttcaatgggtgtcaggacctcacaatttcaagacagcaaatatggaccttcgcggacaagtaatggcggaacgcttcaagctttgcgatagaataggcgcgggaagtttcggggagatatacatttgcgaggatcttgaagatcaccaaagatatgctgttaaacttgaaagtgttaatacaaaagtaccccaactaaaattcgaagcaaagctatacaagctattccttggattttcaagtattggtcaattacactggtatggtcgtttcaacaaacaccatgcattagtttttgattatctaggaaaatctctcgaatattataagaaaatttaccagcgccttagccttaaaacagttcttatgcttgcagaccagatgcttacctgtattgaatattttcatcgaaaatgttttattcatcgtgacataaagccagataattttgtcatggggcttgataacaatgccaaccttgtttacatcattgactttggacttgccaaacaatattgtaatcccaatacacatacacatattccttttacaagcggtaaatcgctcactggcacagctcgttatgcttctgtcaatgcccttcgtggagttgagcaatcgcgtcgagacgatcttgaatcattaggatatgtattagtatatcttctgaaagaccgcttaccctggatgggacttcctcttggtaattctcatcccaaatacgcgccaattctccgtgttaaggaagccacatctgccgaaagtctttgcgatggacttccagatgagtttttggagtatttccgcctcgtcaaaaacctttctttcagccagaagcccaactacaaacagtaccggaggcttttcaggcaatgttttgagagatatgggtttacatatgattacaaatatgaatggacaacaccacagaagagaacaaggaaactatcaatgccaagactgccatcgcctaagcaaatgccattagcattacaacagaagaatgaagcaattaatcacctgagattgatacgatcaaatagtggaacaaacttaagcagaagtggacaattggactcagtgcatgtgaatgcaatgtcttccaagttcgaaacttgcttaggatcaggtgaagaagatgcaagcgaatcatttgatttggatttcgatacatcttacacttatgaaacttatgaatatagctatacatatgaaactgatacgtccagttgaggcgaaatttaattaaagaaaaatatacctttttcaactcgtttttttttctttgaatgataaaactttttgagtgaaattaacgttctcgaatttacaaaaaatatttctaaaatgcaaaaaatcagatttgatttgtgacaagtatcacttatcgaaaaaaaatttgaagcataaactatacaatatcgtttctatcgttatgtaaaatttacaaaaagtcgagtgaaaaaaaatggactatcaatgatcataagcacgttaaaaatgtcactttttaggtggtttccgataaaattttactcaaaatctctgatcggaaagaagaaaaaaaaaatcaatgattaaaagggtagctggtacgattccatacaaatattttgtattatggaattaaaaataataaggtgtactcaatagacttccattaaactttaagagtaaataatactatgaataataataaattttttgttgttatgaattttacatcatttttttcacaaaaattatcatcaaattatatgaaaatcatacaatgaaatatgatataaaatattctaatcaacaaatttaatgcgttaataataatatatgaaaacaaaatgaatttaggatatgtttatttcaatatttaaatatttcctcttttatccttgtgaatcttttaattttattatgccgtcacatttatgatgttgaattttgtctgcaaataatcgaataatttctgcatttttctcttctgatgatatcataagcgctgttttatatgtttataagtaattccaaatgtttcatatgaaatttcatatttttataaaatattttaaataaaacaaaaaaatatttttagcatcaatatcaatattctcttgttcaagaagcaatttaactatttctgtatgaccatttaaagatgcaaacataagtgctgtttgaaataatataaataatttccaaatattatattaaattctcatcgagccactttttgaaatgaaaaaattaaaaaaaataatttcgttcacaattttcaattcaatttaaaattgcaaaaattttattgtttatatagaaagtgtatctgaaatttccataccagctctgctcatgtctactgaaaataatgtgcaaaactattaatgtaagctagtaacgtacaacatttcatattctgattctttttaaatataaatgaatgcaaccaatttgtcatgagtaataggaaatggttcttcgtgtattagatttctcatcactttggcataagcatgaatcagcctatcatatgtacttttcgttcctgctgaaacatttgcggctgatattgtatcagcttcagcaagtaattgctccatcaatgacattttaaatatgattcataaaaaaaacttaaaaacaatattgaaaattgtgagcgcaattacaaataacgatttaatgaaaaaaatataatatttttgtttcttaacaacacaagaattatttaatttggctgttgacaaattacaatgatgtaaattaataacgtatcttctcgaggtaagggtaaaattttgataatatttaccatcattcaaatttgctcctatcgtctcttatcgttgttgctatcgtttgatattaaccatgcaaaagtcgattattgtcactttttaaaatgagaataaatttatctcgtgctaattatgatattattttcagatttatattaatcaaatttgtaattatgtatatatattatatattcataatatcaagatcgtaggatgatcgctatatacgatgggtggaaattgcaagtcgagtttaatatatgagattaatagtgatgaaatttcagcgtttttgaaagaaaaaaaattaatattaatgctgataatataagctaatcagcaagaaatggaaattataatttgttataaatttccttcaaaaaaatcaaattccaaaaaaatattatgccattacttcagaatcagataatgtcgaacgtgtgaaacatattttagaacaaaaaggtattgatattaatgcaacatatattcattttaataatttataatatgttttaataatttggaatatataaagtgtattataagaaaaactccaacaaaaaaagtgttggcaacaatcgtaacatttgataaattttcacacaatttaaacgatgtttctccaatcattggagaagattttcgcatataaaaaagtggtgtttgaagggtaaggctatcaattgatcaactaattttaggcccacaatttttgttttttgccaaattctaattctccattatataaagaagctgcggaacaatattctacaaacactactgcattcaagcaaaaggctcaagagtacatgactctttactgcaagtataaataaagatgattatatatttttaactctcaataatattttcatcttttacaaatttgttcaggtacttataaagtgtaaacataatcattaaaattcaacatatataaatttaattggttggttttaacttaaaaaatcttcattgtaaattcattaaaattttcattttattgttaaggtataaatcatctgttagcaaatataaataacatttacaaatcattgaatatttacaacttaattagaatttttttctttaggtttttcatctaataagaaaaaattaaattttgtcatgaaaaaaaaatatttattaaaaattaaaaattgcattacctacaaatgctaattcaataaaaattatattttaacgaatcctttatctaagaaatctgttccaaacggatcttcttcgatatgtgaagtttgtacaccagaaaaaccggttattgtttccggctcttcattcgtagcattattcattttacttttgtcctcttgagttttttcatattcatataaaatcgatgacgaacttttatctttagcatgtttaacaacacaaccaagagtaccaataattattaaaattataacaattgaaccacaaatgattccaattaataattctaatgaaattttattattatttaaatcataattatcatttaaataaaaaacagtaaagaaatctgaataataactatagaatgtggtgtatgtaataactttataatcataaaatacaaataatgaaacaaaatgtatgtatatggtaacgctaaaagaaattgtatctgaattagttaaatatgaatacgaaattattgtttgtgtaactgtcataacataaattaatgtttgggaataactttgacttatagtaacaccatcagaaatattatgtgatgacaattgagcaggagtaaaagcatctgaagaagtgaatgtataagtggtggaaaaagtgcgttcgtcagcctttttttaaatgaataaaaaagtaaaagaaattttgtttatttattatgatatgtattcaccttgagtttcaattgtaattaaaagtctgttcatccattcattatatacggctctgaaggtgtctttataaatattatacagtaatgtttcaactttttgaaaaagtcgatcttcattttcaaacttctcaccttcgagcattttttttagatatccaaacagaaaaaagtcagaaggtgcgaggtctggcgaaaacgaaggttgcggaagtcttttaattcccaattcattcaatttttcatgaaccaaatgaggccgggcgttatccatatgcaaaaaatatcccttcgttgaaattctttttgccaaatctccaagtacaatctcagaaaaaaaaattcgattaaatttttggcctatcgggagcattgttattgatttgataccagttatagaccatataacagatatcattacttttttggaggcaatagtttgtttgggtttgtatggtttgtgcactccagattcattccacatcgagtttctcccgttaacaaaataaatccaggtttcatcttgcgtcaatatgtgtcttagtctgtagtcatttgaactagaaaggaattcaaataattcagaagcaatggcagctcttttggctttaatttctggagtctacttatgtgggatccatttgaagttaacttttttcatccctaaaatattaatcattatatttttcactgtttttggatctgcgcctacattcttcgcaattttcttcgtcgatgcatatggataacctaatataaaactggttattctttgatctaaatctgatcttcttggtctccctgtttttttctgttcgaaaattgaaaaggtatgttcattcatcatcttttttgttaatttctgaactgttcgaagtgtaataatattatcaccatatacagcacataatcgtctatatatgtcttgattttcatttgattctaaccaaaggaaatggacaacagaacgtaattcctcaattggaactgacattaaaatgattaaacgttcttcttcagaggtatcctgaaaaaaagttatttacttcatgcatcatatttatttggaaaaaagtattataataataatgataatatatttattataaattttatttatataatttgatttcattaatattcaatataaatcaaaaaaaagctgacgaacggactttttccacccctatactttacgcaggaaatgtatgtgttggatcaaatgtcatcaacggattaaacgtagatgatggatcaaatgtagatgttaaagaatatgtatttgaccctgtaaattttaatgttggtggaggggtacatccttctactgatgaagtaaagatttctaactgaccaaatgtattattttgatgttccaccataaaaattaaaacaattaagggtattgcatcgataaaatgcgtaatcaccaataaaatttacattttctccaatagaaattgattccaatgcagaacactcacaaaatgctgcatctccaattgattctacttggaattgatgtaaatcataaagatattgaattgttttgtttaatatttattttaataattttatatctcaaaataataattggaaattattcaaattattttatacagcacttattagagcatcttggaaaggctatacagaaatagttaaattactacgtgaatacaaaggaaatgatattaaataaatcataatttttttttgttattattattaaaatgatatgatttttttttttttttgaaaaatacgacaattcaacaaataacgatacctcattcattccacatgtaaacggtcgtatcaaaataataaaaaaagaattttcagataagaaatcaataaatatacgaagaataacaattgtatgaatgagtgttctcagagagttcctcaaacttcaaatcatgcgatatcttttcaacaataattttatgttaataatggcatcggcagtagattgcaaaaataccctcgtcatgaaattctgactgttcaatctttccaaattcgatgagatttcgacctactttttcgggaattttggaatatttcctatgctaaacaagatagaaaaaaagaaccggaagaaagattgcaagatgaaattagaaggattcgaaaagaagttgaagaatcggaagatatcaattcgtttgttgaagaatattttccgaataaagaaagaatttatgtcatgtcgatcgttaaaatgtggaaagctgtagagaagtgcatgattcggaaatatgcaatgaaaggaatgcttgaagtaacaggcaattggaaaataacacatgtttaattatacactttatgccacaaaaataaaatgaaaaataaatttttcttattcttataaaaataccgatacgatcaatcgatattggagttaaaaatcttgtatcattattacttttgacgttatcgatatactaagctaaaaatgctatcgaaaaatgcagattgattaatctatatattgatactgtagtaatcgaaaagcaatttccggttcgtcgttttctatgaactgtactgctattattctatgttcaagatattttctgccgttcaagcgacattgaacgtatccgcctcgtgtttcatcgacatgttcactaatgattcttttatttgattttcttcttatttgataaaggaaaattgtaaaaatctcgtaatcgcaatcgcaaacacaattaatccaactcattctatttcatagaaattgaaaaaattaattatttataaaattaagcttatttttaaattatgtcaaatcaaccgaaaaataagatttatttttagctaatactcattaatttctttatcggattacttgaatttttacagtatctgggaaatacaattgccatgaaattaatgtatagtatcattactctttcactaatctttagaactaatgttcatttatttgagccagaagaaaaattttcatatttaggttcaaaatataacaccaaaaataaagctcataagaaatttagcgttaatattgcaagaaattttataaagaatgttgaagaaaaatattttagtacttggagtttatttcgaatgccatataattttgaaaaatataataagcaagatgatatagcttatgcaataaatcaaggaatagtttgtgctttacaaaataatcatatatatgtcttactaaagagcagtataaaaaattaatttcagaaaaaaattgaacttagttttataaaaatttatgtcctgtacgaaaattctcaaaaatctttcaattacatagtaaactattcaatttcccgcatacttacagtgcggttgtgatcgtttccctcggaaaaagccaggctttttccgagggaaacgatcacaatagctctcgctcccggcgctcgcaattactaaaaaaaaattgttgttgagtgttttactcaatttgctccatatgggataaatggctcgacgactccatcgactttccatgtaggagagattgtaggattccatttaacgccatagaaatacctttgatgaggtgtttcctacgtctatctatcattgacggttttttggggcagtccacaatgagctgtgttgttgtaaaatgtttccaatttctaagttcttcaatatttttgcatttttctgctgtaccccaaaatcttttacatttcccattttgctgtgggtttttgacttctgatgcaacttgtttaattccattttcttcgaggaatttcttaaaatctcctttgaattcctcaccattatcggtccacacagaaaatggacggttgccacaagattgaattgctaattcgaggcacttttttgtagttgcttagaattcgttgaagattgcgtcacaataaacaacgtaacgagaataatcatctatataagatattaaatattaaccgttataattatgagatcagtatgccgaattaagtctggattcgatgcttcatatcggcaacgatagggttcttcgggctttaacggtcgcgtgtacgataaggcgttgttctcctttgctggattgtcttgacggtagcttctagccaaagagggcaaattttgatcttttttgcattcggatattttagttcaatagtttactcagagattgaatgatttttgagaatttccgtacagctggtgtacaaatataaccaaaattagggggtgccgagcgtggcttcctcaattcagaggaaacttttcaatttttcaataaactcaattttcaataaacgataactatgaattttgaatgtttctgaaatttcttaatgtcatgacaaaataaattgaatgaattcatttttcaattaacgatacctatcgttttatcattgaatcatttgtattttgttttaaaatgtgactttattcataataagcatgatatacacgttagcaacatactaacaatgaaataacatttttatacatgaaatatatgatatgcacatatgaaatatatgatatgcacatatgaaatatatgatatgcacatatgaaatatatgatatgcacatatgaaatatatgatatgcacatatgaaatatatgatatgcacacatgaaatatatgatatgatattttgaattttattcaaacggtcgctcgtggatttttcatttcatttgattcattgtgaataatttgaataaattaaaaagcttggtaccaaatataatgaagaatttcttgtaaataattaggaacatttgtcgattgatgtttgcgatatacaacgtgaaggtaataatagaaaaaatgaaattgagatttgttagaaattatattcaacatcttcatataaatttttgttttcgttgattttgttaccattatctgtgttgtttgtaacatttcaattaacttttgatcttttacgtcaattttgatgtttttatttgaaccattagttttaacatgattacttaaaagtccaattatttccaaacaattggaatttcttcaatttcatattcgatcataattccatttaatttgattttgtataatgcgattttagatccatttgttatatatgattgacttgatttggtagaagcgattaatgcatcatgtacaaatatgatgaatatattgtaactttatttttattaaagaaaaatatgttcttaaatatgtttaatgcttttctatatgaacctgattgagtcataagatgttttgcgaactcaaattctgaatatccttcaagaattgattcggatagtgttctatatgttgtaataatgaaattttccattttaatttgttaaagtatataaaagaataaatggtatactaatgcgcattatgtaatttactcgagcacgtaaaatagattggaaaaatttcttttgccaacgagttaattgtgtcaatgtaacattctctgtacctttttccgtattttcatttaataatattgcttatgagattgaaatatcaacttcaaattgttcaactgaaatccaatttcttgttccatggatatcactaaagtaatttttaagttcaaacacaatgaattgtgtgttctctattatgttgaacaaaatattatgaaatttttttttatgatccaaataacaaatctttcatatttattttggaagattgaactttttgtaatcaatgcttcctatttttttatgttaaatctatcataacaaacttgcaattccatggaattgcatggaatgcatagatcagacagatcatcaaatatagaaacagctttttgctctgaatcaactttttccatcgttagccttaactaggcgtttttgacacaattatcgtctaatttttatattcaaaaatggaaatgtaataaggtcatttgaatcgattttgttccaaaatttttaacgatttgacctaaaagttatcgttcatttcaaatgaatgatatttgatcgtatgacaatatttgtcaccctttgttaggttttcgttttttacggttggggtcggagctctcaatttttcaatcaataaactaaacgatagaaagtttatgattttcttgtttccttatctttcttgtgcattattagaaatcataatcgataaaaaaattcacattacagcagaaagtttgaatcaagcatatcatgaagcattaaacattgataattcgacaaatttttcagatgttgaaatcgttaatggcgaatatattttcaatgaagtcgataataatcagtgggaaatgattcataatcttactatttctagtgatgttaatttttgattcatatgacttattttttgattatcccaatgttaatacaaatagaaaatatttatttgggtattacaataaaacgtgattcctatttgaatttcgagaattttgagcatttgaaatatattttttttgcaaacatttcccaatttaatacaaatatgttttcatattgtaataacctggttactgttgaagctcctacgttgtcttgtattggtgagtatacgtttcgaatgtgtaaaaaccttaaatcaatttcatttccacacgttatagcaatagatgcttatgcattttcttgctgtgctgcactacagagtgttagttttccctcaactcaaaaattgtggatctaacgcttttgaatattgtccaatcacaacaataagttttccatttctcagcgaagtttctccatatatgttttcttcatgcggaaacatggaaactgcttatttaccaaatgttactacgattggtgcttatgcttttttgcattgcttcagcttagtcgatgtaaacatcacaaaagttgaatacatttgtgaaggagcgttcaattatgcatacaatctcagaaccctcgaattaccttcaattataaatgttggcggaccttttcttgttgaatgttctaggctaatcaatatttctttacccaatgcaattcgtgttccagattatatgtttgctaatttatcaaacacgttacatatatatattccaaaagttgtttctattggaaaacattcatttgaacaatattttttcggtgagaatacttttgaacaacttaaaatcaaagaaattgatgattacgcattttcaggttgtgtttgttctgatgatttaacatttgattattgtgaatatgttggaaattttgcgttttgtaatacgcttgtatttggtatttcattaccaaatcttaaatcatgtggaaattattcgttttgttcatttggttatattgaagaattatattttcctaatcttgaaagttgtggtgattattcattttcatataattttaatttgattaatgttacatttccttcattaattacgattggagattcgccatttgaagaatgtccaaatttagagatcatgaatttaccaaatttagttcaagtaaatgattattttatatctaatgttaatatgaatcattttgaatttttaaaattaaaatatattggatctaattcatttacgaaagcatgtgacaaagttgaaaatattaattttccagaagtcatctcaattggtgattattttttaaaagattgtcaacgaattcgaagtatttcattaccaaacgtagaaaatattggtaaatatgcattttataattgtagtaatttaattgaagtttcattaccaaaattaaaatattttgactcagaattattttattattgtaatttaattgaaaatatttcattcccagcacttgaaactattggtaataattttttaattctttgttataatattaaaataataaatttaccaaaagttcgaaatattattaatacagcattttataattgtagttcgatttatgaattaaatttaaataatatcacgaatgtaaacgaaggaccgattgctaaatattgtaagtcattaaaaatcattcacatgaattcacttgaaagttcaccaagattttttatttgcgcacatgcaaagtcttgaagaagtttcattaagaaaattaaaaattacgaaaagttatttattttataattgcacaaatttacgaaacattaatatgccaaactttgaaacaatgattgaatctgattcaggttatgaatttgcatattgttcatcactcgaaacaataaaattaccatcaatagaagaattctatggtcgaaatacatttcagaattgcacatcattagtcgtaattaatatctctaaaacaacaaaacttgtcgaatatatgttttcaggttgctttgatttgattgatgttaatttatatagcgttactacacttccatcatattgttttaaagattgtacatcattaaaaagcattgaattgaatattaatgaattagatggagatggacatttttcagggtgtattaacttagaaataattaatcttccaaatttattagaagtatcagaaaatgcgacaaaaatatttgagaattgtaaacgcttaacgattatatatttaccatcttctccaccaaaaacatttaatgaaaatatattttcaactacaactaaagaaaacttaagtatttgcttatactatgatatatattatggtaattatacaagtggttccaacggcacaggttactggaaaggaataaatatcacacttaatgacgatttaacaagaaaatgtaatgtacatagatatcacgagacgaattggacttggattgatactttacttatatgtataggagttgtagttttgttgttcataggtagttacgtgctatttatttatttgtgtcgaaagtataaaaaagaaaaagaatcactggagactgtgcctcatttaaatatttcgattattgatccgatttaaagaaattcaataatatataaatgattttatatcagtaaattcaagtgaattttccatgaaaaacacataaaatatagtatttataaaacaaatatattcattgaaatgaagaacattcatggcaatataaacaattttttttttggtttatattttttaattttatttgaatttattccaataaaaaaaacatttgaagtttgcatgcaaatacaatatcattatattaaaatcttttgatattgtggaaatgacaaaaaaataaatggaaaaaaatagatataaatcaaatatacaacaatttaaattacagaaatagaaccattttgtgtcatatcaaaaagtaccaggtgaaacaaaatgtaacatgatgaaacaaaatatataaatattatccctgttaatttcaaatattatatgacgttaaaaaaaaatatgaatatatcaatgtttacagattcaagacaaaataaatataattacatcacaaccttggttaagtaattttactttgttttgtataaaaagaaagagaaaataaaccccatttatttgtttcgattagtgattttaaaataaatttggttattttggtctgcacttgatcaattgtgcattttggtctaatttgttatcattaatattttaatgaactaaccttggcactgagaaacaatatctagcgaacaagcaacaaacaaacaatttactaacttttgaatttttgtgtggttttcaaaaaatgaataaaaattgatcgttgtttaatgagagaaaaagatcaaaactcggcattcttggcaattgatgtgatatttgtactaattgttggaattgtctctctctacacaaggctttggacaatttcttatccagattgcatcatttttgatgaagtccattttggaaattttacgaaatggtacattcaacatctctttcattttgacatccatccacctcttgcaaaaatgaccatttctcttctaacctatcttcaaggttacaaaggcaccgaaattgaacattttgatcgactaggccgacaatactccaccacggaaacagtttatgttattattaggatggttccagccattttttctgctttttgcgcaccattaatatattgttcttgtaggttactttacattacaccattttcctcattagtagcgtcattatttgtagcccttgacacctccatgatagttgagagcaagtttattctctcagatggtgttcttcatttttattgtgcgttacatttcttttgtttttcattatttattcgacgtggagggactgtacttgctattttagctggtattacacttgggatggccggttcttgcaaatttacagctcttggcctcattgcagttgatggcatatcacaaataatttggatttttatggcaaagcccacacttttcgaaatcattatccgtgccattgccattcttatgcctgcctttttaattacatatctttcttggttaatccattttgcgatcactcccatttccggccatcacggctactacatcaagaaagaagattcccacaccattgctgatccgaagaagatcaacacatattattgggggaatcgagtttcccgatcttcatatttgctacggtttatccgttggaacattgtcatgaacggcataaacatgcgaagcaagattcctcatccgtgggagtctaaccccaaatattggccttatcttggcgacaaatacgtttccttctattcgaagccgaatcgacgcatttgttgcatgggatctccattaatatattggacaacattcttcggaatggtgataacatttccgtcgctgttgttcaagagagctggatggcagaacttgttgttcatgctttcatgggctgtttcatatattccgtttttgggcgttccaagaacaatgtttcattatcattatttaattcctttgatgttcgcttcgatgaatttgtccgctttgatcgatcgaatgtttagattgagatctgtgagaggcttcgtttgcatgacgctgatcatactgtgcgtgctgtgctatttgtatttcgccccgtggatatatggaacggaatgcccgaactgtaccgcaacaaggatttggtggagcagatggaaccagggaccgccaaggccactcctgtactacggaaaggaactgtttaagacaaaggaaaagagaattaaattgccaatatgacttaagttacatatgtaaaatagagttattactttaaaatgaatttctttttggttgtaaatatgaaaataattaataattttttttttaacttttaattgtttatataaaacaaaaaaataatatgttactgaaactagaaattgttgaatcaataaaaatatattcttaattttttattgtttgcttaaaatattaagcaaagtttttgtgaatgtgttaaatttaatttcagctttttaaaaacaatatctatgattattagatattacaaatttcttctgtttaagtaaaaagaaaattatcaaaaattagcaaaatgataccaaactatgaattaaattatgaaaattgttaagtgataaaatttcccaaaaagaattaaatttaatttcagcttcttaaaaacaatatccataattatttgatattacaaatttcttctgtttaagtaaaaagaaaattagcaaaatgataccaaactatgaattttaattatgaaaatagttaagtgtaaaatttccccaaaaagaattttattaaatttgtgtcgccgccacaactgacagttccttcactattggaacattacataattctcttattaactctaatctcttattgcatgcgtcattaaattctttcacagacatcaaaggcacaattgcatcaccgcatattgataaaccgaaagctattccttcggctgtcattgtctgttgttcaccgaatggtgttaacatatccttaaagttggataatttcttcacgtgatagagaccgtttaatgtcggttttatgatcaaaaccatttggtcacttttcagataatccttactaattttcagatcgaaatcggtttcattgaaaattatgtgtataaccgattcgcgtgccatattgaaaatggtctttgcgccatcttcagctttagccatggaaggacatactaaagcggatacagagtttgaagatgggataataggtaccgtagttcttaaaggaggtaatttgtgatctttagccgcagtatcacttacgaccattggctcacttatttcacgcataaattgctgaagtaactgcgaaactctcttatgatgtgcgggcttaaacaagagggcatcatcttcgcaagtaacatgtaaaactggaataacatttacatttaatttttcaagttcatcaaatcgttttataacagataacacatgttccttattaagttgtaatcttacggaaagtgagttattcgaatccaaaataccaatagttgttaagaaatcaatgacttttggtctttttgcaacaattggttgattgaaattcggataaaatccaaagtaatcccattccaaccaagtttgatattcttttccaaacttttgtaataacttatcatcttcagcctttaactcattcaaattcacttttgaaatgtcctcgattggggtgccctggagctgtatcggcttcacatcaatttggggtggctgcggcagagcggttttgacgatatcgtttgccagttttggctcaggcgaagttgactttatgttatccgatacgatccaaattgttttaccgaaagaaccacgagcgaacaccactaacggcccagttccgtcacttttttcgatgaatgaaaccaacaatttttcttgtaccgtataataatttattaccgggttattaattgcgtattttttgatgattaattcttcgttaattgttaatgaagagtccaatttccttgagaagtaatcaaggattggaatatgtgcatcaattcttgacactacaatattacttaacaagttaataatcggcaaatgataattataagtttttgccgattctttattcgctaaataagcgcttaacttattataaaacggataaaacatttcgagttcttgtctctgatggaatatgtcttcgccccattcgattaatgttattaacaacaatagaaccgatattaatacgtgtggattttctttgactttattcgcgcaatccaaaatcgaatttaagacatgttcttctaaaaatgctttacttaattgtggacgcgctcgaattattgcgctaatgtaattaattaatccggagatgaaactaattccgttttcgatttgttcataattctctaagttagaaaagatatcatttatttgtttaaagatgggataatcaataagttcaaatgaattacatataaatttatataaaacgattttgtaatgtgatggaaacttagtaaatgggtctaataaactactatacatatcagaaaactttttgtcattacgtaatatgacttgtgaactaattaatgaatcaaatgtattcgataaaagtttcattggttcgaataaatcagttggagtttctgaataatcaatgttctgcatgtttaataatgacacttctgataggtatggaataaattgataattatgtgaaaacgatttggataaataattataaaatgatttgatacaaaaaggatattctttcttaaggaattttaagatatatgtaatcatcttataatagatattctcggaattatcaacttcaaaatgtttcatgattcgcatcatcgtcgtgatgtttttggatataacaacatcaaattcttcttttggtgattcagaatttttaatgtcagaatataataatttgccaaatagttgtaaaaaagtgacagcggggaaacggttagttaacaattttgataacgtttttgatgccgagcgtgcgatcttataaagagtttcacaaatagaacttgcttgatcaagtgttcctttgagtgagtgtattttgtttccatcaactggcgatactgaattaacaagaatataagaaattgattgatcatcaatttcttttcctttgataaaaataccaccaacaaatggattactattggcatctattgggatattgtagattttatgaagaaaatagttgaataatcgaatagtattttcaccccatgatttaataaaatcaatgtcattactccaatcagagaaaaaccttccaatacgcttccatacatgatcttcttttattccactggtatataatgctgagaatagtacatttgctactgcttgtttgagtgaatgatgtttctcaccaagaatcaatgtaagtgttgcagaatgtttaactgtgattgtatccaaaatgttaataagggtattaataaggacaatccatgtttcttgatcgaatactcgagaataatttaaatgaatatcattataacaatataaaataccactcaaaaccgaataaaaagcatcctttgtgacgtcttgggaaactggatggttcatttgaaacggaattgataattgcataagaatccttcgaatatatttgttttgcctttgtggtgacccaaagaaagacatgtctttaagaaactcatgataaacatctagggcacattgcattaatttatgatcatcaatggtcattgataatgcaacagctaagaattccattaaaaacttaattctttttttagaatttaaaggaattgctgatgggtctttatcgatatagcttacaatgattttacaagcaggaatcataacttcatctcttggatatgttaaaagtgcataatgagaagaattatctttcataagtgttggatcttttgatgaagggagataaaatgggaattttacctcgggatttccctttttttcgtcgttggatttcatttttttattgtttttttgtctttcaatatcgaccgtttgtaatcctgagtaaaaaatttacgtcatatcaaaattgacaatttcatagaatatttgtgaataagtctggttgactgtaaacattgttgaagaacatccttatcatcttagacattattaaaaagaactaataacaaaaaaaaagagaatccttatatttgtatagatgaagaaaaataaaaaagtttagtaaaataatttaacttatccagaaatgatttattttcatgtaatttgtttttaattttcatcataatcacaaaattctattcagtttctaaaaatttatattttataataaaataaaatattttattttcaatgatctttgattgttgagtataatggctaaaaataatatcattttattaatgtataatatgtgattaatcattataaatgtttcaaaagtaaaaatagttcaacttttatattttaaaataagttttaagttttattctttaatcaaggaattcattcaagcaattgcactatttctatgtaaccattttcagatgctttcataagtgctgttttaaacaaatagaataatttccgaatattacattgaaattaaaaattaatttgttaaattttaatttaattaaataaatatttttgatgttaatatctatttctttttgttccagcagtaatttaattacttttatgttatttttataagatgctttaataagtgctgtatcatatatatttaataatttccaaaatttatattgaaacataaaaatgttttaataaaaatcatacaaaaaatggtgaaattttcggcattaatatcaattccttctatctcaagaataaactttacagcttctacgtttccttcatatgatgctttcataagagctgtatcaaatattaatcataaatcccatttattactttgaaacagaaaattatgaaagaattttatatctttcatattgatatcaaatccttcacgcttataaagtaatttcatcatatctatgttattattacagacagctttcaagaaggctgtattaaatatactaaataatttccaaataatattttgaattctcaaattattgaaagaaatttcatacaaaaatagaaagcatcttgaagattaatatcaatttctggttgtttaagaagtaattgaactatttcattgtgatcgttttcaactgcataaataagtggcgttttaaatgatttaattaaattccacatactattttgaaacatataattattgaaacaactactaaataagataaataaaaatctttaatattgacattaattcctgcttgttctagaagtaatttaactatttctgtcaaacctttttcacaagcaatcataagtgatgtttgaaattattcaaataaaatccaaatactattttgttattcgaaaattttaatagaaaccaaaaataatataaatcaacatttctagcattaatcataatttctttatgttcaacaagaatttttactatttctatataattatactcaactgcgaacataagtgctgtattaaaattacgaccaaataaaaaaaataaatatttttaatattgatattagttccttgatgttcagcaagcaattttactatttctacatatctcttcttacatgctacaataagtggtgaattaaatattataagcaatttccaaatgttattttgaaattctaaattatcaaaacaaattttaaataatacaaataaagatcttccatattaacatcgattccttcttcttccaaaaataatttaactatttttataaatccattttcaacagctataatcaatggacaatataaattaaataaattttaaatattttttaaaacataaaattatggaaaataatattttcacgaatattagcatcttctttatcaagaatatattcaacaagttcattatttcctgcttgtacataatattgattcgttaaataatatggaatttgttttccattcagaaaatgctgaactaaaaataaattaccaatttttgctgcttcaacaataaaattaacataaattttcatccctttttcttgtaaatatgtaaaaatatcgtaattatggtgttgaatacatattattcctaaatcttctatattttcaatctcaacaattttattttcaaaaagataatgaaagatatcatttcgatgaaattgaattgctgtttcatatgcattttcaaatgatgaatgattttgttcacatatatgaatgatttcttcatttccgcctgcaattgcatatttacctgtgttttctatttttgctccatttataagtaaatatttaaaacatttaactgatccaaaaaatgctgcataatcaattaatgtaacatttttatgattaataaatgaatatctttcataaggtgatggtttaattgtttgattaaaatcaaaatttgtttgtgatgatatttcttgaagtttttctacttcatcatttcgaatgatttttgcaatttcattaggattaactccttctctaattaatttcttatgaagttcccaatcattctttgaaagttcttcagtaacgatgtcaaaaagtgttttcttgttttctttattttgtttataagtaaaaaaatttaataatttgcttttaggaataaatgattttttaagtttatgttgaataaaatcttgttcacacaaattcttgagaataaaatttgattcattagtatgattcactatgaaaatagtgaaaacatcaaaaattttatatttgatatttttatcttcttcatgtttttcaatttcatttaaaaattttaaatatacgttaatatcatgcattttcgtagcaaacaatgaacaagtcatctgaattataatcatattgaatgtaattggatatgtatcatcaattatatttattaaagattttgctctttgagaaatattattagcgtctaaactaaaaattatgttgctaattgataaaagagtttgccattcattgtgattgttattttttattaatcgttttttcttaatagatctttggacacgagaatctttcgagggtatcataatctttgtaatatatggtaaaacaattgaaaattcacataaaagtgacaaaagaaggaaatttttttatattactgcaaactcaaaatataatcactttgtggaaatataaatattatattaagtgttggttaaaatctttcttaccaattttctggaatgcaatttttcaaaaaatcagctgatttgcaagtcaattttcaaattttgaatttttaattggataaattatagtaaataatataaatggaatatataataaatatgagcttttaaatcatatttaattggagaaaaagtcactttttagcattgaaccaaacagatgatataaaaaataattattacacattctaaaatttttaagagaaatataacttatttttgaaatatatcataacattcagttttaaataaaactttttgtttttccagacactcaaagtttttgatcgtcttgaattcaatttctcatgtgattagaccatttataaatttaaattaatgtttttgttttctaatgaacgaaactttattatacctatgatgaatcaacatatataagaatgggaggtcttaaatatgctttttttaaaaatcatcaactttttgagatcattcaattcttaataatttatcataaaattcataaatgaaatagtatatatgttgcactgtttatttatattatttgcatttttatttgaagctttaataattttttacaaggacatgaaaatcgcttgagcctttctggcagaactaaattcattaccaacctcaaatatgtgatttttgtttgagtgaaagcatgagattttatttcaagaaataaaacaaaataattcatataaaagtctgaaactcaggaatttgctacctcttgttattcaacatgttttgattcttaattgccttcatcagatataattggtacgtttgctagatctaatctttcatattctgcatcaacttttttttggataatatttagctcatctactgtatccttaagcattgcaatttgcctcttagtttgagtctttaacttttgataatcatgaaactgttttactccatttttatatcttgtaatcaaattttgaaaaatttggtatatctcttcaggatccttattgtcaagattatcaacaaaccccgaagcttcagattcagaatcaaagttatcatttgattgagctaccattggaatatcaacatttaatttcggaatttcatttgaaatgtcaaatgcataagattttcttcttttaggatttgatggagtgacatattttaatgcataatttgattttttttgaatttctttttcaaaaactttttttggcatttgatttgatttatttttatttggcttttttggtggttcaatttttttactaattataggttgtgataatctgtgagttcttttcattttttttggcgcgtttatacagatatttcatatagcatgtcagagctatctaatgatttctgggattgacgatactaggcaatatcctaccgaggatgaatttaagatattaattccaaggttaaaggattattttagtttaccggagcgatctaaagaaagaaaagaaatggttgacaaaacatttaacgaacttggagataaagaaagatggccccaaaagaaaatccgactttggttcaataataataaaaccaaattccttaataaaacagacagaattctaaccccacaaataactccacaatttgctatagatccaaacatcaaacctagttttcaagtagatgaaccagagccaacgcaaaatgaggatcgcccaatagaaacagcagaagttcaggctctaagaagttctcctaatcaatttgttcttcctcaaattccagcaaaagaagaaataaacacatattttaatttatatgtttcagagcgcgaagaaacaaatgaagcagaagatgatattcctaaacttccagaaattccaaaagaagatttagattttgatacccttgattctctaaaattttcacattataatgtccttcttgatttgagtcatcgggccaactctcaaatcaagaaaccagataatgatcgattaaaaatgttatttgatattgaaattcgatttaatgaagttcttcgacaaatgcatgatcaacttaaaattgatcgcatttcgccaattaacagaaacaatcaaattgctacaccaagttcatttggtgtaactcgtatgttatctattacatcagaatcatatgcgggtaaaagacatgatcaaatccaaaccttacgcgagaaaatatctgacgaaatcctctttgaatggcccatttcccgcaaaatcccaaaaagtatagaaaataacgaaccccttctcaacttttacaaaggaaagtgccaaacaaacgaagaggagttaacgggcatccagtgcggttgtttttcatctcagagcaaatttgcctatgtttataagaaccgtgtaaacagtagtcacactctaaaatatggtgggaaagagatatcaacagggtttttcaaagaagcaaattcaatggtcatcgatgaatccgatggaaaaatatggattcaagctgattgtcgcttaaaatcatttagtatggagacgcttgagccaattgataactttgaagttggtgctcgttgtttagcccaatcatgcatttgtatttgggatcaatatatagttgttggaacagaccgtgttatatccctttggctcaaggatcaacctggcgctacaaattcaagtaatccagacacatttaagaataatttaaatgaagaaatagcccgtagacaaggcttaaattttgatttaattgattggagtcgcggcaagaaaccacataatacattttgtaccacatttaatggcagaagtcctgttacatcaatttgtggattagatggagtcttagcagtagcatccgatcaatatcccacgatacatctcatgaatgaaagaggcaaaatcgttggccggttaatcttacatgttgatggaatcacttcattatcatcaaaagatggaacaattttattttccggttccaaagatatgactgccaatgaatgggacattaaaagcctctgttcaataaaccaattcttcatccacgaaggccctataatatcattgacacatggtaactattttggacatgagtttctgtttacgggcggcggagataatgtaatcagaggatgggacataactgggaaaagaactatcttcgaaatcagacgcgacataaataatacaaaggagttgacaccaaagttaattatgttcgatacagaaaacgctgttttaaatgttttgtttgtgaataatgagttggaatcgatgttgttccaaaacagtcaaagttcggtatggaaacaatatcgtttcgataatataaaacaaatcgtatgatattatttttggtatttgagttaataaattatatatttatgattatttataattttttggataagatatcataaattgaatttggaaaacttttttatttagagtaacaaaaagatattgatatatgcttttccatacttagtatcactcaaaaaagttttttgatcaagcttttatttttggtgttcattctcgcataaaatggaagtttatatacggtcggtttaatttttttgaaacaggtaaagcactcaaatttagactttatgttttttgctgcaaaatcgatttaacaaaagccaagaacaaatccaaaaatcatttactgaaaaaaattaattgttttatatatttttctcatccaatttcttatcattatatgaatgagtttgctcttgctacatgttaacatacattcttcaatgaatacacattttgtagatgtcacacctaatttctatgcttaatagcaagaaaatatattggtatattgaactcaattaaaaagtgtgtaaaacaattgttgaattcttcaaaattatgaaataaacggccgtcatcacgatcgttgtgggcacccccaaatatattggaaaccaaaaatttttgagatacaaaccataaatgtttactaaagctatttaatttatcagatgtttatacgattatcttccacgaaatcatctgcaaatgggtcatcaaatatgagtcattttagttgtttcagtttctattcaacactttcagccttttctgtttgctgtatgttatttctttgatgacgaatatataaaacgacaactaaacatatgatcacaataactacaactatacatacgactacgattattattattgtagctgtattatacacctgtgtcatactatgagtctcttcaaatacaatagaatatattatagttatggaatacgtatatcgttcattaaactttaatgattctgtaaatgtatttgacttagtaaataaatcttaatttgaaaatgtatttgagaatgtatttgattgtgagaacgtgtttgacatagtaaatgtgttagaaaatgaattcgattcggtgaatgcatttgattgagtaaatgaatttgaattcgaaaatgtatttgattgtgtaaaagtattcgaaaatgtattagatgatgtaaatgtatgagaaaaagtatttgacttcgtaaaagtttatgttatcaaatccatagtaatatcacaatcatatacatatcctgaatctaaagaagtaatttgaattaattcatctacagattgtccatatcgaacaatggataacgtaattccgtttgttaatgtttgtggaaataatatcattttacacccaatggtttgaaaggctgtataagcagtgcaaatatttgtaatgtcccaattattaactacaactgcatctgaattaacagctgcacttgcatcattataatatttttcatgttttagaccactaatttaaaaatattttaatatgttgaattacaaattattataccaaaactctcatgctataagttctgcttatattccaaataaaaaattaaaaaaatagacataatatttaataataaaaccgaaattctttaaatgggatcaatgatcgaaatatttaagtgaggcgtagtttcgagtgattctttttcttgtttattctttttaaataagtaaagcaacagtatataagtacatattaccaaaaaagccggaattaatatgcataagagtgcaatgagtagtattttgttgccattatcattctgtaaataaatacattcctgaattaaatcatcatcaatttcaatatttattcctttccaataatttttaggacatgttgatacaccacaatcgtttccataattttcataagcgtctttagctggcaaacaaatacttaagtttcctttttttatagttgaaaatatatattcattaaatgtttttggtggagaagatggtaaccaaataattgttaagcgtttacaattctcaaatatttttgtcgcgttatttgatacttcatttaacttttgaagataaattttttctaagttaacacatcctgaaaaatgtccatcgccttcaaaaaaggtaacacttgtaaatccagcttcatttaatgatatgcaatctttaaaacaatatgatgaaagtattgtaactttgggtacttcaatgtaaatcaaattaatacagtttaaaaacatatattcgacaattcttatcgcttttgaaaagttaattgctactaatgatgtgcaattctgaaatgtatttcgaccatagaattcttctattgatggtaattttattgtttcgagtgatgaacaatatgcaaattcataacctgaatcagattcaatcattgtttcaaagtttggcatattaatgtttcgtaaatttgtgcaattataaaataaataacttttcgtaatttttaattttcttaatgaaacttcttcaagactttgcatgtgcgcaaataaaaatcttggtgaactttcaagtgaattcatgtgaatgatttttaatgacttacaatatttagcaatcggtccttcgtttacattcgtgatattatttaaatttaattcataaatcgaactacaattataaaatgctgtattaataatatttcgaacttttggtaaatttattattttaatattataacaatgaattaaaaaattattaccaatagtttcaagtgctgggaatgaaatattttcaattaaattacaataataaaataattctgagtcaaaaatattttaatttttggtaatgaaacttcaattaaattactacaattataaaatgcatatttaccaatattttctacgtttggtaatgaaatacttcgaattcgttgacaatcttttaaaaaataatcaccaattgagatgacttctggaaaattaatattttcaactttatcacatgctttcgtaaatgaattagatccaatatattttaatttttaaaaactcaaaatgattcatattaacattagatataaaataatcatttacttgaactaaatttggtaaattcatgatctctaaatttggacattcttcaaatggcgaatctccaatcgtaattaatgaaggaaatgtaacattaatcaaattaaaattatatgaaaatgaataatcaccacaactttcaagattaggaaaatataattcttcaatataaccaaatgaacaaaacgaataatttccacatgatttaagatttggtaatgaaataccaaatacaagcgtattacaaaacgcaaaatttccaacatattcacaataatcaaatgttaaatcatcagaacaaacacaacctgaaaatgcgtaatcatcaatttctttgattttaagttgttcaaaagtattctcaccgaaaaaatattgttcaaatgaatgttttccaatagaaacaacttttgggaatatatatatgtaacgtgtttgataaattagcaaacatataatctggaacacgaattgcattgggtaaagaaatattgattagcctagaacattcaacaagaaaaggtccgccaacatttataattgaaggtaattcgagggttctgagattgtatgcataattgaacgctccttcacaaatgtattcaacttttgtgatgtttacatcgactaagctgaagcaatgcaaaaaagcataagcaccaatcgtagtaacatttggtaaataagcagtttccatgtttccgcatgaagaaaacatatatggagaaacttcgctgagaaatggaaaacttattgttgtgattggacaatattcaaaagcgttagatccacaatttttgagttgaggaaaactaacactctgtagtgctgcacagcaagaaaatgcataatcatctatttctataacgtttggaaatgaaattgatttaaggtttttacacattcgaaacgtatactcaccaatacaagccaacgtaggagcttcaacagcaaccaggttattacaatatgaaaacatatttgtattaaattgggaaatgtttgcaaaaaaaatatatttcaaatgctcaaaattctcgaaattcaaataggaatcacgttttattgtaatacccaaataaatattttctatttgtattaacattgggataatcaaaaataagtcatatgaatcaaaattaacatcactagaaatagtaagattatgaatcatttcccactgattattatcgacttcattgaaaatatattcgccattaacgatttcaacatctgaaaaatttgtcgaattatcaatgtttaatgcttcatgatatgcttgattcaaaacttacacgcatttgaaaagcaccttcaccaacataagacaacgtaggaggatcaactgttatcaatttgacataccttaaaaacatatatggctcaattcgaaaaatatttgcaaaagaaatatatttcagatttctacaagaaatgaaactcaaaacggaatcagttcctaatgtaacacctaggtaaatgttttctacatgtattaaattcaagaaaattaggtataatgtataggaattaatattaacatctccagaaacagaaaaattaagaatcatttcccattggtcagaatcaatttcattataaataacttcaccactcacgatttcaacatctgaaaagtttgtcgaattatcaatgtttaatgcttcataatatgcttgattcaaactttctgctgtaatgtgaatctttttatcaataataatttcaaataatgcataagaaagacaaggaaacaagaaaatcataaacctcctatcttttgtttaatgtctgaaaaattgaaagggatttgagttagttataataaaaaaatcattttttattttgatatctacattttaagtgcaatttaaacttatttatattattaattgatacagtggtatttttattctcaaaatatttcctcgaaattctctattaaccccaggaaaaagctttttttcttttctccatagaacgttaattgaatgctcaaccgcaaatatttgaattcaaatcttattcaatttttgatagacggtaggttgtcagaaatttgataagatgtgtaaagatgtcacttttggtaaaaagaactcaataccttttatgtaaactatacaaaattcataaattacctacattctgcactttgatccttctttttggcgaaattactaaagacatctttgattgctctggaacaaaaagtggatttatttgattaaacctatttttttgaggaattggcaatgcactttatttcattgtttggatataatatcatcaacttatcaactttaagtgtacaaagaatcgtaaaaatctatttgttgttttggagaaagttatattttttccataatatttgatgaatcaaaaacaatttatatcgcatttaatggatatgtttaacttgatttttcgataaaatttaatttttgcattttattatcagatttcttattgatgaatttttttccaatcaagcattgccatttaatagatcatccaaaaagaagcttatctatatcaaaaaagtaaaccaaaacaactagataaagttatggtatattttatgaagtttattaactatcttttttatgaaacaaacttatattcatcatctctgtctttgaaccagcactttttgttttcactaaaataaagtatttaaaaattcaaaaatggtcttttttgttccaggaaatggattcctgtcaaatcacaaatccttttttttgtcctcttcatacacaaagataccaccatgcgttacgttatattcaagaaataaatccctattatgttttagatcttggttgtgcagattgtgattttattttttatttaagccgaaacccggggaatctacaattcattgttggagctgacaaagatttaagagctcttcaaaaaggatctaattatttatctgctccacaagttttttattcaaattcaagatcatttccaatatttttattcaaccaagatgttaccaattttagcaatgattttgttcatcaaaatctctgttgtccatttatcacaatgttagaattaatggaacatttggaaccaaatgatttagaattagctctttaccaaattttccatcgtatttgtccattttgtatatatattaccactccaaatattgaatataatgacatattaacaaaatcatttggccatgacagaagattcggcaaattcagacacaaagatcataagtttgaattgaaccgaactgagttttattgttggtgctcatgggtttgtgaaaattatggatattcagtaaatatcgatggcgttggaaagtgcgttgatggaaacgatgatggtaattgcggctgcgcttctcactccgcattttttttacgttctttgccggtttacaggaactttttctcctacccaaataactccacgttcagtgtcataatacaactgaatgatgagcaatgcaaagaagcacaatgaaaagtttatgtgcacctgcaaatgatgaatggtttcctcatttctacatacatatctccttgtatctgttaatttagagttatataataaataatacattttgctatagaaaaaaaatacttcataagttttcatgaaacattgttttgttagaaatgaacaaatttcatatagtaatagttcaaaatttgtaagtgtttctttcattatttagaattgtattctttgttttatggaatttttcttcaagtttaatggtgtggctattgaatagtttattgatcggtatggtaatcgttcgagtaaaatggaagaaatcgaggcttttcctatatcatgccctttaattccacttcttcctgatggagaaaaatacccaaaggattaccaacttcctttaaggcagcgaccacaacattcactcgacattgcttatcttgttgatgttcttcaaaaggaatctatttttgacttaaattatcaaaattcacatttatcagttatagcagttctttcaccatattcacttcttaatcatgttatgataactgaactcagtccaaataggtatcttccaagtccaacttcatttacttcaacagaattttccaatatcacagaacttactgaaaatattattttactcacaaaacaggatccacataatgttcaatgcataggttataattgttcgccttattcatggggcattgaagaagaaaaaggaggttgtcaatccataatgaccaaatttcatcttatgatttggcaatggggtgaaattactaatcaaaaaattcgcaatctttccagtggtcataagctttatttttccacaaacacatataatattccctttgcacgtctacttcattccacctcaagctcctttttatccaattatcacatattttcaacaccgacatttacatctcgcggactttttcttccatttactgaaaattcttcgatattaactgtacttcgggaaaatgattttttgtataatttctcgcacattatcgaaggagttattgatcatttaaacgaatgtcttttgtctgatgattccattcatgagatgaaaacaattcttgagacgacttcttcacatgtattaacagaagaagaaagaataacacttcgaaagaaccctaaaattcggacattcgatgaagcaataaaaatgtgtaaatgtgaaaatgagaaaaatgttattgaggctgtgtatgaatccgctttaaacagagcaacaaaaaatgatccgtcgaatccattgtggaaaaagtatttcgggtattcgcttgcggttgttgactctaagcaaaatgatgtttgcaaaagcggtctatatgttggattgcatgcgctttgtattcctggtggggtagcagagttagtcggatgttatttaacgaggccagagcaatgtttggcagatgaggaaatcatgatgaagcataatcacttgttatggaagctctcagatggtcttaataaattgtatgaataaatatttatagacagtactttttaggacagataattcactttggctcaatgtcccattcaacaacttttaaacatatttttaattttctccaaataattttattatgggaaaacgaacaacaaaacttcagcattttttcattgatttatagcaaaagtgtcatatatttattttttatttattcgaaaatttttgaaactccataaatttcattaattgaagcgatcaaatcgattgaacttctaccaattgatttcatacattgcttttgcaagtcaggctgtgcctccaagaagtccatcatcaaatccatatcgacgacaagcctcggctgctcgatcatcagctcttggttttccagcaaagggaacttcccacatctgtactccaagtgggagaaccctgtcagagttttttcgaacaaagattggaccaaacaaagtcttcttcggtccaactcgttattaattggcgataatataccgaatttcccatggtcagaaacgaaccaaccgaagtgtccatcgatttcattactgattgcgctttttattgggaagaatccggaatttaaaggtcgacaacccaaatagaaaattgatttcctcacgaaagcatcaattggtattgcgtattcatcgatatcagagatttggacattaccgaaattatcgaataaacaagttgctaaaacacctttttttgtaagtaaagctccagctattggagagaaagttaagaaatcttttgccatagtaattaatttgtgtccataattcctccatcgaattaattgacatcctttatatatatcgatataaaacaacaaatttttcaatgataacatttgcgaagggataaaatgtccatttaattgtgacactactttatattgtttttcattcacaaacattaacatttgaagttgtcctccaataaacgctgcaatataaccatctaattcagtgataacattaactggcgccaagaaaaccttactaaataattcttgtaattgatattcattaccattattttcatcgctttgaataatggaacctttataaatagctaatcggcctctcattagtcgttcttcatgacacatataacctgtgcctatagctaaatattccgataatgtcgaattcgggacttgataattttcagatgtacgtatgaatgagacacaattaccatattcatgattatctaaacttaatgctttgataataccttcggaagtaataatatttaagtcataatgctcttcatattttaatggtaatccatcaatactatcaaattctcgtggtggagttggtggcttttgataatgtggtgttaatgaagcttctggatcaatgtccggttcattttcatgtgtaaataatatcggatatgatgaaaagaagataatcgcacgccatgaaggtgcaaatgtcattgatcgaattgtttggccaactttaatacgttgaactatacatccatcaattatatgcgtttctttttgtgttaagttatcgaaattaattaatttaatatcattgttatcaattaacattaatgattgatgatattgagtacaatatattccaataggtgatggaataattcgtggataaccacattcagagagaatatacattggatgttcacaacaaatatatgcacctgaataaccattaatatttgtaaatgatattatcgatccaaatttacatgttttacctgacgatgtaaatcttcgtgttttaatcttacggaaaccaaagttataattaccaaagtaatgtatttgatatataataagattaccttcacgcattaacattattaaaaatggctttttatcgatttcaattatgttcatatctacaacagtaattaattgaaatccggaattattaatttgacattgcggatatattaaatcactaaaatatttaaattgttcataaaacgcaataactttttgttctgatatcgaatatatatgtaatgtatgattgttttgtaacataaatatataatcatcatatatagctaatcgataaatttgtggttgtttaccagttgtagcatttactggtaagtttaaaggtacaaaatataattcatcattaagaatttcactacatattaatactgtatgatctgataatattataatgatataatctttcgatattttcgctgttttaatttctcgacctataggtggatcgaattgatataataaaatattatctctaattaatcgaattgaagtagaagtaatttgtacaaaagaatccataaaatcgcctgcaataattgtcggctcatttgtaacaaatatttttaatgtttcttcatctaattcgttgaaattattcatatttagttggcgcactgctgtagatgtttgttgtgataataaaacataatcaaaataattcgatgtaaaaatggaaattacatcagtcatattaaatgaagctaaaatatttggagttaatgatgtccttaaatattgtaaacaactacttttcttaaacccacaacctaatgccatcgaaatagcttcattattaattccttgtgtaatcgatgtatcatcaaagttaataaatggagtagaacatgtaactgtaccaatttgatatataactccaacaattgttatatccatttttgtaataatatgtcgtgaaactggttctggtaattctttatataacatttggaataatgtcttttgtgattctgttaattggaattcattaaaataactattcgatatatcttctgtttgataatttaacgataacatatatgtgtcttgaattgtagaagctgcaaatattaagttgtccttataatgtaaaaataaactcggatggaattcaaaatcttcatgaacatataatgacatccctgtaatatcaataccattatcatgtaatgttaatatggcggggacatgttgatcgactgtgattaaaatatgattagaatctaagacacaatatgccgatgaatatatttcatgtggcgtctcacaatgatcagagatttcatatggacattcatcatcaatgactgctaatgagtttaaaccatatgcaaaccctgacgtatgcgtcatataaagaatggcattcttggttaatactataaacccgccatgaggtacaaagactggaataatacatatgaagttatgtggtattggtcgagagttccatgatgatttcttaagatctgattgttcaccacgacgacgtataagtaatggggaaattaaggagactgtgatcgtcgacttttgaatgggtaatcgaacggaaaatgtaggaattggctcatgaactattgctaatgtgggtcgattataaccttctaaaaaacgtatgtcaatggttcggaaaaaaggtggatcatagtcatgtaataagttatgatgaattgctcctgtgattatattccaacctgaatgttgacctgtctctaaaataggtcgttcgcttttggaaaaatcatttggatcaaataaagtaagaaataataattgatcaccacctaaaagtaaagctatgcaagaatcatttggatcaatgatcattttgggtggataacgaagacaagtggatgtatcacaaacatcaaaacgatgaaattccgtttcttgaagatctatatcgccaactgcttgaagtgcaactacttttgaataatcacatcctaaaattaaaatatcataatcgcccatcctgtgtcgaacaacggaaaaaatattggcccaaaagttcttttcccagattaaatgaaatccttcttcatcaaaagtatatatttgaagtttactaccactagcagctgcaatacattcgttttgagaaaaaggtaatatgcatttggttgctgtggtaaatgctggtggatcacaaatagttcgataagctgtgtccatccaatgcgatttgcccttttgagaagggtaaaatatggggtggtctgaacgatcaataataattcaaaattatgatgtatgtatattcggtatctaattttagaatttcattatcacacatattactttatcttttcctttagtggtcgaacaggtttccaaaaaattacttaaaaaaaaattttttatcagatgtaatgaaaatatttaaaatatcatctttaatttgcttaaaatttaaaaatgattttagcatgagtaatcatatttgttatatttaatgaatttctttcatttcttcagaagatacgcaaaaaaacatttttgtattcatgattttgactttttgacagatatttgaaatgtcacttttgtgtcgaatacatctttcaatgctagttctttttcttgctgcaataaattcattaaaatatcagtgcgtagcacctttattgacgccggctccaataccagacatgaagttagtttacgcaacagttgtaattcgtcatggcgcaagagcaccacaaaatgcttatcttccattagcacaaagaggacactgggtttgtgatggtgaagacgcatacgcgccaaggttaattggatcaaaggattctgaatatagaagatataagcaaatatttgatccaagattagttgaatttttaccaaattgcagagctggtgatcttttacttcaaggaatggaacaacatcatcaacttggtgaaatgtatcacaaatatttctttgaaaccacaaaattatttgattcaaatgatgcaaataataacaattatgtctttgctcgttctaccgatttcgacagaactcttagaagtgccgagtctttcttaggaggagcatttccaccattaaaaccatttgaaaaaatcacaataaaccgtggaagtgaatatttagaacttctacgtcccagcagtgacttttgccaagatatcaaagacatttataccaaacttgatgcagatcccgattatcttaattataccaataccatgtggaacaaaatcaaacacattgctgatgaatttggtgttacatatagctcctctaatcttaatcttgttgctaattgggttgttactcttgagtgtaatggacaacaacttccatcctttgtcaagacagaagaccttgaactatgtcaaaggatcacagctgaccttatgtacattgcattcaagaagaacacaactgttttcgtgtcttatgccatgcgtgagctcctcagagtcgcaaaggaagccgtaaacggtggaaaccaattcaaattttcacttttgtcatctcacgactcaaccgttggcacttttttgacatatttaggatatcaagctactgagactattcccccttatgcttctcacttattaatggaaatatggaaaagtggtgaacaaaggtatgtgcgttggtctttcaatggtgaggtgttgaagatattcggtggtacaaatgaatacatgaaatgggaagatttcgtagaaaaaacaaatgaagtgtaccaatattgtaaagaacttccataaacattttatttatgtctaattatgatttcattatttttttttattcgtgattttattaagtccagagaaaaaatctttatcttaaatggttgtgcaagtgttttgtttgtttgctctgtacaatgatgaaggaaacaatgaaaaaattgtaaataagcactttgataacttttttcaaatcattaacacagctctaatttttgaaactgtgtgtaataagcgttgatgaattgctgctgtgattatttcttaaataataatttacatcaaaaaaaattacttattcaattctttattcatttccttctaaaccttctgtatacagctattccaattccaattaccaaaacactaccagccacgattgccaatgtcttacataatctcgaattaccttcctccttctttgcacacaacgtatcgttcttccctagctcaggcaccagtgaaatggcaaattcgcgcatctcttcagctttttcaatgtcttttttaacgtactctcctttttcatagaattgagcgaggtcatagcaaacgaagggattctcgcgcatttcttcgtgaactttctcaagaatcttcaaagacttttggggatctttgtgttcatatacaacagttgaatatggactataaatttcggctatggcaattccggcttcattgttcccttgtgaatatgagatttcaaagtacttgatggagctttggacatcagtttgaagaagataaagtccaataagcaatgatgtgtcttcatcatgatatatatcaaatatctttttaagtaattgataaccttcttcttgtgagctctcgtcgtagataagcttgcggcacttccaacaaatggcttttgtgtaattgaaggaaagagcaatgtctaaataacgatttgaaagtgagtcattatcgtaatataacattgaggctaagaaagcagaacgaggatcaatgatattagctttggttgggccattgatgacaatttttggctcatttatggaaattcccttaagttgaataacatagttcccatctctaataaatgtttgtattgattctgcaggtttagcgagttgaccagcgaaaaaaggtatgtgattttcaagtttgcaaataatttcagaatttgaattgtcattttcgattgaaatcttatcaggtgaaacaccttcaacaatagggaaacaaacatctataatgttttcatgtacttgtagagtgtaatcgtacatttttcgtagttcaggacgaatcattggaacagatgaaaataaaataaatcattcaaattattgaatactcaattattctctaaacgtctcctcgcaaaatggaggaagaaattaatgaaaattctcaacccagctgttttgaaacattacagattaaatttgaaggaaaattttcttatttaaatattgctgataagtctttctcagatgtatatatttcatttatattatttgcactattactcataattctattctcaatttcatggtattgtgatttaaatgcgtacacactttcaagctatgaaacaaataggccagaatcagcaagaagtttaagaattttcaatattgatgcatatgcaaataatgaaataaacgaaaaatcaagtgttaaaatacaactaattgttacagaacaaacgagttttataacatcaaagttatatttctcatgcaattcaacgttcttttatcgttcaaattatgttctctttcttgactcaccaaaaccttttcccatcaccaacaccacatctttttcgatttttgactcggttccaatcaaatctgatacattttcagtttcatgtcgattatcaggtgatcttactctttgtaacactgcttcctttgctgttacttttggaagcgaacggtttgattactacactactttttgttttatatttttcacagttgctatgtttctaattcaattattttattttgttgttatttttgctttcggcattcagccacattttcttcaatactgtgttattttccttgtgatttcaggtggtagtcgcctttcattaaccgaaaaaatggccggatatattccatcaaatggttttaagacattcataaatatctcacattcggtctccatttccattattaggatggtctggttctttattcttagttattattcacctgtcattatcaaaaatccaatttttcgattaatattttttttgttaatttctatttgttatattgcaacaaatctttcttatcaagaatcaaaaacagatggctctaaattagctaaatcattcatggacatcattatcttttggctcaccgcatttaaatggataaatttcttaattatgccaaaacaaaaaacatcaaaattctttaagtcactttttctatcggttgtcgttctatcgtggctatcgttctgggtatcggaaacaatggactcaagtggaaattattcagatagatcagcagtaaaatatttctgttcagatatagtagatgaaataatggttttcgtgttcgcattttatggcctaaagtctgataatgagaatgatgttgtaagcaaatgatttttataaagaattagataaatgtttggatataaggattttatttatctaattaaatatcataaaaaactgtaaataaaaataattttaaaaaaaaaaatgtctacttgttctctttcttatttaagaattaaatgactttttacttgaaatgaaatatttctttaaatataaattttttcatgaaatgaagatatattaatatatttcacataaattttgatcgagtggttgctgatcttcttcttctgtattatcattttcttcatcatctattgcaccattttcaaaaaattctttaactttttcttccatttcagaatttggattaattatcttaaaatattctaaaacggaatcctttgcatcattatctccaccatttattgcctttcttatatatcgaaatcctttcttttcatccttttcaccagctacaccagacaaatacattagtcctaaatttcgatatgtcaatggatcgcctgctttttctgccattttaaaacaatgtaatgccatttgaggatttggatttgttcctcttccacttaaatacattatacccaaattactatatgcgccaacatcacctcttctagctccttcacccaaatatttgaaagcaagcatcattttgtggaactccttctcctttcatataaagacaacctaaattatatattgcacttgcacttcctctatttgctgcttcacgaaaatacattactgctttgttatcatcaacagaacctcctaatcccttatgtaataaaatacctaaatttgtcattgcaggaacacatccactttctgctgcaatggaataattcattctcgctttaaggtaattttgttcacaacctaatccatcactatacatacgtcccaaatgaaaacgtgcattgataacacctttttcagcacaagtttggaaacattcgaatgcacgcttataatcaatagatgtacctttcccttgcattagaaactcacctgctttcatcagagcttgtatttgacctttttgacctgcttcccaaaaacattcaaatgctttagcatcatcttgaggacaaccatcaccagattcataaaagttaccaagattaaacaaagcaccaatgtgtcctgctttagcagctttctcaaaccattcaaatgatttagtagtgtccttcttaacaacgccccattgttcccctgcaagatagaaattaccaatttgaaccatagcaggagcatttccatccttagaagcaatcataaaatgatcaaatgctttatgtccattgacttcacagccatagccacgattatagcaaacaccaagttgaaaatgagcttgaggacttccaagatcagctgctttttgccaatagttaaatgcttcattaatatcttttggtaaatcatttataccttggaaataaagagatgctaagtataaattggcttcaatagaacctgctttacttgcctcacggattatgctaagaccttttttaatatctttttcaacaccttttccattaaatgtacatgctcctatttggaaaagagcatctgcatacccttgttcatatgatttttggaaaaatataatggcattaggataatcttcctttttcataagttccattgcagtttgatattgatcataccctggtttttgttccatgaaaattatgtgatgtggtaaaacacagattcctaaaattgaataaaaattttgtattaatcaaacaattcttgccctaaccgacaataataagtgttggcataaataaggcaagaattactctgctgaagcaaggatcattttatttaaaatttggttaaataatttcaactaactatttattatgatgattttcaaaaatcattactttcgatatttcttgtaaacacatctttcactggagcttttccatcatgccaaaccatccatattcttgtattaaatacttgaaaaagaacacgtaccaactctctaaagtccacatatctagcagcagtataataaaacgtgagctttctcccatcaaattgatattctgcccctgttattttcattggaaggttcatttctctcactttaatttgacatatttcgactgctttttcttcatgctctgtttttaattcaacttgatcaatctcacattgccatgcttttctttttattttctttgctgtttttaaatctttatttgttggattttcaatataacttattactattccaatatcaattcctttcgtagcagcaattatcacataatcacctatagaaatctttaaactttcatttgttgaacaaatttcacttcgattcttatgacatttaattaagaaatagctcagcttagtttgaggaaataatagtgcgttatttcttggaattattgagttatcatcaaataataaattaatgttatcaaaattttcagaccattcatcttgtaaagatgatggaagaagacatttatatgattcatcatctatttcaattaaataatcccattgatctttcataaaagtaaaaatataaaataataaatattttttaagtaaatatagtcttaaatttcaaagttatagcatttgccatagcggtgtttgaaaactttattatttgactgagtcaacaacagttaaatcagatagcattttatatcgtttaatttttgtgccgatttaaaatcaatagtttcaattttcgatattattttttgtagttcaaaaatgtacatcaataagttaaactacttaaaaataaaaattctaaaaaaacgattggttatgaaatttgcttttgacaataaattacttgagttattattcaaattgttgtgataaaagttattcattttattaattattaatttataattataaattttacatatagtaactaaaatattataatattttttaaattaaagggagaaaaagaaatttaagtgaattacataatattaatggatatagaatttaaataatttaaaatatttttatttagtaaaaaatgcatgttctattcaacctcgcatgttcacgaagtaattcaacgatttcttttgcttcatattgtgaagctattgtaagagccgtttgaagagaaacgaaaatacatcaaaaattatctagaaactaaaaaacaatttaataaattttatacaaacattaaaaacattttttatattaatatttatgtcttcttgctgaagaagcaattttactatatcaacagtacaatttctacatgcaatcattaatgctgtttgataacttttaatttaactccaaaaattttacctaaaccaaaaaacacataaataaacataaaattaaacaaataaaaattcattgcattaatatcaattccgccatttttaataatgaattttactgtttcaatatcaccacttaaacaagcgaacataagtgcattataaagctaaaagaataaattcctaataatactatgaaacgtaaaatttacaaaaagaaattttaattgatttaagttaaaatcagtctcagtaatatcgaatccacctctttcataaagtaattttacaatttcaaggctaccattttcacatgcagttaaataagctgttttaagtaatttaattaaatttcattatttaaaaacaaactcgaaaacattaaaacaaacaaaaaattaaccaaaaaaatgccttttaatgtaatatcaattccttcttgttcgagaagtattttaacaatttctgtatttcctctttctgatgccaaaattaaagcatttctaaataatttgtataaattccaaatttattaataaaacacctccttcaaacaagttggaaaaaacttctttcatattaatatcaattcctttttgttcaagaagtaatttaacaatttcctgataatttttagaacatgcatacataagtgcagtttggaaaaatttaattaaattccaaatgttaaaactaaacaaaaaatcatttaatcaaacaggaaacaaaacaaataaaaatctttgaaatttacatcaatatcagttatatcaaggaaacattgtacaagttcaaaatttccagagatcacagaattaaccaaaattctatttggaatttcattatcagccaaaaattgttttgtcacatataaatttccaattattgctgattctaacataacattttcatcgacattcatatcatcgtttaataaaaatgataaaattttaaagttaccacattctatacattttattccaagttttgttttatcaacattttcaattattttcctttcataaaaataatgaaataattcatttcgatgaaactcaattgctgcttcatatgcaccaacaaaagatgaattattttcctcacatattttaatgatttctatgtttcctcctgcaactgcaaatttcccagtattatttaatgttgcgcctttagttattaaatatttaaaacatttaatcgatccaaaaaaagcacaataatcaacaagtgaaacattaagtttgttaataaaagaacatcgttcatataatgatggactaattgtttgattaaaatcatttttaacttcttgttgaagtttatcaatatcatcatgtcgtaaaataatagaaattgaaagaggatttatcccttcatgaagatatcgcttatgaagctcccaatcatttcgttgaagttcatgaatgtttgaaaagaaatatccactaaatatcgttttttcttttaagttattaatttctgtttgcgacttgtgatgtgaaaagtattctgtttctttgttttttattacttttggattaattaattcttgttcaaccatatgttcaagtatataatatgattcatgagtttcaagattaagaagaaacctacaaaaacattcaattattccttgaaaattctttgaattttcttcttttttatcaatttcttttatgtaattaagataaatattaacatctttcatctgagaaacaaaatatgaataaactaattgtgaaataatgttattaaatgaatatggaaaattttgatcataaaaattaaaggatgattcaactattgattcaatgttatcttcttttaaatttgagattatatcatctagctcttgtaaatcttgaaataaaaacgttttatcgttttcattttctttagttgacattttacaagtgtgtaatgctttgttaaaccggaatttgtctgtcacttttttgtaaggccaatggaaaaatgcgaaaacttatcaaatcaaggcaatagattcgaaaaattacaatttttacagaaaataatacttgatttaagtgaagagaacactaatcaatcatttctttcaataattaatatgtttaatgaaaattatgcatattcttttaacttacttattagccaaataatatattcatcatttatcttacagaataataattttaataaatattttaattttatgaaagaaattgaaatattcgaagaaaaacataaaataaaatccaaaatattttctgtatttacacattttcttctcgggaaattatcacaagaatcacattatctccttgaagttatgattgaacgtaatgtattaaagcccaaagtgcttgaaagtcaaaacgaaaaatatttttttcattacattttatataaaaattttaaagaagcaaacaacaaaattttattacgtaaagatttcaaagaaagtcgcgaagaactttcacaagataattggaaactatataaaaaattaattaaagaaggagttaatccgaatgaaattgcgaaaataattcgaaatgatgaaatcgaaaaacttcaagaaatatcatcacaaacaaaatttgattttaatcaaacaattaaaccatcactttatgaaagatattcatttattaacaaaagaggtgttacattaattgattatgcagcattttttggatcagttaaatgttttaaatatttgcttatgaatgggacaaatttaattaatacaggaaaatatgctgttgcaggtggaaatgaagaaatcattcatttatgtgaacaaagtcatacattgtttgaaagaccatatgaaacagcaattgaatttcatcggaatgatatcttgaaatatatttatgaaaataaatttgttgatattgagaatttagaagaattaggtattgaatgcattttgcatcataattatgaaattttttcctttttgcaaaaagaaggaatggaaatcaacgattccattattaatatcgcagctaaaataggtaatatatttcttgttaaatattttcttgaagaatatcaaattccaaaaaatattttgattttttcggtaaaatcgggaaatattgaactgatccaatacattttaaatcaaaatggaattgatatcaatgctaaagatatttatttgttttatttgatatttgttttaataatctggtgattcaaaacattatttggaaattgttttaattatttaatacagcacttataattgcatctcaatatcatcaaaatgatatatttaatttattttttgaacaagaagaaattgataataatcctaaagatttttatttgttgtgttttatatttgttatattaattttctatttcaaaataatatttggaaattatacaaattatttaatactccttttaattgtgcagctgattgtgtccatatggaaataattaaattacttcttaaacaagaaggaatcgatattaatgctaaaaacgtttgtttatttatattaaaattgattttcataacttaaagtttcattgtaataattggaaatcattcaaattatttagtacagcacttatttgtgcatcttatacaagcaattcagaaatagttaaattgcttcttgaacaaaaagatattgatgtcaattcaaaagatatatatttatattatttaatataagtttctataatttgaagttccaaaataatgtttggaattcatttatgttgtttcaaacagcacttatttgggtatcttctaaaggaaacatagaaatagttaaaatacttcttaaacatgaaggaattgatgtcaatgcaaaagatattttttaatttagtttaatatttgttttaaccatttaatatttcaaaattatatttgaagactatttgaactatttcaaacagcacttattaaggcatctaaaaaaggtcacatcgaaatagttaaaatccttcttgaacaagaaagaattgatattaatatcaaaaatatttgttaatttttcccattgtttaatacaatattttaatgttttgaaataaaatatggaaattatttgtaatatttaatacaatttgttttcatgcaattcaaaatggaaatacagaaatcgttaaattacttctccaacataaaggaaatgatgttaatatcaaaaatatatattgatatttatcaaaattagattcttttatttaatgtttcaaaataatatttgggaattatttaaattatttgatacagcactcattttggcttcagaaaagggatatatagaaatagttaaattacttcttgacaaaaaaggtattgatttcaatgcaagaaatgtttatttaattattataaaattaatttcaataattttttgttttaaaataatgtttggaaattactcaaattgtttaacacagctcttattttagcatctgaaaagggatacacagaaatagtaaaattacttcttgaacaaaacggaatagatatcaatgttaaagacatatatttgattgatttgatttttcatttaataatttgatatttcaaaataatttttggagattattaaaattatttaaaacaagtttgattttggcagcagaaaatggtcatacagaaactgttaaattacttcttgaacaagaaggaattgatattaatgcgaaagataattagttatcttatttaaactttatttaaataatttgacattaaaatataatatttggaaattatataaaatatttagaacagcacttatgtttgcatctgataatggtcataaagacatagttcaaatgcttcttttacaagaaaaaattgaagttaattctaaagaaatttatttctgtcacaaaaattttcagaaaatactttgctatttcaaacaaatttatggaaattattcaaattattttatacagcacttatgtttgcatcttcaagcggtaaaacagaaatagttgaaatactacttaaacaaaaaacaattgacatcaatgctatagatgtttacatgatttaattgatttttcatgtaataatttgaaatataataataacatttggaaataatttaaactacttcaaactgcacttataaaagcatctgaaagaaatcatacgataatagttaagttacttcttgaaaataaaattgatattaacattagagatgttaacttgttttatttaaattttatagaaataatttgaaattacaaaataatatttggaatattttttaaataaattggagctcactaatttatgcatcatataatggctttacagagatagttaaattacttcttgcacaagaaggaattgatattaatgcgaaaaacatttattactttaatttaatgtttaatttaataatttgaaatattataatatcatttggaattaattcatgttaattcaaacagcacttatgaaagcatctgaaaaaaatcatactgaaatagttaagttacttctggaaaatgaaggaattaatattaatgatagagatgttgtttttgtttatttaaattttatttaaataatttgaaattacaaaataatatttggaatattttccaaagttattggaatgcattaatttatgcttcatatgatggtaatatagaaacagttaaattacttcttgaacaaaaaggaattgatatcaatgctatagatttttatttgttttgtttgattttttatttggtaatttaaaatattataaaaaaattcggaattaatataaattaattcaaacagcactaatttgtgcttcttcaaattgtaaaatcgaaatagttagattacttcttgaacaaacagaaattgatatcaattctaaagatatttactttatttcatatgtaatttattttaattatttggaattttgaaataatatttggaaattgtttaaatatttttggactgcacttatgattgcatctgaagaaggttatacagaaatagttaaattattaatccaacaaaaaggaatcgatattaatgccgttgattatgtttacgtattctgtttaatttttatttaaatactttggaattaaaaaataatatttggaaattgtttaagcaattttggactgcattaatttgcgcatcttataatgggcatgttaatatcgttaaattgcttgttgaacaaaaaggaattgatattaatatattagatattaatttattatatttaaaatttgttttaataatataatatttcacaataatgcatgaaaattgttgataatttttgaaacagcacttatgattgcttctgaaacaggacacaacgaaatagtaaaaatactaattgaacatggaggaattgaaatagctgataaaaataactaactcaatattacggatcgttaatagatataataaaaattaatataaataaattctttttgatatattttatcaaaacctaattcttatcatttaaacttataaaaaaaaaaagaaaatccattaaacaaaaactttttacttatattaatattaataaattcctaaaacattaacatattattaagatatcttaaactgaagagatatatttgttgtaaaactttttatatatgaatagaaaaaatcttaaagtaatcaaaaattctatgaaaaccaaattcatttgactttcaacatgcgcaattccaataatatttcattttattatcaacctaacaaaaacaaaaaaattttatgaaatttctaaagtaaaaataaacaactctttataataaatacaatcaaattttgaaaaattcctttttaatacataattaaatgatttctttgtactaaaaaaatgatcattaactcatattatctttcttattattttttgtgataattctatcgtcgacgatcaaaaccataacaattttcaaatataattcaaatttcaatttattgcagctttacaggaaattacataaaatgagcttcttcaaggttcatcgttatctcgtgggtcagaagattggatccggctcattttcatccatccggctctgctttaaatcagccggtgaacatccactggttgcaaaaatcacatccaaaaaagtcgctgcctctttagtagatggcaatagaatagatttcaacgagaaaactctttctcctctactttgccatccaaacattttagccattcacgaagttattgaaggaaaatcacaaacattccaaatatcagatctttatgaaaaaggtgaccttctccagctccttaggacatctgggctatcaaagcaagtcataatttcaatagcagatcaaatccttgcagctatcgaatatctacatgagaatcatatttgtcaccgagacataaaactagaaaatgtactcctcacagataaaatgggcgttagactttcagaccttggccttgcatatgtcacttttgatgataaagtaacagggaaatgcggctcttatcaatacgttgcccctgaggttcttacccaacgcttttatgatggctttaaagccgatatatggagttgcggggttcttttcttctcaattttctcgaaacgatttccatacaaagagaatgagcctccaaccaacatcaaattcgacgcgctccccgctgacgtccgcccgctgatatcggctatgcttaacatagatccaaaaaaacgtccgacggccaaagagtgccgtaaatttgatgttttcaattcaattccagttcgaacccctccttatatgtcaccgtttgattttgacgtgccaattcaacacccaaaaatggatgttgtctcaagagtttcacaattgattagcgttgcaccgaatgaagttaataatcaattgtcaaagcctgaaccatgtatcgagaaattactttattatttgttcttccaaaaattacaatcaagacatctattcaagagatttaaatcatgtccaattaataacaaaaaagtattcgatactttcatcgagaaaaaatatagagctcatagttgtgctttgatgaaggcaattaatggatttttgttaccttttaattgctgtatatcaacagctgcaactttaaatagaactattgtattgaaccaagttgatgatgattcttcggcttcttttgatctagtggattgtgatgatttcgaatgttgtatactaacgttgacagtaagaaaggaatgcagtcttttccctacgaaattacttgcatacttagatagcatgtttgagttcgttgggtaatatgaatatgagccaaaagacagaatataaatgtaagaatagagaactagcaatgattttttgatgtttatgataatttgtgttagaacatcaaaatgtttgatgtgaacaataccttaacggtcgcttatataattttggtttttatttcctcgaattgggataatttatatttcatataaatttaattttgtttcactgttaaaaattatataatatttttttttatttttgttttgcaaaagccatattttatttataagtctggatatatttgcaaaagtactaaaggatggacgaaggattcctttacattcaattttgattattttcttaaaactttagggtaagattatttttaaagaatagcaatcaatcgggaccgcaaattttcaaaattttcattttcgaatcgatacatttaaataataacatataagggacatttttttgggcaattctatttttaattatatttataaaagtttcatttaatgacttaatttcacttgatttatttaaaattgatattaataatgaatcagaaacattacaaataatttcattttgattatataataaaattgattcatcataataaaataacgaattttgttttatattaattttaggtattttcatatttaacttattatatatcaaaatgagatcagaatatataaaaggcggaactaaatggattttaatttgtggaaactcattaatttttatttgtttttcgattattaatatttttaatatgttaataaaagtatttaatgaatttgaagtaataatttgatcaaattcaaaataattattcgaataattataaatatttttatgttcgaaatatttcgaatcatttaatatataaaatatttgctcataaagtaaattataatcactttcaggtataacatttataattgacttagaaataagtcttctaattcttgacgacttattatcaatatgttttattaacaagtttaatatttcagtttcttttttagtcgaattaaataatgataaaacagttatcgcaaagtatatagtatgattattaatagactttaatgcattaattaatatttctttagagtttggaaacttttggaaaaatatcattaaatttattgtcttttcacttcgcttccaaagcttttgtaataaagtcgcaaaacataagtttaatgcacttatgaagtcccaacaatggaatttttcggatgtttcgaatattatttggaatatttttggtaaaaatgtttcttcataagaagaagtaattttatctttgagaacaaatcgaataacatttaatgtgtttgtagcttcgatttcattcgaagtattttttaataagttaattaaagcgtttaatattttaatttgattttgatttaagttaactttatcattgtttttgttattatatattctaattaatgataaagctacaaatggtaatgaagcacttcttcgcatattttccatatcgaaattacttaaaattgttaataattgcgttgtataattattaagttttgtttgagaaatttcgatattgtttattaacttaaataatgattcaaagacaaattgtccatgatatgaaattccgacatctttcgtattaataaaaacatcgaaaaatttgtcaacaatttcatttagaaatgtttcagtgaaaacaattgttttatcctttaaaaagcgctcaagagtatgaatagtttcggaattattttcttttaattcattaatatatttatttaatgtttcctcattatttttaacgttaattttattatcattttgttctttaaatccaaaattacgtaaaatttccgcttttttgttatcttttttatatatttcattatatattatattgtatacatttttactaaatttcgtcgatggatcaaataacaatgaatatattgaatgaagtaatgtttcattataaatatttgggaaatgtttccaaattattaaagttaaatcaaatccaaattttcgttgtgttgttactgaatcaggtgccattaaataaacaaattcatttaaaaatgagtttaatacattatgaacaacttctttattcgaaaaggatttaaatatattaataaaatcattaaataaattgaatataatttgtatatgtttcgatgaatcacaataaatcattttaatgaaatattttgttattaattttaataacttttcagaagctaaaaaatctgttttaagtaatacttgaaatgataaaagttttaagtcataattacaatgtcgaattccatactttaaatcattatatatatcataattcggccatttcgattttggtattgttgaaagtgtttctaatcgtagccaaacttttatagaattcgatttaatatcattaaataattcaaatgcttttgttatcatttgtggctgtaagttataaaatggctgaaatatcgaaacaaatgttttaaagttataattatcatcatgttgaaccgaatattcaatgattgacttaattaaattttcggattttaatttgttgttcttacaaaatgatttaatacatttgttaactaatgagcaatcagatgcatcttgtgatagctcaattaactcatttgtaatcgatggaaaatcagtataaaatgttataatgtcgggaagtacaaaagatttgaaatgtgtttgatatgaaagttgttcaactgataaatataattgtttccctaattgatttaacgttttgtcttttttggagcgcttaataatggataaatataaattctctaaggaattatgtatatttgcatttcgtgaatcaaagtcaagaatcataaaagcaatcgaattggaaacaaatgattcaaagtcttgaatataattggtcaaacgcattaatgacacatatccaaagattttgtcttcaatagaagattcggacgatagaaaattgagaagtttattgtatattgaatttgtgatttcggatttttctggaattcctgagactgttattgataaaaacaaataaaaacagttcctattgagtttagatttaagcatcaataataatggagattttgtttcagaatatagattaagaatatcattgatgttaataatagttagaatgatttctgaaagggctcttgttaaagaataaatagtttcaaagttagtttcattagaaataacatcaagaatatatgagcctaaaattgaatatgaatttgtttcaacatgtgggaaatgatttatgcctgaactaatgggaattggcgcttgttgtgatcttaaatatggttcaattaatttagaacatgatggaatatcttttccagatgatataaaaacaagaaattcttcattctttgattcaaaaaatacttcctttccaaatattaatatgaaattattggccgattggaaatttggatttgatgacttccaaaatgatttttcgattgtttcaatacaaatattctggaattccttcaatttatttatttttcgcattatgttttttacttttgttgacatagtttgaagaacaaagaatgagttttctccgcaaatgcgatctgctaaaatattcattgttaaattctcgttttcattaagagagtctctgaggaaatcaacaaacatttgtacatttttagttgtaatttcttcatgttctaaaaaaaaagttttcaattgttccattgcgaccaacagaaaaaagacaatttaaaagttcacaaattattttgccatattaaaaattaattcccagtaattcctctaaatgtttataaaatttataaattaaattatatttttatattatacgcgtaatgtaaaagttatgtttcccataattttcggtaataatcacaattatttatttttatcaataattacaacaatgtcaaaaaataaccactcagtctaacatgatggataaaaatttttatcatcccatgatgggatgtggcttggttgtgagaaggagaaatcaatttaataaaaaataaagaaagatcatgtggttatagttgaaaagtattgtataggttgcatgctacataacaaaataattcaaacaaaaatgaagaacaaaaaatactttaattgaggtgaaatcaacaatatcgttgcaagaattcttggtgttgaaatttcacctaaaaatcatcgatgatttgaacaataaccactttttgctttcaaattttgaataattttgtttattgcaaagaattaacaaagtcatttattgaattatcgggtaaaaccatccaaactcggtgctttcaaattattgaattattgttgttgttgacaaaatataacatttcacaaacaaagatgcctccaccaggacctccacatcatcacccaggaccacctcatcaccacccaccaggacctcctccattccatcatccacctccaccacatccagggttccgtcctcctcctccacctcctccagtttatcatcatccaccaccaccacctcctccaccagtttatcatcatccgccaccacctcctccaccagtttatcatcacccacctccaccaccacctggacctttcttccatccacctccacctccaccaccacctggacctttcttccatccaccgccacctccaggaccacctcgccgttggtaaagcgtttaatagtaaaaaatacaaatgtactaaatcttttaagaaggacacaatcaattgagtttcgatactgaataatattactccaaaatcaaagaataaggactatctggagatgtcatactaaggtttgtaatatctggattgcaatttttcaataaatcagctgatttgcatattttcgatatttatttggatgaattatagttaataataagtgtagtagatagtaaaaataagcttttaaaattatatttaagtgggaaaaaatcatgcttgaaatattttcaatcacataatatggctttttagtaatgaaccggactgttaatataaaaaataattacatattataaaaatttagaagtgttatatttatttttaaccaaaatatatgcaacctaagagaaaaaaatattttttaggtgtaaagcatttttatcgttcggattcaatttttcaaatactcagaccatttatgaattcaaattaatgttttcgttttaagatattttggtctgattatgcaagtttttacataatttcatgaaataaatcccaatttcaccatcattacggcatttctcagaaagttaacaatatatcgcaaaatgttgtgttcgtttggttaaatttcaattttgaaaaggaaataatgttaaactatcaaataaatattgatgataaatatttttgtgtaaaaagattgcaaaatcgttccctgatgaactcaaaagtcgagaaaatgaattcaaaacgaactttaaacaattcctggatgtcgtttttgtaatctttttgaaacactcaatttcccaatgacttttgttgtatcttctatagaaatatacataataattactcatgaaaccactaaacacagtgccataccataagcaaaacatgaaaaaagcgaatatcaaaataaataaattcgaaaaatttgtcgcaaattgtgtttcaaattcattcatttatttaccacatacaacaactatcccacgaggtaacatttgtactcagctaatgttctgttttaaaatgttaattaaaattcataaaagttaaattcaattcaattggcttatttatgcaattgggacgcaggccattgatgcaacaccgcattggttgttcttgtccttgatcatgcggatgtaaccatcttcaccccatgatgtgccccatgagttacgaacgatccagtagtttgtagcaccatctgagccataaccaacagcagcaacaccgtgatcgagggatgttgatgagcagcgtgtttcatcatagataccactgctgtagagttggaagctgtagtgtgaagcatcgatagcaatgcatgttgggccattgtttgtaaccttagcagcaagatcatcttcatcatatgaagcaacttcgaggtagtctgagattgaaccaacagcctttgaagcatcgaacttgcatgagccttggacagccttgtatggatagtcatcttcgagcatgaatttaccatcttggtacctgataacatagtcataagcggatgtcatgagaccaccattgcagccatagcatgttgtaacgcaatcaacaaggttttgttctgagaaggagaggagtttgcctgtctttaagaagtaagcaccttcagcaccagcgatagcagagaatgcccagcatgaaccgcagctagcttggtccttgatatcattaacagcacccttttgacgccagtcgagggaaccatcgaccttgaagttggactttttagccttgctagccttgatttgtggaacaaatccaaggagtgatttgtattcagatggtgtgtaagcagcaaacttgttcatggcaagcttgaatgagtgggcttggttgtgttcttggacaagacgttggttagccatccagacaccgaaacgtgtttgatattcatcgccagtgaagaattggtttgtggaacgcatccatgaaacgaaggatttttcttcgtgtgcttggtagtatgccgagaaggcaagagaaacaagcaagtgtaacattttgtgatgtcaacagttgttgttttttcctcaaccgatgctctcaatatttgaataatttcagttaactgaaaatgattctgaaaattgaacgcaaacaaattcgttccacgttgttttgacatcgtttttaaaactggaattatacactaattactaaatgtatagagatattttttgggttatcattttgttattataatatagaatattttatttgctataaaatatgtttctcttaaatatttattgggaaagttaaaaagaaaaaaatatctggatcgtttaaggtgaacgtttaaaaatttaaagtggtcggtttaagccaacagtggaaaccgtcgaaattttctgtgttgattttgaagtaaaatatttacgaagcatttcactgtttcacaaaacaaccatagatcgtttcaaggaccattaacctaaaaaagttattggacaattagcgttaacaccgaaagtataatttcaaaatatgtatgtttaaataaataacaaatcaacgcactgtaattcatatttcttcacagtttggtcctggacaccaaaaaatccttggttttgtgttagtttttttgaatctattatttatatagttgtgaagttgacattcttttggaagcatttggagttcttttgtgcggttttcgaagtcggcttctgtaacaaattcttggttttgaaattcgtttttttgacattcatcaaaaaaagtttgagcggctttcaaagtcttataagagacataacaagaatttaattctggatcaagtaataatccgtttatttgtccataagactctaattttgatctaaagagtagaatgtcatctatttgaggaagttggaatttaatgcaacacgatgccatgatttttccatttgcagatgtacggtgtgtagaagacggtgattgaatttcgaaccagaattggtataatctatcaacaagctcatgtttttttcctgtagaatccaaacctaactgtgttaaaatttcttgcagctcgctgacattgtatttgcgtaattgttctcgtgtgagagtatctgtttccaagaggtaactccaactcatggtgtacgtttattatttggaagaaaacttttataagaaaaaagttaacatctcttagactccatattatttaaaactacttgttaattgaactttctgtttcttttactttggcacggtatatgttattaagcaatttatttttcgatgattcatatgaaacatttgcattgtcatgtttcgtcacattgttacacattggttgtggtgtatttttgttaccatatttttattactcgaaagaactatttcgctttatgggggtgtttcttttctatttttatttggtcaatgaacgaagcttcgttggcttatgaagcactcgaagctcaacttgataatataataccttacacagctattaaatatgacgaacagacatattgggaagaaaagtatttagcaaacaatgatgaagagtttgaatggtatctcgattgggagcaattcaaagatagtattgcaaaattccttcgtaaaggaggagcagcacttgatgttggttgtggtaattcatctttagcagcagatttgcaaaaagatttttttcagaaagtttatggaatagatatttcacaaaatgtaattaaacaaatgaaggaaacttaccaaggcaacaacaacttagtgtggatagttggaaatattttaaaaaccaatttcccttcaaattcatttgatgcaatctttgaaaaaggaacaattgattcattactctgttccaaattcaacacaaaaaaagctaaacatgcaattgcagaaatttcacgaatcttaaagccttcaggtgttttcttttctatttcacatggagagccacaatttcgagaagctcttttcaagacacaagaaaatctaataaccttagttcaaacagaaaaagtgcttaagccatctggaagtggctactactatatatacattttacggaaattatagatatttttacattttttctttatttataattaaatctttctttaatgggtttttaatattttttctgaaaatcaatacaataattaaaatttaaatctttaatgcaaatagacagatggggatgaatgtattgactttctataaaacatttcattaaaaaaccagaggtactatggccgagtggtctaaggcgatggattcaagtcccattaccgagaggtgcgtgggttcgaaccccactggtaccattttttgatttttttagtgttaaaggattttttttaacaagtatgttgtttaactctaggaagttactaagattcgattcaacttgcattttcttttgtaagaagttgtaacaattaaaattgattttatttttgatataaattcgatgaatttaaatcgcaattttttaataaaaacaaaggttgccttgtaacatatggagttcattcaacaaataaaacaatttttattgttcattttgtaagcagtatccccatatggtccaacagtgagaattgacaggactctgtttgaattccaagaccagagctcaaatgacagacgttattcagccatcaaacgaacagccagcaactcctgacacatccaaatggccattgcttcttaaaaactattccaatcttcaatgtaaaaccaattttttcacaccaattggaagtggccattcaccattaaaacgaccaattcgtgaacatcttaaatatggtgttctcaatcttgacaagccatccaatccatcatcccatgaaattgtttcctgggtcaaacaaatattacaagttgaaaagaccggacattcaggcacactagatcccaaagtcacaggtgttcttattatctgtttagagcgtgccacacgtattgccaaagcccaacaaaatgccggtaaagagtatgttgctgttctcaagttatttgatcatgtcactttacctgatcttgagaatgctgttaaattccttacaggccgtgtatatcaatgtccaccattaatatcagctgtcaagaaagaacttcgtgttcgaaatatatacaaagatgaagttatagaatttgaccaagagaataatttagccattctcaaagtatcgtgtgaagcaggcacatacattcgagttttatgtgaacatttagggttgatcttaggagttggtggtgaaatggcagagctacgacgtacgcgcacagggcacatcacagagaacaccggcatgaacacaatgtacgatgtcttagatgccaaatggctcttagacaccaaaggcgacgaatcgtatcttcgccgagtcgtcaagccattagaatggatgttaactcaatacaaacgaattgtaatgaaggactcatcagtcgacgcagtgtgtcacggcgctaaagttatgattcctggtatacttcgatttgagaacggaatcgaagttgacgaagttgttgtgatcataacgacgaaaggagaagcaatcgcattggggattgcgttaatgacgacagagcaaatgtacaatagtgaccatgggttcgctgcaaagattaagcgagtcatcatggacagaggcacatatccgaagtgttggggcaagggcccagtcgcacaggagaagaagaggatgataaaggcaggactgctcaacgagaaggggaagccaaacgagaaaacacccgcaaattgggtaaggaattacctcgaagggaaactgaatcaatgattttaataaagaaattattcaaagtgaaaattcgtttaagtaaattttaaatttaaattttgttgaagttctgttttgataaatgaatagaatacaaaataaaaattatatccatatcgaacatgtgttcagtgttatgcaattgcatcaaaaatttcttgaaaatttatattttgctgaagttctgattttgatatattagtgcccatatttaacaggttagcagtgatattatgcagctaattaaaaacacaacatatctcatgataaaaatattattcaaattataaatttaagtttcaccgatttttttttacttaaataagcaaatgtttttatgttaaatatgattaatgaatttttcttttttgaaatcatcagcaaatggatcttcatcaatattattcgttgatgttcccattgcaaatgtattttctttttcattttgattttcttcgaaactttttgcttcttgttcattacttatttgtttcttattatgaattcgcatcaaaactatgataagtattgcaattattacaattacgacaactgcaacgcaaacacttataattataattgtgtttctattatcatcattaatattttcattttgatatataattgtaaagaaattactataatatatgtaataagtcgaatatacaacaacagtatattcgtaataaataaattcactcaaaacataagttaatgccgaattaaaaatagaaacagaaaatgaattcgaatacgtcgaattataaatttttattgtttgcgtaatagataatgattgtgttaatgttattgtattcgttaatgttataccattcgaatatgaaaaagtaaatgaattcgaaacaacaaatgaaatttcatatgactttgttagtgtattcgtcttagtgaatgtattcgacttagtgaacgtattcgactgagtaaatgtgtttgagtatgtgttcgatcgtgtgaacgattgcgtcggtgggagacattcatcaatgacttttcctttactgacttttataccgcagaatgtttggccgttatatgaatcgattgtcatgacacttctgattaaattgttgttatcaaatacattcgatgtattcgttgggactgtttcgccataataaaaaatacatgtgagattgcagcatgatgcaaatgctttgcttccaactgacgttatattgcatggaatttcaatgttccttaatgaaatacaattacagaatgcattaatatcaattacactgacatttgttgggaatgtatatgtttcgtttgttttcccgcatggataacatataattttagtgacgtttttgttatataaaatcccatcttcgttataattgcaataatttgcgttttcgctggaaactttaatcatttgaaggttggtacaaaattcaaatgaagaaattccaattcctgttactttattgggaattgtaatatttactaatgatgtgcaatatgaaaatgcataagttccaattctttccacattttctccaataaaaactattctcaaattagaacatgatgaaaatacataatttccaatttctgttactttgtttggaattgtaatatttactaatgatgtgcaatatgaaaatacagaagttccaattgttgttacattttctccaataaaaactattatcaaattagaacatgaataaaatgcataaattctaatgtctgttactttgtttggaattgtaatatttactaatgatgtgcaatatgaaaatacagaaattccaattgttgttacattttctccaataaaaactattctcaaattagaacatgatgaaaatgcagaatttccaattaaagtgattgattcattcattttgatactttccaaattattccactcataaaaacaattatctccaattccagtgatggaacctccaataataacatgaattgtttcatttttatataacattctattatcataatctgttgaatttgaaatagtaagtgttttagttgaattatcaaaagttgagaaacattttgtgaaaaatgtaaaaagaaaaatcaaacaaaaattttcatttcgatgtattttatggaatttatatagtaaaaaagatgtaattgaacaaaaattatataaaagcaaaaagataaaagataaaatcaaataaatgacattgattttaaagatacaaaaattgttttcttttaaaataatattaaaaataaaatcaaatatttgagatttgaaaattttatgatttgataaatgagaatgaaaaggtaatgaatgggcatatgcttggttgaaataaaaagaacaatttgttaaaaaaattaaagggaaatataatttgttatgaaaatttaaagattgatgataatcataaatcaaactgttgaattttttggaggaagtatgattaaatgacaaaagcatgttcctaagaggcgataggatctgcccttttttgatttggtgtagttgatattgaaaatttaaatgataattacaaataatattgaaaatagttttacttagagtgataacatagaagaaggtatgggaaagcgatgtccttgtagcaagatatgatgttttattcgtgtgtttcaaaatgttcgttctggtttgaaatgacataaagagttgcggtcgtcagtttcaggtttcttggttacagtaactgaaattgacaatttgcaggttccaaatatgtaaattttttttatatatcgaaatataataatgaataaaaaattttgcctttgcttgctgctttgctattcagaacgtgcattggtttagaagatatttttgttttaattgcggaatatttgaatacaaaacaacgactgaacccatcctaaaaaactaaggaattgatagaattcgtttagtttacataagtaaacattttaatactcactttttgataaatatgtcacttttatacaataaaacggttatgatccactttgcgcacgaccgtttagcaaagattgaatttctgccattggttgcatcgacttatattttttttgatgtctacgggaaatttagcagacccaacatcaagtgcaaaagacaaaatgcatctattacagaaatacaattcgaatttgagtttaacttcacgattttgaacatagtttacaattcaaagcgaaattggaaaaggaatgaatggaactgattccccagatattagcaattcttctgggaaaagttatggataaaacccattaaaaatatttcttttgataatgtttttaatgaaatctagatattatcacaaatttcgcaccccaatgttatcaaatgttttgacatatgatttgagcacaatccacaaaaggacaacatatcattatatattcaattggagttatgatcaaacttcctaaatttgatatttatagccttggaatcattttccccgaagtttttggttcatttaatactcaaatgtcgaaaataaaaactataaaacaacttcaggacaacggcgaagcgaacataaatgctgccgaaaaaccaaaatcacttatcagcaaaatgactgataaggaatcaagcaaaagaccaaactctgacaaagttatcagtgcacttgagtctttgctttaaaataaataaattaatatgaaaaaccaattaattaatgtattggtaaaaaatgactattaggaaaatattcctaaagatataaaaaccaatttttatattggatatgtttttttaatacaaacttttttttttaaattattttttatttcgaaatgaaattgtgtaaatgtgttagaaattcttttgattttctggccgaagaatcgataaagagagcggatatatgataaacttcttaacataatattcatttctcagatttttggatcttaaaacattaatttgcaattcatgaagttaaagattgtacttaattaaacaatttcgatcatgtacagatttagtacaattattattgtagaaaatgtcaaaagcattaacgatgatacatttgatatctgtggacagcttagatgtatttattatcatggtaaatcagaaccaaacatttcatcaccagcttttacatgtattgaatcaataaatgttatgtcattatactattataacgatataacatttggtccttttaatgttacaaaagaaacaactgttgaaggatatattacttggtcaacacaaactttcacacaatcaaatttattttctaattcaaatatttttttcagatcaaatgcattcacacacgaatacatttactctgtccaacatattcataaaatcaaatacatttacaacatcattgcaagtatgtcaatatttttcaataacatacgcataataaagaagttaaatgttaattataaacatacaaattatataaaaacgaaaattatttcatgaattcatttattaatgtttaacatttatcaaagtactttctatttaaagaaattattcacatatcatttttatagccattggtcctggtcttccaacacgagttcattatattcctgatttacttcatctgatctcatatcgcttccagttgaatttttagtttcgaattttatcgctgttgattcgctgttacttttctttgatttcttcacaaggaatatgataattcccataatcagcaaaactgcaattattgtgccgcagataatacctatcaaagccttttgagaaataccatttccaacaggatttatgacgtcgataattgtgaagaaattcgaataaaaactatataacgtcgaataacgagtcacaatatattcataataaattaaatctgttctgacatatgtactactaactccaattaaagtcaaaacatatgaataagaatatgtaccagaaattgtaacagtttcagtgatggaatatgaattcgtaaacgaaagtgtcagcgttacattcgaaggtaataatgtattcgactgagtaaatgtattcgtcttagtgaatgtattcgacttagtgaacgtattcgactgagtaaatgtgtttgagtatgtgttcgatcgtgtgaacgattgcgtcggtgggagacattcatcaatgacttttcctttactgacttttataccgcagaatgtttggccgttatatgaatcgattgtcaggacacttctgattaaattgttgtcatcaggtacattcgatgtattcgttgggactgtaaaaaaaaaaaaaaaaatacatgtgagattgcagcatgatgcaaatgctttgcttccaactgacgttatattgcatggaatttcaatgttccttaatgaaatacaattacagtatgcattaatatcaataacactggcatttgttgggaatgtatatgtttcgtttgttttcccgcatggataacatataattttagtgacgtttttgttatataaaatcccatcttcgttataattgcaataatttgcattttcgctggaaactttaatcatttgaaggttggtacaaaattcaaatgaagaaattccaattcctgttactttattgggaattgtaatatttactaatgatgtgcaatatgaaaatgcataagttccaattctttccacattttctccaataaaaactattctcaaattagaacatgatgaaaatacataatttccaatttctgttactttattgggaattgtaatatttattaatgatgtgcaatatgaaaatgcagaagttccaattctttccacattttctccaataaaaactattatcaaattagaacatgatgaaaatacataatctccaattgttattactttgtttggaattgtaatatttattaatgatgtgcaatatgaaaataaataagttccaattctttccacattttctccaataaaaactattctcaaattagaacatgatgaaaatacataatttccaatttctgttactttgtttggaattgtaatatttactaatgatgtgcaatatgaaaatacagaaattccaattgttgttacattttctccaattaaaactattctcaaattagaacatgatgaaaatgcagaatttccaattaaagtgattgattcattcattttgatactttccaaattattccactcataaaaacaattatctccaattccagtgatggaacctccaataataacatgaattgtttcatttttatataacattctattatcataatctgttgaatttgaaatagtaagtgttttagttgagttatcaaaagttgagaaaccatttgcgaacagtaaaacaaaaaacactaaaaacaaattaatgtttttatgtcgcaaaaaagttttcgataagtgaaatttaatcaaaaacacaataaatgaaactatataaatgttatcatttctaaaaaatgaaaaattgctttcatttaatgaaaaaaatttaatgaatttatgaatttttgcccaaaaaatgaaaatttctttttttgtttgcgttgataataatatgttttttgatcgcataagatcaataaggtatgtttggtaacatgttttttttgattttaccaaaatgttagcaggttgttgatcatcaaatgtgttgaaatttttgttgttaaaaagatgattaaatggtgataaagaacttgtattagtagacgcaaaattacattggttttcaatttgattttgttgctggaattgtaaatgtttattaaaaacaaaggtgaaaactattttacttataaaaatgagaagaataaagtcttgggtttttgaagctcttaaaacaaaatgatgaggtttgataaagtacttcaaaattgttgttctgtttgggtgtgacatggaagatcgtagtctatcgtttctgatcgtttagtcaatgcacagttcataacagctccaaaattatgattttttgtatgatgtcgatatatgataaaaaataaaaaaatgagatttttcgagttctacctatttcgtgagatctattttgttttggaagatattcttgttttagtttggtgataattgaatagaaaattatggaaacataaaaaaggtttgtgaattgactaactttgttcgaattttactgcaacaaaggtataaagcggttttgacattttgacctttagctaactaataaaataaaatattatattctagttttctttccggaagactcaagtatttttggaaattatcctgatgattttgagatattttaattttaaaatttttttgattcaattatttttaagattacattttttctctatatcatcaaaaatattttgtttgattttgctacaacgggtagttatcattcatcagaacgagacatcttgagtcattaaaatgatttttaggtaagatttttcgattagaaaaaaaaagcgaacgttaattctctccaatatctaacacacttagtcaaaaacatatgaaaatcataaaacatcaaagaatattaataagcaaaaaacaattatgtagtcaatttttgctttaagaatatcggatgcaaaatttattaaatatcttctataattcatacaattcctgaatttttttaaagaattatattatcgaatagaaggattaaattattcatttgtattttttacaaaaaattcaaaatgttaatcttctacaattttgatagaaatgaatttataaattattttatccataactccataataatgaacattttccaatatatttttgtttaacattctaccgtacggaaaaaaggttttacatcgacgccaaaaacgaacgaatttattaaacaatttcttttatttctttataaaattccaaaccacaaattatcatttccacgatctaattcttttgtcatattttccacaaattcccaaaatcatcgaaaccgacgagcagaatattcccaagtatttcatctcagcgttcgagagcaaagtttccaagaacgagctcttcaagaagaagtgttctatgaactttgcgattccataaatatgttttactctcgcagacaccaaaacccacagtatgaagttattaatttggatattttcacaatataattccaactcagtcaaaatgtcaatcgattccactacgtaataaagaatgacagctataccagagttgggctgaatgtgtccgagtaagtcacttgctctttgcaagtacttttctcttaatacgaattgttctttacaattcgaaagtatttcattaataatttcgtcgtgattgttttcgattattgttgagatgatcactgacttcttccaaacgctttgatcacttaatacgaatctacgaaatgatacgtgatcagtcatcaaaaaaaacaatattcgatatattaatgaacattgttgtggtaatagtttataaggctctaatacattcgatgcgatttcttttaagtccaaaaatgattgcttaaggatttcagtgtttgataagaagttaatacttttcgacattacgattttgaagcaatagtttaagtcattacgtattaaatatcgtgcaacattcgataacatataaccttgtacattctcacgcattttcttcacagcggataatgatgatgtaatacgttgataatgtattcgtaatgccgacgttttatcagcggaattcattgcatatgaattacgttgattaatgatttcatatatcttaggaaataatgatgagattgatttagtgttattaatcgcataataaaataatgcatccgattgtgttaataatttctcggagacaaaatacggagcaacaattcgcatcttctcaaagaactctttcgcattcttcggcttaaatgatgatatacttactgcaaatgatgggaaattagcaatgatgtcacagaagtaattctcgaatggaaagttaagtaaattcgttgtgctaacttcttcatcaaatgagaaaagtgatttagttcggactgatttagctgcaattgttacttctttttgtcgtaacaatacaattttaaaatgttcattaatatattcgttcttctctggaatgttatttaagagatctaaaatcttttcgaagtttttgttgttgactttgttcttagggattgaaagcgctgctaaatgtaatacacaaagatctcgagcagtaattactaactcttttggaaagttcggattcgtatataaaagttcacattctgatattaattgatcatgacgtttcttagtgtttgttaacgcgtctaaaaatatgtcgaaattaatcttttcatacgcaggtattaatgataatacatgcgtaagtgggttttgaaagatgtctaaacaatttcgatatgatgaaatcgaatatttcccatacttagatcgaaagactgctgttatatctcgcgttggtgaccattctacattgcctggatgccatggtaacaatcctaataattgtggattgtcaagggcacgacagacaaatgattcaaaaaataataacatgcatttttcattgccattctcaaattgtcggataaaccgaaaaagttggggtaccccaggaggaagcaaatccatacagcgaataagcgagtcaaaacataaaagtgcattgtcgcaaataaccgtccaatattccatggcagcataagtgttgctttcagaattggtcgaaaattgattacgaagatttcgtaggcgtgataacgaatgaagaatagtaacaacatgactaagagcacattgaagatatgaaaatgatgctccattaaacaaatatgaagtaacaaaagatgaaagtggttcaagcatggaaagaattttggaaggtgaaaaccgtggaggattaagaacattttctttgacattaaattggatttgtgactttcgttcaaattgtaatatggctaattgtctaagtgtaagaaataaaagatgatcttcttctttacaccagccttgttggaaaatactaagaaataaggacgaaatgcgagtgattttttgtggatatttttgagaataagaataaagacattccgcaagtatatcaagatgtgaccgaagaaatgaaataaatgtaatatagtgatttaaaacatttgagtcaaaaaaagatggacaatactctagagcagaaaatgaaagtttttcatgaagctcttgggatcttaatatccctttttcatagcctgttttatcgcaaagaaagcgatatcggattaaactcagaagtcttaattcactaattaaatcattcgaataagaaagtgtttcttctgttaactgatcatgtttagcttgttgagaatttaaaagttgttcaactgtataaaggtttgcttgtatttcagctaactgctttaattcttctacttcttcggacattacttgaaaaattgaatgaaaccgccataaaatgtgcgaacaacacgcaagaaagagcattacagtaaaaatattaaggcacaaatccaattcctcataatatctcattctaaaaacaatgttaaaatgtggttataaaagtgaataagtaaatacaatacaatagtcaaaaaatattttcttcaatagaaaaacaaagtgaccacaatacgtttcgtgtggatttagatacaaaattggaatgattgttaacgaaaaagatattttatgttctttactaagaagcttaagaaacgataaaaccgtttgaatgcaaaaccgctcattcacaatcaaaaagtaatccaatttacatcaaaatatttttttacaaacaaaatatcttaactcaagagaaggcgtaatggagtaacttaattccaggatcccctttatctttttctaagaacgggtaccgaattccgcattcttcttctttaggcctcatttgaagtaccattttttcgaattctttaaattccattgtttttaatacttcaccatttaataaaattcttactaaatgagaatttggattttcgtttttttctaagacttcaaacgcaacaaatttcccaaattcaggaaatgttactgtctcatttagagaagctaaaagcgaaactattgttaatgtatggccacatatgagcgtaaattgcgatttctttgcacctgaaagataatcgcgcatgtccaaatatatgtcagataataataatccggacgaaaaggatctaccctttgtaaggttcataacacccatatagaaatctactaaaagatttgcagattcggccataaattcattggtgaatttccctggaagatgttgattagcacaatgacgagtgatgagaagctccccaattcttgaccaatgtggaacgactgtgatattgctaatgtttttgatatgattgaggtgattattgaaaatcttcatttttttggaaaaggtggaattaggtgtttgaacatcgcgatataatgaaccaagcttgggacataaataactatttggcacgagtgattcaagctcttcgtttgcaacgaaaacatcaactggatcttctcctggtaatagcttttgagcaacggtttgaatagatgcaagacatctgttggtgtaagtggatcgaaatgaaaaagatcgcctagaatcaagagttgataataaagatttgtaatttgattgtaaataatcacctaaattattcatttgctcaatcccttggttaagtaattcacctgcacgacaagttccgcggagaaaactctgatgtggaatagttttaataataaattgatttttaaacttatgttcatcgtttaacgaatttcctcctgggtaaagccattcttctccggtgcaattccaaggtatgtcatgtcctggaattttgtcaataggtgcacgcatcccatgtttaaaaataattgaaacatgtcttacattataccctggcggtgtttctgcttgtttatataatggtgtgcaatagctctttgaataaattaataatgttaaaaaaagcattttaagcaaaggttttcttaaatggcgctttgtttctgaagaccgttaccacccttttgaaaagtgaagataactaaaagtggtatttgtaaacttcagaattatttagcttgttaaatacattaagtaaataaattgttacctcatgaatgatttggaaaccttttgttcaagtgcatgtaagtgcaaaagagtgccaaattaactttttgagaaagttttgctatagaattaaaaaaaggtttaatagcgaaacacaaaattatataaaaggatctttggtgtttacttggttcctaaattaaccttttcggaatattttcaactttttctcgagattgtgcataaataaatttatgaaaggaccttaaataaaaccaaaactcattacatgttataatgtggcgatatccttctttttggaattttaaaagtgaaaacccttttctttttcatatcacttgtcggcatgcgggggaaccaccgtctataatattttttgtaccctaaatgttcaattaaatgagttttgatagtaaatagatgatggccaaagaggtgtgctaatctttgaattgaaatatatggatcaatatcaagtcagtataaaattttttcagatatatcttcttataacggtctcccaggggactctataatctgaaggtcttttctcctctacgaatttcagaaattcaaaaatatacctgtgttttagagagcgaagaaaacaatgctaaaagaatttcataaaaagacacaaaattaaccaatcaaatttcgactttttgaatactattaccgatcgaatgatgggcatagtatggcacagaaccatatccatcaagctcacacgattttttccttggaaacaattatgaagaatttaaaatataacaaattaggcaaaagtctcaaatattttttaaaattcctttctattaataatcattttattctttgtttattttaacaaaccaattaattgttccaaatctgattttcatgggaaagaaataaaaagctttacataatggataaatgttttacttttctaagagtaatttaactatttctgtatgacctcttgaagatgcatgcataagtgctgtattaaataatttaaatgatttttaaatattattttgaaatataaattctaaataaaacaaataaatatctttagcattaatatcaattccttcttgttcaagaagtaatttaactatttctgtatgaccttctgaagatgccaaaataagtgctgttctaaataatttaaataatttccaaatattattttgaaatataaaattattaaaataaatttcatttttagcattaatatcaattccttcttgttcaaaaagtaattgaacgatttctgtatgacctttataagatgcccacataagtgctgtatcaaataatttcaataattttcaaatattattttgaaatataaaattattaaaataaattttaaataaaacaaataaattttatctttagcattaatatcaattccttcttgttcaagaagtaatttaactatttctgtataaccttcatcagatgcataaataagtgctgtattaaattatttaaataatttccaaatattattttgaaatataaattttaaataaaacaaataaatatctttagcattaatatcaatattctctttttcaagaagtaatttaactatttctgtatgaccatatttagatgcccacataagtgctgtattaaataatttaaataatttccaaatattattttgaaatataaaattattaaaataaatattaaataaaacaaataaatatctttagcattaatatcaattccttcttgttcaagaagtaatttaactatttctgtatgaccattataagatgcccacataagtgctgtccaaaataatttaaatgatttccaaatattattttgaaatattaaattattaaaataaatttcatataaaacaaataaatatctttagcattaatatcaattccttcttgttcaagaagtaatttaacgatttctgtacgaccattttcagatgctaaaataagtgatgttttaaataatttaaataattaccaaatatcattttgaaatataaaattattaaaataaatattaaataaaacaaataaatatctttagcattaatatcaattccttcttgttcaagaagtaatttaactatttctgtattaccgtaataagatgcccaaataagtgctgtataaaataatttaaataatttccaaatattatcttgaaatagaaaattattaaaataaatattaaataaaacaagcaaatatctttagcattaatatcaattccttcttgttcaataagtaatttaactatttcaatataactttttttagatgctaatattaatactgttagaaataatttaaataatttccaattattattttgaaatataaaattattaaaataaatattaaataaaacaaataaatatctttagcattaatatcaattccttcttgttcaagaagtaatttgactacttttgtctgatattttgaagatgcatgaaaaagcgctgttctaaaaaaatggaagaatttttaaattttattatcaaacaacaataaaataaattaaattttaaatataacatataaaaatcctttgaattgatatcaatttccccttgtttaaaaagtaattgaattatatcaatataaccataacgcgatgctttcattagtgcattttcaaataattttaataattcccaaaacaaatttaacaatattaaatttaacagggaagcattaatcataacaaataactatcattaattgtaacatcttttccctctttctcaataagtaattcaactatttctgtatatcgtttttcagatgccaatataagtgctgttttaaatatttgaaaaaatttccaaaaattatttccaaatttccttttaacaaatcaaatattatttctgtcattaatattaattcccttttgttcaagaagtaatttaactgttcttgtattaccattttgagttgcatacataagtgctgttgaaaatgatttaaatattttcctaatattattatgaaacataaaattattaaaacgaaaataaaacaaaataaatttaagtctttagcattaatattacttcttttctgtttaagaatatactgaacaagttcaaaattttttgattccgaagatttacataaaagatccactgtaatgatatttcttggtagaaaatgtttaacaagatacaagttaccagttcttgctgactctttgaagatagaatcattaaatcctttactggaaatgtcttctaaaaatgatagaagttcatagtttccatatttaatgcaaagaaattttaaatcattttctttttgttgagcgtattcttctattttattttcataaagatatttaaagatatcattttgatgaaatataattgctgtttcatatgcattttgaaaagagatatgattttgttcacataaatgaataatttctaaatttccacctgcaattgcatatttacctgtgttatctattttagaatcattcataagtaaatatttaaagcatttaacagcagaaaaaaatgctgcataatcaattaatgtaacattttcttgattaataaatgaacacctttcataaagtgatggtttaattctttggttaaaataaaaatcattttgtgatgatatttcttgaagtttttctatttcatcatttcgaattattttcgcaatttcatttggattttgtccttcttgaattaattgtttatgaatttcccaatcattctttgaaagttctttatagtttttcataagaaaaatatatattggatcatttttggaataaatatgtggatacttttttgatctatgatggatgaaataatttgtttttatatttttgataatatttgtttcaattattttttgttcaatcattttctcaattaaataatatgattcttgtgatttaattccacatatataatcaataaaaattgtaataacttttagataactttgttctatttcttcttttgtttgaattttttctaaatatttgatatataaatcacttaaatatgaattcttatgtgaataaaatgataaatatatcaaattacttatagtaacattaaatgaatatggaaatttcttatcaaataattttattgtttgttcaatagctaaatcaaaattttcatcagttaaattaaatatgattttttgaagtgaagtaagtaatgttaaatatacaccagaatcttttgagttcttttttgattttttagagaaatttgcattaacatcgtgaaaaacttgattatcattcataaaattaattttattataatggcttcggaggttatcggcggtttggccgtcctttttcgggatgccaactcgtttcaagaagtcaaggaagcttcgtggccaagaatcaatgggttacggtcgtgttggaaagcacaggaagtcaccaggaggttgcggtaatgctggtggtcaacatcatcaaagaacttggttcgatcgttatcacccaggatacttcggtaaggttggtatgcgccgtcttcatgtattcaagtgccgcgaatgggaaccaatcatcaatattgacaaactttggacattagttcctgaagaagttcgcaaccaagctgcttctaaaaaacaaggcgatgcagttccagtcattgattgcgttgccaatggatatttcaaagttgttggtcgtggtgaactcccacaaattccattaattgttcgtgccaaagatttctcacaatctgctgaaagaaagatcaaagctgcaggaggtgcatgtgaaaaggttcaataaacatttcagttttggctaaaacataatttgaaaagaatttatgaatttattatttacaaacaaattaacaaaactgtgaacctctgattggtgaacttatgttagcaattgctctgtcgcattcttcaataggttcatatggatgcattctgtaaaaatcttcacatgaatgaacagtgaaattaatatgtacaatagaagatgctggcgtaaataaaactcctgttggcaatatcctaacggaccttgcatttgtaattgaaaaatttgcaaaaatagattgttgaatgttatcaacatatgcccattttaaattataagtccaatcaataattccataacatcttccaactttacatgtttctaatgttattgaacatgaagaaccaaacatcaaaggaaataaaacctgatcttgatatgtttgagagaatgaacatccatcagccacaacattacattcgttacctgttttccttctttcctcatatgaatcttttgagaaatcaaaagccaaaagagtcaaaatcgccaaagaaaacatttgaaaatacgttaatcatcgaccgtttatcattttcatcaaattcggctttctatttcttttagattataaggtttcccaacgatagaaccgaatgaatgaaaaatcatcggatttatattcaaaaactgaagtgtttgggagagaactttctgcaaccactttataaaaatttaacaacttctacacgatcattctttattgcttgagtaaaagcagtttcaaatattcgttaacagcttctaaactaccgaaagcgcacgcgcacataaaaggcgtaataaataaataaaataaattccgataaaataaaattaataacaaaaattgcaaacaaatgataataatcaatgaacaattgaattaaagagattttgaaatcgatatttaaaaatatggaaatttattcagtggaatttaaagtccgcaaaagaatcctttgataatatgatcgagctaatccttttacggctgattgctccaattggctctgcaagaacttcggaagggatgagttaatgatgacttcctttccaatcttcatactagaaattgcgtccaaaattagcaagatctgagatgcctgatcagttttcaaatattcatcaacgcaaccaattaacttttcgatgccttgttcgtcaacgtaactttcgatttcatttactccaaacgttctttctaatgcaatgaaagttcttttcacgttcatttcatcatcactcttaatcatattcaccagaccctccaagttctttgcgcattctattgcagcataaggatttatagtaatattagcaattagaatcaaagcatattgtgtcatttcggggtcacccaaaaaaccgaaaaccgtagaaacacattctgacaacggttttgacatcggttcaacgaccgatacaaacgccaaaaccatcagagcggttttagcgtattctttagttttcaataaccgtacgatagaaggtattgcttcttgaatgaacaacacaccgtttaaagttgaagagattacaccacataaattcaaagcttgtgtggtcaattcaccttcgttcaaattttctaagatgaactttttcagttcaaatgttttgaacttttcaatgtcatatttctgaaggattaacgtgtaaattgaagcaacgatacctttcattgaatcatattcagaagcaaagaatttgttcaattttggataaactttttcaaatgttgaatagcagccactttttatcagtaagccagcaattgtttttaatgataacataacaacatttgaatcatcgctctccaaacatttttctaaagcttcacacgcttcgtttgaattaatgaatttattaatagcactaggagatttaaatatcatttttgctaatatataaattaattttcgttgattttgatcattgaatttattaattaaatttgggaacatatcaacgaaagtaattatactcttttgaataagtattgtcgtcgtaacgattttagtatataactcaagtgaacatgaaacaatataatcgtcatcacataataacaatgcgcatattttagatgtgaaatcataagcttccatcattcgacaagccttaggtatttcgattaaatacttcaacaactcgagtgataacttaagtaattcgattggcgattctggtacaacgttcactaaaacattttgtactatttgacatattgctgaatcattttcataatatttaccttgtaataatttgattatataaatggaacaattaattcgattcgataaatctgatgtaattaaaaatggagcaagtttaatgaaatgttctttgttaagtttagttaatggtaacattaataaattagaaatcgctaatggcattgatgaaactccatactttaagaataagtttaaatatgaattagttccattattctcgataaatatcgtggacaaactattattctttaaaatggtattaataattagtgagaaatcaaatgcaagttgtaatgtattacatttgttcattgaatcaataaacattttaatgcatttttcattagaaaataattctagccatttctcatcatctataatcgtcttcaaattagagatattattagttaaatcatctaaaattcgatataatgttattgatgatggtgcacctggattaaagactgtttctttccgcttaataaattgattcaaatatgcttcaacttcactatgattcgtgcctggaaaatctaattgcccactttcaaatgctttaacaataatgtcaaagtcagggcggttttctggatttttgtcccagcacttttcaataaactgcgcaattcgcctggggcaggtcgtcggaattaatggtcgcgagccttgcatcactgcaacaacaacttgataatcccggagacctctgtaagggatttcatgcgaaagtaattcccagaatagaattccatatgaatatacatcggctttcttaccataaggtttggaatcaaggacttcaggcgccatccattgtgctgtacctgtaccacctgtcattacttcagaatcattactaatcattcgactcaaaccaaaatcacaaatttttggataatcatcagcatccaataagatattaggtgacttaatatcacgatgaactaatccttttttgtggataaaggaaagcccacatgcaacacctaatgctataatagtatgtttggtcggtgaaagtggatttgaatcagagtgaagccgtttaaagagtgagttccccgacatgtattcggtgatgatgtaatatggaggctcaagagttatgccaataaatggtaaaatggcaaagtggttaagtgtggacgcaattttaatctcacgttgaagcatttcaaatgtgtgcttgtcgaattgtgatgcattcatcttcttgatggcaacaaaacgtttctctttgatgtgataaccaagatacacatctgcaaaaccaccagagccaatgcgttttcgtaactcaaaagcggaatgatcatatgcaaattcactgaattgtgaaaaaccttgtgctacctcctcagcagtaagaacacgtgaatctttggtgtcgtcaagtacactgatgcgttggttaatttcttctagtttgtcttgaagtttttgtgattcttcttgagaaattgattgatcatttgaaatgattgtttcaactttatcgcgtaaatcataacaatctacttggtcatctacattttcttgttcttttgaaagtcgaaagacatttgattcaataatttttgaatcttcaatagctttgttaaaatcgttcttgaactcgttgagcttatcattaatgtatagtaatggatgttcaagtaatattctaatgtaattttcttcaaataaattggtaaatagttcatgaagatcagatattaactgggatgcttgacgaagagctatgctttcagtaggagaagcaattttattgccgcatttcatgactgctaactttttgacgaatgcatgtaattctgaacaaacgcaagcaagtttagttctatgtataacgacagacttgtagagcttaagtatttgcaagatatcagctcttaaactttggatccattggaataaaggtactccgatttctgatgacatctaaacgatcatttttcacacaaattctgtgggtgtaccaaatttgaaaaccataaaaaatttcaatattttaacggttaataatgtcaaatgtttcgattggtgtattgtttgtttaaagtctgtttttgatgtaaataaatgtttactcagaatcaggctttggctcttcttctgttttagagaaatcaacatcttctggaacatctccaagatcattattttcttcttctgctttcttattaagtccagaaagattcattcctgaaatgagatcagttaatacttcaacaattggtttcttttcaacctttcccattatagcatatgtatttgcatgcatgttgaatgcaagttctggtttttggaaggaaagtgcttcttcgctgccttgaagaattattgatgctgaatctaattctccaaattcacggcatccaagacgttgtgctgctaaccaaactttaagtccattttggtttccattcttttgtgttttctttgtcttacgacgccatgagccgcgtcctccggtcttcataccaactcctggtgacattgcttgatcaaaggcccaacaaaaccgttataacttcttgttaacggtcgtgtaaaaaatcaaaaatggataaaaatccaaataaattaattttgcaaaattaatgatttatcgatttttttttttttttttttaagatttatggattgtacaagttttaagagatctaaacgatctagatcagatgcaacagatacacagtgttagttgaaggttcaacaattgtcatttgaaagctaagcaaaagaaattagaaaacaaataaaataacacaaattatgtaattagttatcattcacgcgttgaagaagttgattaaatgaataaaatgtaataaaataaataacctatatatattatgaaatcccataaaatagtattgtttgttaaataaaatttgatttgaacgttcttaaaatcaacaaacattttgaaattatctctcacaatagaaaacacaaattaaaaagtttaaatggttatacagaaatagttaaattgcttcttgaacaagaaggaattgatattaatgctaaagatatttttatattcaaaatttattttaacaatttgatgtttcaaaataataaacgaaattatttttgacagtacttatgtatgcatctgaaaatgggtatacagaaatcgttcaactacttcatgaacaagaatgaattgaaattaataccaaagatatttatttgttttatttgaaatttattttattattttgatatatcaaagtgatattagggaatatttaaaccactcaaatttcccatattctttaacaataagatatcataacatccctctacaaaacatgaacattaatatcatattttttgttgattccttcaattttttcgtaaagatattcacatgattttttagatagatttatttatattttacattcataaaaaaaaattttattaaacttactttataatttgttctttatataacaaaataaagacattttcattttattcatttgtggtgttttctgtcatgattgagtttttcataaaccaaaagtgacgttaccgatatactttaaacggtcgaaaatacccattctatcggcttttatcggcatatgataaaatcatgttcttttgggcgtttcttagcaaaatcacaaaaagttcctcttgtagggttgattaacatgcccaaagatttgattcttgttcggcatggatatgcagaaggaaacaaagcctatgctgaagaaaaaaaaggaaattaccaatttttctcaccaaaattccttgaaacacatgaatcacaatggcgccttacatctaaaggtagagaacaaagtagagcggcaggtgaatggataaaaaaaaatgtatcatatttttttggacaatatctttgcagtgaatacattcgagcgcttgaaacagcagctcttctcaatctccctcatgccaattggactcgtaatgtttttcttcatgagcgaaattttggtaaactctcaagactctcatatgccgtacgtcaaaagcgatttgaagcgcaactcaagtggcgtgagcgcgatgctttttattggaaacctccttctggtgaatcacttgctgatgttgctcttcgagttgattatattcttgaccaactttctgagtttccaattcaaccaagttcggcgattatagttacacatttccatgtgatgcaagtcctgcgaacccgcatagagatgatcccccaatcagagttcagaaaaaagctggtaaacaatgacgagtcagaaaaactcaaaaacgccgcaataattcactacacgcgtattgacccagtcaccaaggaagtggagcccgtttacaaatggatgaagattgttattccatggatcaaaaaatactcaaatcctgattggaaggagatcatatacccaacattcacaaacgaagggctcaaaagagaaattgaggaatcgtccagaaatatctaatcatattatttttgttcgctatcaatcctaaaaaattgtgacatactttttgcgactaatcttagacgattataacatttccgttatgtgttatgagaaaaatgtgtttttaaacaagttcttggcaaaaatatttgtgagtttttaaattgacacaatttatttttcatcggttaaagcggttatggtccgtcctttctgcaaaatgtctcgcattcatcaggagaaccttaggtctgctattgctgaaatccttgactactctaacaacaagaagaagaggaagttcaccgaaactatcgaacttcaaatccgtcttaagggttataacatcgcaaaggataagcgtttcattggtagcatcaagcttccaaatgttatccgtccaggccttcgcattggtatcatgggtgataagattcactgcgaacaagctgctgctatcaatgttccatactatgacctccaaacccttacaaacttcaacaaggacaagaagacaatcaagtactgggcaaagaagcatcatcttttccttgcttctgataccatcatcaagaaccttaacaagacattaggtccagcattcaacaagacaggtaaattcccagcaccaatccgttcatctgacaaagttgctgatgctgttgatgaagcccgcaagacagtcaagttcaggctcaagaagtcaattgcatttggcgttgccgttgccaacgttgcaatgaagcccgaacaagtataccaaaatgttatgcttgccacaaactacgttgtttctctccttaagaaacaatggcaatcaattggtgccatcactctccattcaacaatgggcaaaccacaccgcgtttactaaacacgcaccaaaacaacatcaaaaaataacatacttcactcgtgaaggagatgtctttttattgcggatttgtttgttcaatcatattttttgaaatgagattttaagttttgcttatgtgtaatgagaaataatacaatttagtttaaaaaagttttaaaaacacaaaaaatacattttatcatcgcgaataaattctgaatttgatgcgacggttatttggagaacgtttatctcatgcgctatgattttaggatctgtgaaacagcttcgacgcacacatcaaactctttaagtaattcatctggttgatcatctgtgagttctccatttatttgatctataactccttgtggttgatctattacttttaaaaattcaattgtccatgtctcacttgacatgcaattgattattttgttgattgtctttaatgcaatccaaaggatttctgtttcaccgcattcaatcacttgtttcattaattccgcaaattcgtttgatggtattctcaacaatgcaaaaacacagccttgagctacctcacacagaaacttgaaaaacatcagttgaacctggaagatttgtgttgataaaatgttttgtattccaatttgtccaaatgtttggaaaataacatacacagaattttctcttgttagaatgcatatgcttagcacacaaatacaatgctcaaagacttgaattttatcaacaaatcttaagctaaaaatccgtgagattgcaactgcaaagtctccaacagggattccatacgtggtgttctttaaatatctttcaagaaaggaaagacacatctcaattgttttccaattgactgagcacatcattagtctgtaaacgttctccatcaccataaaccgttcgatgaaaacgtttaaatttgtgaaccaattcaatgcattgaaatacccaaaaagtgaatttctgtcagttttttcattccctgtgttgatgttgctgccaagaaattccaatatgtcgtttccataaacaggattttcaaatttcatgaattgtgataatgtccaactcttgagtttctgaattcttgaatcattttgaacatcaattcttaaaatgtctggaattaaatctaaaccaacttgaaaataaataggatcacgtgatactaaatttccaacgagaacaagaatattttcggttgattcaatttcaatctctttttttaaatatggtgaaattaagcgaattacatctacaggaaatggaaactctgattttgcactcattttaagaaaaatcattaaggctgttggaaaacattcttcaatatttatcatttctgtaagaactcttatgtggttttcattaaatttactcattatatatctgggacacatttgcatgtattttgcaagtaagtttacacattgaattcttatatttaaatcatcatgcaataaacattgtaccgcttgtgtgatattatcaatatcaatcggtactacaattgataaatctgcgaatggatcatattcttcttcttcttctgtttgaatgacccatttccttcgttcactcattatgacgataaataaaccaaacaaatttgaaagtacatttttgagagagtttgttcgatgcgattttttagattatctttaaagaatatataagaaggttagatttccatatatttaagaaatttttttgtttatgagcatattacaaaagatatataacatttttgtatcaaaatattgtaaaatttttccatcaacaaatcaattatcataattttccatatctttatctctcttttatttttattcattgatctttttcatatcaaaattttccctatagaaaaacactgtataggttaactaaaaatgttgaaggctctttattattcaacaaaaaagtgaataatttaaccaaaaaatgtctcaatcaatttaatataaaatgatttattattcttatattactttttactcattttcctcactctttacctttttcagcacatccttaatgctttccatatcgacttgtccaatcttaataaagttttggtcagtttcctccatatccatatctttcaagaactttgttctataagcggcaacaacttcgacgtacttattatgtgtcttcgctatgtctaatgcgtgttcccatcttccgagttcgatgtttaactttattgctcggaatatgcatcttccctgcaaaagaattccctctgcttcgttcacgcggccttgcaacacggcaatcatcgcgttacgtgctgcggggctttgcatctttttaactttctcgagaaacataactttgtcaatgagcgacaatactgcatatgattcttgagcagcgtcaatttcgccagattgtatggcacatgcagcgcagacagcccaaaggctttggtcgtttgcagatcgacagatttgaagaactaatttccaattcttatgaatgtcaatggcttcatgaaccatgataagatatggtgaaatgggagctacacatagcgagccatctttggaggtaacaaatgcatgcgttccatcaaatgaagtgatttcagatacatcaaataataatcggagctcggttttgagcatgggcattagttcgggcgtaaagaatatggcattcgggcaacaccaaactgtaagagttttatcactacgtgctaagataacatcatgtgatgtatgccattgaaattcatcaataaaattggctagtttttgggattctatggtcatagaacgtgagtttgcagaaacaaaacgacaaattgttaaatctccatttgaatttaatagaccaattcttgctttgttttgtgtagtagcttgattagtacgaatgtttttaatttcagaagggtggtttaatggttcagctgtaatcatttgaccagttgatgccgaaaatgcaaaaacatgttttcgatcatcaggtgagacaacagccaaaacgcatggtgacaatgaaaccaagtcaagtgataataaatcccatttaatacgagaatcatttatccttgaaataggtcttccatcgtaaccgataacttgagcgccagcaacggttatgtaaacaaaaatcgtttgcgattgcaaaagtgctctagcggtttcttttgtatcgacgatagacggagtgctccattgacttgatttataaatgtgaattttgttttgtaaaacaacaattaaatgatcaaatgctaaataaaagtctacaaccgaagtcgaaaattgaaggttttctgtgatgccattcttaagatcataaacaataagttttttgggagattccatgaaaacttcacaatctcgataaaatgcttttttccctataattgatattaacgaaagtgttccatttccgccaactatagcacgtggttgatcatccattacgcaaatagcagctccagaagcaagcggaagggtattaattatccgaagctgaagatctgtaagatataaatgatgagctgtaccaataagaataagctttatagatgaaagaaagcgtactgtggtaacagcataatcgaattgtgcggattcaactatcattcgtccatcaggatcaaagattctagcaatgcgatcttcacttcctgtgatgatctcatttgtggctttgttccaatcactgcatgtaattagtctccgatgacctctaaattgtgtttgatcttgtttaaatgatgctgatcgaacagttatcattccaccatgtgtaaacattaaatattttcctgtacaatcccaattcatagatgtgacggctgccccacaacttgctaatgtggatcttaatattccatttcgactccatattttgattattccatcttcaccagcagaagcaattgaagcaccatcaggatttacgcaaagacaggtaatcccaccattatgtgcttgaactgttttttcaattctccaatttgaagaacataaatgaaagtttccatcagagcagccaataaaaaaagtatttggagctccttgatcatgtgtacaatctaaacatgttatatgtgatttctttaatgtaaaaatatcatcagatgtttgtggaagatcatcagaattcattaaatatttcctaattgctcctccatctactgctgaatagaaatacttatcgtcatgacaaagagcagctaccattccattaagtcctgttaatgaacttgcatctgtttttgacagaacttggatcttcattttttttctttgaaatatagaaaacgtattttttaacgttcgtcaatgttaatgaccgttaatctccaagttaattggccgaataacagaatgtatttagcttttttggttgctatatggcaatcaaatgcaccttggaaaacaggtttacgaatgaatgacccaaactatttaccagtacctccaatttttggtctagttcattcatcatccaaaataaattcacagataatatttggcgattttttaagtatcatacaaaataattcatcatttatgggatataaaatccttaatgatttaaatcttaaaactaatgtatcatattcattttatcaattacgaacagcttgtagaaacaaaacaggacaagcatgccttattctaggtagaatttatgagtttggtgcttatggaaccgaagaaaaccataaaaaagcattttcatattatcaaaaagctctagattacggtgataaaaacgctcttattccactttctttttatcacagatattatgacgttgacatacctgtttctattgttgaaactgattcaacagctgaatcagttgagtcattattatcttcttcattccaatatgaaaaaggttttttgcgacctttatcatgtcccacagcatctcaacttcttgttgacatctctagtctttgtacacaaatgaaagcatttcccacatctacacccctaaatcaaagcgaagttgatcgcttaattaattccactgatcccaaagacctatacaaacttggacttcatgagatgtctgtcttttatccatctcgtagtgaatatcgctcagccaaaagcaaatttaagaaagcattacaacaaggtcatttacaatcagcgtcagccattgcacgaattcaacttattcgtaagccgcaaaacaccagcaaaatattatcatttcttcgctcagccataaaaattaaagatcctgaagctttattattagcctcagatttatacatgaccataggaagaaacgatccaatgcaattacaaaaggcatataaatatgtaaaagacgcagcacgtacagattatcctccagcaatccataaacttggccaaatcacttactatggtttactcggagtgccccgtagtaatacagaaggatataaactattcaaaaaggcggctactaaaggtttcgctccttcgatgtttgatgctgcacaacagttactcggcggcgatggggtaactgttgattgccaagcagctctttctatgttacgaagaattattgacgttggaccatggtcattattctttgataaatatgttgaaagaggatctaaacatgcatttcttaaaatgcttgatatgaagctaacaccaattaaatgggttaaaattgaaccacaaaatgaagccattaggaatttgttggagatatcaaatatggaatattcggcaactgaaaatgccgaaacagatgaaactatagagaaaatgagattggtcagagaaggtgatgctaaatcattactatggctaatcatgaaatcaccactcgaagaatcattggaatggattcaagcggtggaagtaatgccaccgaaaattgcaatattagcgaaacctttgaaatggtttatcatcgcaaagaattctctcagaatggtaaagaatcagacatctgagaaagaacaagaattgctgaaagtgttgttgagcccatacttaaagagattgttcattgtcttggccactgtttgtttggtcattttggtggcagtgaggtttaatatcgctttttctgattaaaatgtgtcattttggatttaatatatttttaataaaaatcgaatttttaatttgatgcatcgcaataatacttctcgtttactgtccaaaatcaaatagaaaatgcgtttccatatgtttaaagttgtttggtaatgatgaaactttgaaaataaagaaataattaaaatattattttcatcttctcagaatgctttttattcagagtaatagtatcattaagtgtaatagtataataaaactatattaattgaaagagtgtatgcatataaaatttattcacaaagtggaatttgaaatttaaataacattatatttttaataatattagaagacaaaatatgatttgcataattttgattaatatctaaaactttactaaccaacttgaaaatttttaagtaattctacaatttcgaggtgcttatttttagatgcatacataagagcagtacaaaatttcatgaataaattttatatattatattgaaatattattttattgaaataaattttaaataaaacatacaaacatcttttaagccaacacgaatttttgcttgtttaagaagtaatttaacaatttctagatgaccattttctgctgcaaacataagtgctgttttaaatatttacaataatttccaaatattgctatgaaatatgaatttttgtaaatgaatttttaataacactaaaaaacatctcctaaattaataaaatttttttcttgttcaagaagtaatttaacaacttcgatgtgaccatagtgagatgccattataagtgctttactaaataattataataaatgtcaattaatatatagaaatttcaaatagttaaaataaatccaacataaaataaataaatgttataattattgacactatttttttgtttttcaagaattaatttaacaatttctgcataaccaaactctgatgcatatattaatgctgtaccaaagaattcaaacatattcctattattactttaaaacattttatcacttaaacaaacatctaataaaaatcaataatattttcattatttatatcaattccttcttgttctaatagtaatttaacaatttctgcataaccaaactctgatgcataaattaatgctgtaccaaagatttcaaacatattccaattattactttaaaacatcttatcacttaaacaaacatctaataaaaatcaataatatttttattatttatatcaattccttcttgttctaatagtaatttaacaatttctgtgtaaccttttttagatgctttaataagtgccgtatcaaaaaatttaaataatttccaaatattatgctttaacccaaaaagattaaaactattataaaatagaacaaattaataccttggatattgatatcaattcccttttgttcaagaagtaattgaacaacttcaaaacgattattgcttgctgcacatttaagtggtgtattaaatcattttgacaaacttggagtaatatttgagaatttcaaatcataaaatcaaacattaaactaaacaaattaatatcactatcattaacatcaactccttttcgttcaagaagtaatttcactatttcaacatggccattactcgatgctctcataattgctgttttatataaattaaatcatttccaaaaaatattttaaaaaataaaattatctaaacaaatatcatatataacaaataaatatctttagcattaacatcaatatctttttgttcaagaagtaatttgactgtttcgatatgaccattttgagatgcataataaagtgctgttctaaataatttaaaccatttccaaatattattttaaaaaattaaattatctaaacaaatagcaaatataacaaataaatatctttagcattaacatcaatatctttttgttcaagaagtaatttaacaatttcgctataacctcttttagatgctattatcagtgccgttttaaatatattatataaatttgaaacattatttttagattttaaattatcaaaacaaaaatcattttgaatattaatctcaatatctttttgctcaagaacatatttaacaagctcaatatttcctgataaaactgaataagtcaatataaatcttggcaaattaattcccaaatgaagttccttaaatatatatataaaaccatgtgatgcaaattctaaaataagtttatcattaatttttagggaattctttatcaaaaaagataacacttcatagttattatataaaacacattttgttcctaattcttctaaatctattttctgtatctttttttcaaaaagataaaaaaagatttctttttgatgaaattcaattgctgtttcatatgcatcttcaaatgatgaatgattttgttcgcataaatgaataatttcttcatttccacctgcaactgcatattttccagtattgtttacatttgcaccattcataagtaaatatttaaaacatttaacagatccaaaaaatgctgcataatcaattaatgaaacatttctttgattaatgaatgaacatctttcataaagtgatggtttaattgtttgattaaaattaaaattattttgagatgatatttcttgaagtttttctatttcatcatttcgaattattttcgcaatttcattcggattttgtccttcttcaattaatttcatatgtaattcccaatcattctttgaaagttcatcataattattaaaaaattcctcccaaaatggatctacgtattccaattttgacattttatagtgtaacatgcggtgtgcatataataaagatttcctaatttgaacagtttttgaatcgattaaattatattttatcatttcttcaagaagaaaattcgattctcggatttttgaccttagaagaattgttgtgaatacataaattatttgtgatttacgattcttattttcttcatctattttaatttccttaattatatgaatacatgtcatgatatcaattttgcgtgattggaaagaagaaaaaattaaatagcaaagcatttccgtaaaagaatatgtaccatcatctaattttatgatcaaatcaagtgattttttgatattctcctctttgaaataaaataatatatgatataatttaagggcatatgataaaaattgatttttgtgttgttgagtttcttcaaaactaaaagtatttaatcttttatcttgatttagcatgaaaaaaatgttactgaaaccgctgacgataaagcgtcggttatatatcggcacagaatcttttgacaagtcaaacaacttttgccgtgtcaaaatatattcgctgaatattttatgcaactgccaacgaaatcatttttgtttaatgagtacagctgatcaagtaattaaacaagacaacaacacaattgggcaatataaactgataagtaatgctaaaggtgatcccattgaaagaaaaatcagtaaattaaagtttataattaaagatgcgtcagatgaagattgtaggaaagctctccaaagcgcatatggtaaccttaacaatgcagctcttcttctattagaaaaaaatgtaaatcattctaaggatgaagacaaagaaaagatcaaaatcagtgataaaattttaaagaaatttaatggagtgttgagtttatttgtaatatcccaagtcttatttatgtgtaacaatgatgaagatgaagccatgtccatactttgtactatgatttgatgattattaaatatgtgtatattcatttttataattttccaatttgaaaaaattaataccaaagtataactgatttgtaataatatggaaaattttgaataaaagtatcaatagattttacgtttggaatatgattctaccatttttaattatataactacctataatgcattatcttatttataggtgttaacttatattcaaatataaacttaccttttccgaattttaaaaatactacacatagattcatcaaatttttatttcttttcattgttgaatttattaaatgcatcaatttacattagaatcaattccttttgggaatttctgaacaagaaatgctcacatccgaaaagtgccatgaatttttataaggaaattaaaattgacaataatttttcacacacttgtttatttaaaaattacaattcttacaaatcaattaacgaatctgtttcatctggtggaaatccagtcaagttttcgagtgaaaagttttttcttaattcttcccattgacttggctgtttattataaggcaccaaaatcgtcatttcccacgaagctgtttgctttgctatatgtgacttttgataatttccatcttgaatcaaaatagaatctgagttataaacgttttcattttttaatcgattattttttaatttttcttgtaagtttttccaagccgcactaattttacttggatcaactccaaatttttgagcattatgatataattttgataaatcttttttcgattttgtaacgtattcgaggtggttaatttcagagaggcggttacagcattcaatgaatttcagaggattctgaaagttattttttgagaagtttacagacttaatcaaattgttctttgcgcaaacttcgacaaaactttccaaacctttatcgccgatgttattcttactgatcgatattgattctaaggtcgttgaagtagcgaaagacccaaagaattcttgaattttattttggtagtttctaatttttgttccacacattgaaagtttttttaatttacagttttgaaggaatgtaacgattttgctcattatcggatcatttaagttgttttcgatttcgcatccatcgatacctaatgactccaaattcggaagattagaaatgaattcgataaaaacggaatttattgtgttgtttttccaataaaattccttgattgaataactcgattttttaggctttaaatatttgatgtcattaaatgtcgtgccgacaattgatgatacatttaatgatattttcgtgacaaatttttgtgaatctaaaatattatataaactatttatatcccattgtacatgtgaaagttttaactccgctaatgttattggtaaattacatcggccattaaaattggtgcatttattatatgataaatctaatgatatcaatggtattgatttagaatttaatatatcaaatatcattgtaatatctgtcccaatatcaattaatgataagtttggtaattttatggaaaaaataaagttaaaaagatctaaaaacgtttcattattcttaagtgaatttgtatgtgaaattattaatgagtccatgtctttaaattcattagaatgatttgaaaattctttaaatgtgccatccgcaaacttacatcggacaaatgatatttgtgatacaagtgatttacccataaattcaataaacggttttatgaatgtgtcggtaaaagtgacgtttttgaacgatagaaagttaacgttcgacgaaatgagtgctttatacattaattcaatattggttaacgtgttacacccatcaatcgtgagcgaattaagtgtgtccttattgttctcgataactacattgatgtaatcaaaaaaactttgtacatcattaccagaaataattaaattagaaatgtttcgtgagcgataaagagctgttaaaagtggaaatgtatacttgggatcacttttaagacgttgtacattaactatcatcccttctttagattcttcagcttcgttttggatcgattcaagcatatgatagatttgctcatttattgataattcatttgatatgcaataagaagcaaataaattacaaaaataaaaaggttgtttggattccgatgaaaagtctaggggagttgtttcaatgtggattggtgggtcaggtccaaataattgatataaattaatgattgttttttcaagaataggtcctggattaacggaaagaagacgaattggcttatccttaaaaacaaaaagaagatgatgaaataatggattagaaagtgatggtgcattgtaaattatttgtattaaattaacccatggaaaaatacccgaaattttaacagcttttaacattttaaaacctacacataggtacattgatgaggttgttattactaaaaatctgtgatcggttttcccatgacgatttgttttagaaacatgatcatatgccaaaatattacaacatgttgtatcaacgcaactttgaaatgattctggtgttaaaatttaaacatacttatgtatgattctttgaggtcttcctttggcatattgctgaataaacgttctccatatttttatttaacgttctatcgaccgtttttttattgttccatactaaaacatgttttgtattcccatgatttaatcatatattgaatattatcgcatatgaaatgaaattacattgaaaaattatttgaaaagtttcatttctgaacatttgtatttaatgaaattattttgttttccgagttaataccaaaaaaatgaaagaacggataaaggaatgaataactaatatatgaacataaagtttattttggttttatttatgtagaattccatttttctttaccctctttttgatgataacatcgttgaatgctttacatggttttcagcccctcggccaacaaatgataagaaaatttgacaagctttgttcgtatgcttcattatttccaatggcacaatacttgcttctttccttttctaaggaattaccaccacaagtaaaagatacaagcatcaacaaagtcattgaaggaattgttggttcattaggtaaggttcaccaattcccagtctcatcaaatttaacagaattttcttcaactgatcagttaatgtccattgctgatgaggttggaaaactcgaccttcaagcgtttagtcttctcactcgtgttgctagaagttgctctgatttatcaaaaaagattcaagctgataatcaaagaggctgggatgatctcccatgcaactgtgcttttgacccagctattccaccaaagcttgttgtttcacttcaaaacggaaatcaaattgatgaaattccaattgaccaatatattgaaggatgggaatggaacgatatccaattctcacaaaaaggttccgttgttgaaatttataaaacacttttagatgaagttcaatcacttgatgaacaaattagaaactcgagcacagctttcacagatgccggcaataagattataaaccttcgtaggaggagtgaaggaagtcttcttgttcgtaatcttgatgaaattggatcttcaatgtattcagttacaaatcttgatgaatatcatgcatccaaagcaacaaagacacccatatatgtacacacacgtaaccttagcactgttttagttgttgtcaagaatggatatgttaatgaatttaagaataattacactcttgacagtccttatgttgttccaaactcattggaagagcttgcttctgataatgagtacacatgttttgccgttacaatcatttacaagaatcttgatgattacaagagtgccactaaagaaaagggctggcatatcaaggacttcacatacaatccgaatcttcgtgaagaactccaaaaggaggcacaagaagcaattcaaaattatctgaatgaatctaataattactcagagcaactccaatcaacattttctcaacttgcaatagtatggatgcatattaaagctatcagaatcttcgttgaatcaattcttttgtatggaattaaatctgacttccaggccttccaagtttgcgccttgccaaagaacatccctaagatccacaaagagctcgagaaggtgttcaatgatggaattcagaccgacgatgcagctgacgatgatttgatgaacgatgaatcagagtatcacccatatgtctcattcaaattgaaccttgttggcctcaaatagaaatttcaaatgaataaatgaacaattaatgctgaacatttaattcaaaatttttgaatctaaaaatggacatactgttaaagctataagttttgtgttatatgttttgatttctctgattcaaacatatatatgatttgtgaattattactatatttcaatgcaccaaaactttatttcaagtcttggttaacttgtgggaaaagacgtaattgctgtaaaatattggttaaaaaagaagtattttttaatgtcaataaagatttactaactttatttttataatggtttatgtttttacctagccttggctctcatttgcctcctctttcttttgagtctccgcatacgcttcttcaaccacttaccacgcatctatcttagtggtcagacaaaaccgctcgcatccagccacggaaattgaatgaaaactgccgcagacttttgagagtagtcattgaatcataaccgtaactttacgcctgagtcatgaaagaatgtttcagtaaaaattctcaaatttcgttataatcatgcgaatgacaccaattgctaaatatatttttatatgctatatcaattaaatcatgaaaatattaacttgttagaagttcatcgagaagaatatcgaaaaattaatattttcatcagaatcgacaaacactctacattacttaatcatttcattgtgcttgtataataaaaagatatgatgagcataaggaaattaattttttggtgatggcatttgaatttatacaaaagaattttctgagaagaattgaacgtgttacgatcgttttgtcgccgtttttctacgtaacgtattcaaaatgtgaagtaaatttcaggtcacccaacaagccaaattttaatggagaactactcaaaaaccctcacagcattcatgaaacttccgccaaatattcaaaaaatactcagacgcaaaagtagtcgtgatccttcgtctcaattcacaactaaattacatgttttacttacttatgttatgaataatccttcaactgaagaagaattaggtgttggttggattacaaatgaaaaattccgaatgaacaaaaagatattggttgaagttatgggtatcaaaattaacactttaaatgtaaatcttaaagatttaaaattcatacaacttcaacgcgataaagatgggtggacccaatggactaaagaaggatttacaaagaaaagtccatctttaatgcctacagttatcaatgaaaatccaaatcctccatcatcacaaaatttagcttatcattttaccattgggttaccttttgcagttaatgatgacttcattcgtaatttctttgtcagctcacagagtttatgggaagaaattgtaggatatcaatgtgaatcattcaatgcgacagaatttattcatagagcagctaacatgctaaaacagaacatgcaacccattgacaatgcagagagtgttcttcaagccttaatttcaccatctcgaaatgatcaatcaataattgaaaaatcagattttatcaaatttcttgcaatgttcgggcctcgccgaactgttatgatcaagatagcatcattgttagagtattctaacagcactgggagttggctatttttttcgaatgattatcctcaaaatggattttacggaagttttagtgatacaatgccaaattgtttggtgctgcacatgaaaaatggcagcgagtatcgaatatataatgtgccgactgttgaagcacaacaggggaattatatctatgatcaacaaggatcaagctatgagtcatggggtgacttctttaagagacatccggaagtgatcgaacaagaaccaaatacatatatgtactgatatttaaataaaaacttttttgtgaaagcaaaaaataataaaatttatcgtgtttttaaaacgtagacattaaatttaaggcgtgtggttttatttttcttgttcgatgcctactaccaatggaagagagatctctcctttgagcaataatcattagacaaattttctatgctgatgttatgtgaatgaaaagtgcatttttaagcaaattacacaaaaattcaataaaaaagtggcttttgtgccgatatgattttgagttcatatttgttcaaacaaagttcatttttttatgtaagtttgtaagggggttaaaaaaaattttttttaggactttttactaattaacttattaattagcttgatttttttcgtattcttgaatttcttcaactgttggttttaatattggatcctttaatatgtatctacatgcatatttgattgaagctatgcatctcggaccataattttcaagttgataatcacctgcatgaattggtaaaaatttaatttgattattctcatttgagaatttgttagttttccacatttcatatttaaaattcggtttatcaacaatagaaaattgataataatcagttgaaagtgtcattacatttaacttttttaatatagatggctttatactaatttgttcatcttttttaattgttgttacaaatattaattcaacattttgggatttttcaaattcccaaaattcatcttgagtaattccacacatgtatattatactaattttttctagtagttttgttactttcttattacgtataaaaagagaagaatcaacacttttaaatcttgatataagataaatggaataaacattttcataaaataatatttgtttttcaatgttgtgcttaatttggaatccggttaatgattgaaacaaaagttctgaatgatgatttggttgttcataaaatacaattaatgtctgattttgtgtaattggtttctttataatttgataaataattaactcatttgcttttcgattatagcaaatatcccaaatatatggataaaatggtgtcttcacattattaattatttcttttatttgctcatcagataatcgtaatgcgttgcttatataagattcaaaagcaacagcaataatacctgctgcaactcctcctgcaaaagaaaaacccactccaatgaatgttgcagctgcaatatatttcattcttaatttccacttatttgctctaaaatattgatattgttttatctttgacttcatatattgaatatttattccaatagaagctttcaaatcacgtttaatttctgttacatattgagcataatcacaaaacttaacttcagcattaccaagaatatatggtaatatagtttctaaaactatgcatataaatttatatacctcatcagttaattcatcaattttagatggatcagtatcaattttcaatttttttcctataagatcattaagtaaaaatgtacatgctacacaatctgctaatggtttattaggtatttttaatataaattctttttcgaatttgagtattaaatccataaaattttgaaaatcatttgaaaataatggatatgattcattttgtattgaatttataaactgatcaggaaaatattgtactgattgaatagaatttaaaataaagtaaaatgattgatagacactattaatatatccacttaaattggcttcaacatccccaagaggtaaaggttttaatgaatttggcgaataaagttcttttgctatgttatgttctttccaccataactcagaaaaattcttaaaattatcttgatatttatctggatttctttgatctaaattctgttctaaatctttgaaatctcttacaaggaaaaaaacattcgataaaggaaatgaagaagaaagttgtgcacgacgaattgttgttaaagtacttttaaaatcatcaactttatcattaaacctagatatagttaaacatacagtagaaattgaagtaaagactgcattaactttatctaatattggcttaagctttaattcatacttttcatcaccaataccttgtgaatcaatgaaaaatattgctgtatttttatcgacattaattgaatcacatttttcttttagtttcgcataatctttactaaatctatttattatatcagaaatgatataaggtccatcaattagtatgccttgagtttgactttttgttccttttccggcataaaatgctccattccctgtaagtgtcttaagatatgttgatttacctgattgatatggtccaaataacattactaaaactataggtctatttcctgctttacgtagggttgattcaaagttcttaattaaaataggatatttcgatgttttatcccatggatgaggattggatttaatatctgttaatggtgttggtataacaaaattattaaatggaaatagttctgaatatattatttgatttttataattgtcaagaattgatctattaataccggaaatttcatcatatatgcttcgaatcttattaaataacttttttgatttgcatctctttttaggatctttagaaagacattttttaattaaagatacaaaaactggtggtgttgtacccgaaatttcaggtaatacgccattattaatattttctttaattcgttgaatattaaggccttcataaggttgtttggaagaaaatacttcattcatgagaagtccaaatgtatatacgtcagtctttttagtgtatttttctccattgataatttcaggtgcaagatatcgagcttttgaaactgagtctggttcaattgatttatgcgtaagtccaaaaccaccaataattggatggaaattatcatcaataaatatattatcaactgttagatcatgatgaatgatgtcattttcgtgaagatattttaacccataagaaacacctaaaaaaacaattatttttgtatccaaggtccattcagatggttgtgtattaataacattacgtaaatttccattcttataaaatggagtgatcaaaacagcttttttatggtcatcatttggataaaacccaaccaaagattgcactgttacatttgatattttacataatactttaaattcgtttatgagtgaattatatgcatcttcggtttgggctcttttcattgcaacaaattgttcagtgtaattaataattcctttatcaacacgaaatgccccacttgatatatttgcattggttgttttaaacatactgaggtcatttataagatgagatacttctgcttcagcaaattgattcataacaatgtgaaccgattgacgataaatcaaaaaaaatgccgctattcaaaaatgagaagtttacagaatgctgtagcagttgaaggggttactcacactcaaaccctgtatcaataaactattcaatttctttcaaaaaagttattagttttcatctgctttatataacggttttccaaaacatcgtttttgaatgaccgtttataagaaaagtgacacatacgttatgaaaaagggtttgaagagttgatggctgatggagaaaaaaacactttagcaaatgttattttgaatgcacaccaacaattttctgagataaaaaaatcactacaaactccaggagtcgaatattcaaatgttttatcgaaattatctgaaacaacaaataatttaaaagttaaaactgaatcaattagcatatcaaaaaacaatgaacctttggtggctccaaagttgttaagtcctcgaagcaaaacaaaaatacagaaaccgattaatacaaagccacgagaatatcatccttttaaaagtacacattcatcaaacctcaggaaaagatatgcagttataaacaaaattaccacagaatctgataaaaggtatcaacaattatcaaatttaaataatgacttgccaattgttactgggcatattgacccaacagatcaacaaaacacaatagtgtctcctatgatccatatggatatacaaggtgctgccatagctcggagagaaagacgacaaaaaagaatttttacagattctcaatttaaacaactcacagaaaaacgcaaatctcttcaaagagctagtagtaacgcttcttctatttcctcacagagtgcattgagctactcaacgagtacagatagtatttatgttggatcaaatgaatataaagctccaagaatctatgaagaacttcaagataaatatgcccaacaaactctccttgtaataaaaggtaagatccctcgagaaacgccagatttcgagtcatttaaaagaacaaataatgaaatatggaaccgtattgaaacagttcttaaccgaattgaagcttactgtgacaaatttggcattcaatttgcggaagttaatggacgcaaacttagtgaagctgcacttcttaatgttatcacagatgacaatatatatgaatgtcttaatggaattgacgaacttgttgaacaaaagaaatcatatgctgcatatacaattcagaaatgtataagaaaatatttagaaaacatggaaagaaaaaagagaaaagaaatttttaaagccgcttttaccattcaaaatttctggagaaatttaaacgtaaataaacggtttcgagcagagattagaagccgtttaagaacagttagcaatcgagccgaacaacttcaaaatcttcttcgtggaaaatataaagaaatagaaaaagctccatatttaattgttcatgttataacagggttacaagatctgacaagatgctttgatttaatgttcaaaaatgtaactcttattcttttgcttccttctttaccatctgaacatgtatgggaagaaatgcttgatcttttctctcagtctggaattgatgacacaaattctagaattcattttgttgttcttcgccaaaattcaagtgtttcccaacaattacttcgtgacatgaaatctattcaacaagttcgtaaaataatatgtggtagagatgcatttcttatcccccatcaagactggtcaattgaatctacaatttctgttgatatcaatcttcctattcttgggtgcattgatcccacctcttttcaaagacgatcagtgatcaaatccttatttagagaggctggaattgttcctcttatttccacaaaagagcatcaagatttgagtgctttactcgacgatacgcaagatttgattgaagataatgatgatatcaaggtttggattatacgactcagttattctacaccaaaaaccggtgttgcatggtttgatgcgaaagattttcgtgatctgaaaaaaattcattcttcaatttcatcaaataatttcatttcacagattaaacaacttggtgcaaccattgaagctattccaccaaatatccgaagctttccatctgtttcacttctacttacagggaacgaaattcgagtaattggaacatttgatcgaattcatcattcaccattttcattttcatcaattcttataccatccatctctgttgatggaactcatcttattggtctctccagacaagttggctcagttcttatgcggaaaggtgttttaggttatgtcatcattgattttctttcatatgtcgaagagaacgaaattcgactcattggctatgacattcgacttaattcgtatcctaactcattgtacacagcatattttacgttatgcgcaggttttgattctcaacgaaacaaaatgttattgttaaataacattaaaacaacagaaaaaacatttaaacgattcgctattgttcaaagccaaataagtcatccggggttagcgatgatgagcataaacgaaacgaagcaatgtctctttaacaaaggattcatgttcgacttgctgaacagagtcggatttaggatacagttcttcggtgcgccgtacgaaggaaaagggttggcaatatgcgccgcaacgagtgcgaatgtcgcgttgcagaggatgataaagatatatgaagagctgttgaagatattagggaagaaggcgggctgcgacggggagagttcgattgcaaaggcacttattggattaaggaattataaggaacgcgtttttatgtaaatgttttgtcattgtaaaacgttctattgtgggtggttattcgctagaaaaatgtttgttattgttgtttctgtaatgcgcagatttttgataaaaattaagatacgtaacgatgaaaattaaatggtcagataacattccaatacagttgatatatgcgatttacttgcgtattctcaaactttccaacaaattgtcaacagtgaatatttcaacaactaagcaagacagaaaatgaagagaaaatcaaaaataaaaaactatgaaaatacgaaattaaaacaattaaaaacttcatttccaccataaaagttaagccaaacaagtactgcatcatgatgatgttgctataacaataatcactaaatcaagtgatttcttgaaattttgcatatggaagacaaaataatttaaggatgaagaaagaagattcattaaagatgggccaagcatcttcaagaaaaataattttagcaactatggaaggaaggaatgttttttatagcacattgaatttgcttatcattgtcaaacggcaaattgtgttgaaattgatcgttttggtaatcattaaaaaaaccgttacgatgtgtagtaggcttaacatacaattctcttccatgttcgaataataatagaaagcattcggtagaagaagctcaaaacactttactggaacccttctaaattgtgtctaaaatatttaccaagtttcaaaaagcatgctatataattagttggaaatttttcaaaagttattaaatggtaatccaaaactcttctcggttgtgtcttgtgtcaatttagcaagaaatattccattccatccttcctgatatcagacgtcatctttgacaaatgacatctcgttgacactttttggattttttcaattgaaaaaatttgcaaatttgctgatcatgcactcaattattgagggattacttaatatttcagagatttatgagaaaaataaaccgaaagggaaccgcaagccaaccggcttcactcgttcaaaagtttgtatatgtattcaatgattcaatgcattcatgtgaaaaagtcattttttagtttttggcaacccaaccgttggatttgtgaggggttattaactttttcattgaaatgtatacattaaaacttattacttaatcaatacaatcgtttgtggtaaaccattgttttcaatactttgtagcctagttccaatccaaccaaattggccaactccaaagacaccaaaaaatggaaatacaagaaatactaagaaataatatccatattatatcagaatgtataatgtttgttatctttttagtagcaacattaagaagtaactctgaaaacggcgaaatcaaatattatgttccgaccgacacttctcccaggatattatttcttattatcacgatgccaaatagtacaatccccttaaacatgtctcgattctatgtcaatgatttaaatcaaaaatctggatacaaagcgctttatcttgattggaagaaaacaaacaaaacggaacaagataacaaagatgatattttacatcttgctgtaccagaacgttatcgaaacataacatcgaatatcaccacaaatggttcatataacaaaaagagcgttgacattttccgcaaaacatattttggactttcatatttttattacgagacaaattatagatggcttcatcgcaccacagatgatactggcattaacctaaagcgattagattcattttatgatgcaatcgaaaagaaatatgatccattaaaagatgtagtcattaaaggctgctgtattcgtcacattgattatctcgggttccttcaaggcggcgctggatatttctattcgcgaagagctgtcgaattaatgcttccaatgtatgaagaaattatattcaactgtaaaagagcagaagatgtttgtcatgatgaattcatatttagattgaatctttcaatgaagaatgctacttcatacgcattctccggacatccattcccaaaaagcgacttagatagaatcaaaaaaaatgatttcaatgacttaaaacaatgcccagaagaacagcacccaacgagacacgatcaatgcccgatgtaccattgcccaatcaacaaactcgtgttcttgcatcaccacgacgtaaggaaaataccaggcgtaataatgagaaataagcaaatattcgcagtggaagacgaaacaatccatttctattatgcggactcaacgcatccggagctatgcaaagcgaaaaataaaacatattccgaaatttgcaacggatgaagataattgcgtacacaataatgttagtgatcgttcatatctgaaacttattaaatgatatatttagatacaaattttggatcaattgttgtcattgatgtgtgaagcggcggatgcaaattagcgatttcgaatttattcatttctgattctgctttattaaataaacttcgaactattggaattcgatccattttaatactaatgttcattaataactccataactttacgatttttaggatcttgtatgtacattctttgtaatatatataatgaaaattgtaacgattcacttaattctgctacaagtatataatcaacatttaatggtaataatgaacgatgtgttaattgtattaaatccataaaaaactaattaactttctcgtgttcaaacaatatatgattaacaattgatgagaaatgatcttcatctgattgtgaagcatttttccagcatgataaaaacgctataggaaataatgaatgtcgaatttttggtcgtgatatatattcagaacaaagtctagacttgatgaaaatggcgaattttttacaactaaatcaaacaaattatttaaccatatgtgtcttttatggatattgtatatcattaaaaaatgatgttggtggttcataaatgtggtgttaaatcaaaccaaagaacaatttgtttatagtgaaatttgcagataattcacaaaaagtcaactaaaagttcgcaacatttttgtttttcatttcaacattacagatagtcaaataaatttggattttgtatttttaaggcgagtggtgactaaattatctttcgccatacttaacgaacgtttattttcaaatgttttcaattcacatttcatgtaatgataggagaacaaaaagtcaaaaaaaagcttctcttttttggttctatatatgttccgaagccaacgttttcattttctttgagcgacattatcttacttctaatttttattttttttggtgtgtgcacccgtacatttaatttatccaaaccaagtcaaacaacttttgacgagatttggtttgggaatttcacaaattattatcttacacgtaaattatattttgatattcatccatattttgctaaacttcttctctcatttgttggcaaaatcagtggatataatgggtcaatcaatttttatcaatcgtatgaaggctatcaaaatcttcattattttacacttcgtttaacagtatcatcattttcatcatttgttccatctttaggatttctcacacttcgtttttttggctattccaaatttgcgtcttctgtcacagctgtttttctatgccttgaatcgatgcttattattgaagggcgctttattttgacagatggcattttacatttcttcacaatgttatcgattttttcagtttctttgttatcacagaacccaactataccacacatcatctttacagctgtttccacgtgtttatcattttcgatcaaatacacatcattaagtcttattccatttattttactacaacaacttttagacattacacaatgtaatcttaaatctattttccagccagataatgatgaaaggaccatcaaaaatgttcttttcaataaaaggattaaagaatttctatttcgactttttttgatgttaataattgtttttccattgttttttcttatatttattcttcatattattataactaaatatccaaaccctgaaatacaacaaacatatccaatagagatacagagaagttctctttttaattcgaacctttcgatcatttcgcgaattttcgaatatttaaaagtttctcatttgatgaatatgaaacggaaacaaaacgaaacaaatataacatcgaaatggtatcaatggccatttattcaaatgaaaagtattatttattgtctcactccgaactctgttgttttgttacatgcgaatccaattacaatgttttccgctttgttcgcaatcgtaactttagttattatatgtattggagaattgttaaataataaccaaagcattttaaaggtgataatttggccttttggttatttcgcaagtttattgccttttatgttcgtaaagcattcggtgtatgcttatcattacttgatcccttatttgttcgcagtgttgtctttgggcgttgtgatcgatttggtgcttgaaaagtttaaaactgcaaaaagttgtttctctacattgttgatttcaatttgtataatatcatattgttacttggctcctctatgttatggtttagagggtttcggattggatagaatttaattaaatgttaaaatatttttttttttcgttttttttgatgttaaacaagttgaacgttaaattctgagaaaccgttgtatccaaacgttctttcgaagtaatggaagatgttcctgtttatgcaaatggctcaatgaaggggtttctagaatatcaaaatacccttagagtatgggctagatgttatgcaattttgaagaaatcatctttatttgtttttaaaaatgaagatgaaaaatcattaattttttcagtgaatattgatagtttatgttcaataacccttactaaacctaatagcaagcaattcagaatcaaaccacctaatcaaaaatcttatatatttcgagctgatacaagttctctagcagatgcatggattatggcacttaggtcttcatcttacagtaagtcgcaagtcaatattgattcatttcgtttaatcacagttattggtcatggatattatggcaaaatcacattagcacaaaaactagatacagaagaactttatgccattaagacagttcataagaaacgccttatagattttgatcgcattcatacggcaatttgtgaacgtaaagttctcactgaatgtcatcatcctttcataatctctctttattatgcttttcagacatcctccaagttttatttttgtctagagtttgtaccaggaggtgagcttttcaagcatatgcaagaatgtgggacattaccaattcctgaagtcaaactgtatattgcggagatctcgcttgcgcttgattacctccacagcctcggcgtgatttatcgagatctaaaacccgaaaacgttctccttgatgcgcaggggcacgttaagctgacagattttggtttatgcaagaatttgcttgaccaaagcatgacgagtacattttgtggtactaatgagtatttagcaccggaagtaatatcacattctgagtattcttttgagattgatttttgggctctaggaattttaatgtatgagatgcttgttggtgatacaccatttaattcgcaaaatcggaatttaatgtttaagcgaatcttaacaagtgagattgagtttgatcctgattttgatccgaatgcacaatcactaatcgaaggattgttagaaaaggatccaaagaaaagaatcggatttaacgaaataaagaaacataaattcttcgaaggaattgattgggataaagtatataacaagcaaacaagaccattatatgtgcctcctttgaatgaaatgggcgtatgtagtaatgaatacgaaggagaaacgccaatggactctttggtgacgccgataaatagttcgttggtacatttaaatgatttctcgttcgcgaaagatgatatattgactccaatttatacggatgaggctaatggtttggcttctttgacaattgataactatttggcagattcggaatcagatgaggcaaatacaagaaattaatttttgtaaatgtaataaatgatttgttgatatgttaaatggtgtttttttattatttattataaatacaaattgcttatgtatttaaattttatttttatatatacaataaatggaaagaaagagtgattttcctaagaatacttataaacccataaaaattgaaacaatgaatttactaaaaggaatagcatgaagaaaatattgcgttaacagttcaacaaacaatgcaagtattcgacttgaatatccaaaatttatttatcttttaatttagattatttcgcatttgataactaaattaatccaaaaaaagagaaagaaatttccaaaaattgtacttaaatcattgtatttttaagcaagaaacattttactatagaagcgtattatataacagaatttgttgatatattagtattatttcaataatctcttcatatatttcagtagaaggattttatcacattaaattttttctaggtcttactttcagaaaataaaagaaatttggaaaagtgaaaaaacagaataattatgataaagaagtgcataaactgaatgaaattattcttaatgctaaacatttaaacaaaagcaacaaaccattaatcacattaacttatttttactgtttgaacaaatcgaaaaaacgataatctcttttcaaatttgtatcatttttttcattatcaacaatttcattctcgcattcatccaaaggggcgacattcgccacccaaagtgcgattcttcctatttcctttgggtcttccttttccaactctaattggaattgcgtcatcatcattgtgattccggtttccttaatgttcgccaacttcgggaatatctttataattgttgcagcgatgaaataaatcaaaaaatcttttggctcgacaaatgaataaaacattagccacaagtcccaaatgttattccatgttcttttatacaacagaacaaagtcttgatatacccatagtaatgctgttaagtcgtaatgtttaagccatatgtatatcattggcgatacttttgataatgtttcaacaacaattttagacttagacacacattgtttttggacatccgcaattaattcaatgtgattaatactttttatcatggaatcataacaccaaaaaatatcagatatatgttcatcagtatttaaaatatgaccttcttcaccaataggttttccttcatcattccaatttggataatatgcaaaaattattggaacaaataaatcattcattccttgaagataaccaatttgaaaattatataaacaataagttcgcaaaagtgtcgtcaaaagtgacatgccgatacaaccgttgttgagaaatgcaggatgtgttcggttcgtacggctgacgtcgttggagataacgtggaatgaactacttagcttcttattacgtgtcatttggtaggtgcctatggtgtcaacttgagatcggagaagttgaaaacgattgctttgaatttctcgaagtgatttacggtcttctgaagtactatcaagtggatatgaaccaagaataaaaggtaggacatctttgattacatcagattcaacaccagcatacaaaatacgtgatttaaataattcaatatctttgagtttaccgttgtcatcaaaaagagaagcaaaattgcttttgttaattggttcgtattgtggaatttgatctataaagttttggtttgttgttctattatgtattgtgatgataatgttgcaatctcaattggaaaggccggatcttggagaatgatataatcttttgcgatctctgtcataaggttaataaaaaattctgttatttgaagccaaaaatcatctaagttattatatttgtaaattcgtaaatgaatataggttggataaggaagaaggtaattttgattgcagtttttgtatacagtaagagtgtgcttaacttctttatagtgatttggtacaacaatgcgatttgataataaagcttctataaaattagaaacttcaactatattgtcttttggaagggagaatctggaagcagaagcattattgaaatcaattgttaaaattaaatcttcatcattttcactaattcggaattgtgaaatttgtctgaaatctgtcttaaaagtcttaccattgttgagtccagtagattcatttcctacttttttaaatatgctattgacaagatattgtggagaactatcatatggaatccaattaaaataaaacatcccgttttcacatgtcagagaaatagatccatttacattgtccttttctaatatttgggcaatatttgatatgtgacttaactggatatctttttgcatttcacaaatattttggagtgccccaaatttagttcgataatgagttagtgtttctacttgatgtgaaaataatttacacaagagaaaaaactgaaatatatttcaattgtgatacttgtgtggatgggatttttggaatttcttctgaattcttttgagatattataattttattcaaatttttatttgaattgattataatcgaatccgatcaaaatattttgatcggatagccgtttttttgaataaacagtttacatcatttcattaagattttaaaaacaaaagaagaaaaggaagaattattgcacatggaaaatgatccttaggcttgatttgacttgctatcatttatttcctatttggggacaaccctaatgaatcgaaaatgtttttgttggaacccctccaaagcctttggcctgacagtaaataataaaaaataaagaaaaatttttttttgagaaatcgtatttggaatatctaattaattcctaataaacataaggggcgacaataatttcctatagacaaaattcttagtaattttaaaaataaactctcagtatatcgattaattcaccaaaattcgatatttttgaaattatatcgtaacattttgcaaaattattatttatatatttcaatgtacgataagaatttctaatgtttatttctgacgttaaaagaaagttgttcaatgaaaccaacatgtacaaggggttttaagccaagaaaaaatgatctccaagatgcaactgatgctcaactccgatatcaagttttacgtttacaagaagagatcaaaaatttaaaaacttcatttaatttacattcatttaaatataagcaattatctgaagaaaacataaaattgaaaaaagatattgagtctttacattccagaagtgagcttttgcatagtatagaaaataactgttttttaaaaatgcatgttgattctctttcaacaaagagatacaacaaaaaagctatacctgattatatatgtatgtctaatatgggacagtctttatggatgtcaatggagttcaatttaggattcccttgttggagaacaattcaacgttggaagaatgaagaatataaacagttaaatattacaaaagaggtatttgatggaagtattgaacataaagatcatcttttgatagtgtttttaaatgagaattattcccaaaataaccatgatgttattctagcagttgacgcagcttgtatatcatcaaatgtcattatacattaagatggatttattataggtttaatggaggaatgttatattgacagagatatagctgcttatttgagatcatcttcagaggcattattatcatttatagatgaaaacaaacaagatattatcaacgattatttcgtctattatatatgtccaatatcttcataaaatggtggtttatgtataaaagtaaaagaaaatggttcatctgacaatgaaattgtatctcaattagaattaattgcaattttacttggtggcttgggtataaatgttgttggcatttcatttgacggagatactggtgatttaaagtttgttaaatcaatttgtgataaatttcaaaattttaatatttcttgttttctaccaaatttaatcagtgatttaaacatgcctcttgtttttgaagatatgctccatcttgtaaaatgcatgaggtatagaatcgtatgtggaaattcaatttgtgttttacctgatagagatttggtgtttaacaaaaaggattatattgatgttggcatcccagaatttattttggatggaagtcatagtaaaaagatggacgatatgctaccaataatgttatttaccgataataatatttttaaagcatttgaaacaaataaattagtgttaatatcacttattcctgcaacattacttattaagtctgttatggataaaaatttaaatagaactcgaagaattgaatgtttgtcattatgttgggcgttgatgtatctttatatggaaacttataatataaaaatacgagatcgaaaacaaacaagctcaatgtcagaagggaaaaatccttacatgtgtatatacgatatatatactattgataaagtgatgtcactcgtatattctttatcaaatattctttatcaaaacaaagatattcatcttggtgcttttgtggtacccattggcttgaacattattttggccaagttataaggttgtgtcattacaatcatagtgcaacaaattttatgagatgttgccaacaagtaatgtataaaaaaatatgcataccaaataaagacagaaaaatatctaaaagaatttcagatagtaaggcattccttagtaaagatgaagaaattttacattttgaaatttctaaatacatcaaggaagtctcaacaatttttgaattagatcaaagtttgatttcagctgaaatgaaaacattattttctaaaattgatgaaaaattttctgatgaaatttcttttaatgacattatatataagtattttcaaataagtactgataaaaaatgggtatcaataagaaattcaagaattgtatcatcaactggatatgctaccattgaaagaaatgttgaatcttcccaactagtttagtaaatttttcttattgttactgattagaattttaaactgcttcgccgtccgaccaaatatattcaaataataatatctaaaaacgttacgatacgatttctctaatttcaagatatttgattgaattcattatatagacaatgaatatatgatattaaaaaattttgtacagccgttttttaaaaattatcaatattctgattattccaacttttgaaatgttgtaacgcgtaaaccatgtaatattgaatgttgtaaaaaataaatatttaaataaaaaaggtgttcttactcaatatctgtatgttaatattagataatatttcaatttatatagttcaagacaatattttacaaaatattgtattttaaatgatggcatgttctttatttataccaatattcgataaataagtcctggcggttttttaaacggctttgtcgccccttcttaattgacacgaagtggcgtcaattttgtattcgacacgataattttatttcaattaaaagtgccaacatgagcatcaaaaatctcaaaaatggtcacaatctattacaaaattctcaaaatgttcatccggtcatcaaatttgatataatctcataagattcagtaggttcagatgaatggaaacacgattgatactccagaaattatatattttgttttacctaaaaattgggaaatgtcgattaacttacaagagacttccccttatgatatacaagaaatgttcaagcaaaattttggtcattattcactcgcaaggacaaatatctttggccattcgaatattgagatatttggtgtcgttttggaggacgttgcaaagttaaaaaaataccgtacgctaaaacaatatgattgcaagagctttataagattgaaagttgatcataattgatcaaaagttatgtttgttgagagcaattttcgacacaaacatccaatatcactagattttcattatagttggttgggtcaatcaaattataacttacactaaacaatgagaaaatgctgcatatattagaaggaaaatagcataatctgtcagtgtccgaaaattttatgatatcagacgttcttatttaaaagcaaaagatgttgacacaatcaaatcaatccaatctattatctatcagtcatcaaataattatgaaacgatattaaatttgaacagagcagataataaaattatcacagcaacatttgtttcaaggaagttaaataataaaataatatctagagatacattacaaatcgatgacataatgatgatcaatgatttcgatatgcctattctaaatttattattcattgatgataataataattaacagatattaacatttacaattatgtaaagtaaagaaaaggaaatatttaaactcgtatttgatgatatagaaaatatagttggcataccaagagtcgtaatcattgttagattaaaagcacaaaatccagcaattgatgagataatgttaaatactataattgtttttcgcagagttcatatgattagatcagttgaacaaatatttggtcctcaatttataatatataagtcatctcataaattcattgagaattaaaataagtcgttataaatatattaattccttaaatcaaactattcggagtactgtcaaaaacataagagctattcgagcattaattgatgatgatatcgattgttatgatcctagtttcttattgtctgtaaatttaagagaacaataaacaactaatgcgatcgaaggtttaaatggtaatatacgggaaagattataatggtaaaaaagataatgatactgttataaatatattggataatttattcacagaatttgctaggctaagtgagagaatgcttacagaaattaacaataatatttatgaaggtaatattaaatgttcaatagcagtagataaatagaaaaatgaagtcgataatactaagaaaactaaaaaacaaataatggatggaagagctaatatcgaattattgatatggattaatgagaagaattgcaaatgtattacaaagattgaatatggtgttccttgtgttcatgaaattattaatcgtgtagataagcaaatcccattaatatcacaagaacaagttctaaaatcatctaatgaacttaaagatataaatttaaatttattctctagaagaaaaaggacaaggccagcaaatttaataagaaggtcagggagaaataatcagaaaaaacattattcatgcagtatatgtggaagatcaggtcacaacaataaagcaacatgtttaaatttacatgaagagaatataaacgaaaagatgttaatcatctgaagaagaagaaatgaatgaaaacaatattttagaaaccgaaaaagaaataattgaagacaactatacagaaatggaagaggaaagcatgagaattaacctatttcaaagatatcctgtttttcatgagtttttgtttgctataggacgaaaaaaaatccacaagacatagaaacactgaatggaatttattatattcaatggaaaacagtaaaagagttaatacaaaatcagtctatggatgtctcggatgaaatagtaattatacaacaaagtgttttgcagtatttactctgagtatgattttaaagcaaaatataaaatttgaagctaaccttattagtgaactcaaagaatgcatcgcccaagcaactcaaagcactgatttaactcttcaaaaactttcatgtaaagtctttgcacaaatatgtgttattgaaaaagaatcttgtctggaatcaattcaagccattgttgacaatgcctttagttctagtgatcccaacgtcactatgtcatgttttaaattttttattgaaatttttaaaatctcaagtgagcttaaaatctcaagttttattccaatataccgcaagacttatagcctagctattgttcttttgtcttcaccaaatgatatcactcctgaaatcaaaatttcttccatcaagatcatcaaagagggaaacatttttctatgtgatgaacttttttcaactaatgtcgaacaaaaggttggggtagttttgcgaatccttttaccactaattaaatcatccgatgaatatgaaaaatcattatgtatgagagcaatattcttcatgtttttcaatttaaaaaatgacgtaatctttttcttacaagattttttatgcttgtttttcgatataattaattgtgaaccaaatttgagtgaagcttatccatcaatgctaatgttggttgcacatttgttcgaaattttttcttataattcggtatcagaagaaatattgcatagctttcgcagtagattggaaattcttttggatatatatcaaaagcagaaaaaccttgaagaaaatattgattatgcaaatcaattttatatatctttgttaaaatgttataaagtttatgcaaaaattttctatgcgatgtcatttggaaattctccagaagattttcaaaaagaacgaaaacaaatacttcaattgtggcaattggttgaaaacattttgagacttcaaagtgaaaacattaaagatgaattaatctcaacttgtattgatactatattacaatatgctatgaactgctcaagaaaaaataatgttatcataaacagagaagtgtttcataatatgatttcattaggttatgggcgggataattttaaaaaaatggctaaaaatgcaatgctttttgttaggtctcgataaacagggagtcaatacttataactatttccaaatttctgaattcatataattataatgtttacacagtataaccatatttagttaaactgaaataaatgataaataaatatatatatatatatatatatatatataacttatttaattaaacaatttttcaaatttataatatatgaattgcatataaaaatgttctacaaaaaataacattaaaatttgtgatatattataatactaaatttagaaaaaactccgtgaaaaactgtctactttcatacaactacgaagttgcaattgcatgataaaaaatatatgtacgggaagatatttattatcaaaaatgcagatgattttgacttttacaaattcatccaattggaagatgttaaaaatgaaaagccttaaacgataacttcatcaaaaaagcatattaagtgaaacacaattgtatgatgatattatttagcatttaatcattaaaattggtatataccttttaggttgacaaaaagcttctatgaatgacattcttatcaaggaagacaagtttttcacggcatctttataatgaattttgatctttttagagaacatttacacatattttaaaaaacaaaaacaaaatgaaataaatttatttaacacaaatctaaataaaattttagcaataaatgtctatgaattcatccactgttttgatgacgtatgatctcaatatatcatttttttcacttatcagaaagtcgtctttcttctccataagtgacacaatgtatttatttacttgttgcggcagtacttgatcatctattttttgttctgcgaagttatttaataggtcaattgaagctccgacttcatttttcatgcattttatgaatgattgatattcgatcaattcgcaatttttttcttttaattgttttaaatgattttcgacttcttttttatcgattttattcgcgaagtaacaaattattaaatcgaatattaaatatttttcgatagaaacattatattgtagaaatgcattcatgcattcgatagcgtttgggaaatcgatccaattattatatgatataattcgtaatccgaaatatctttttttaggttttgatatttcatcgaataaataattaataatcattggtaatgtaataaattttatatttttcgtattattaattttattagtttttgttttaaattgttcatgaaatgctttgttttgtttattattcttttgaaagaaaataaattctttcgataatgaaaagaaaagatccaaattcttttcattactttcaatcgaaccactaaacaatgaacaataaaacaaatgtaaataactttctttaatttcggttgggttaatgtttaaataattatcaagaataatatcaaacatagtaaacgtgaccttataatattcattttcggataagattaaaaacaaaattaatttttctttaattctttcgtttttaatcttcgatattaatattattacccatatactccatattgggtttgttgaatattttatatttggctctaatcgatcaataaaatcatttattaagtcatcatttgttatatatgaagcaatccaaaaacaaattggaagtaattcataaaatttttcatttaacattaactgagttaatgatttaaagaatttttcttggataaaatccttttgtaatatataaaatattaaataaatatgttcatacattttattattatcaattaaattgctttgatttaattgatgaaatattttaaatattaaacaattaatttcatcatctaataagtttaataaagaaacaagtaaattaattgattcgataaaatcttttaaatcatttataaatgttagatctgtagaaatttgtactaataaaaaacttaataaatctttaatttgatgaatttcggataaatttaataattcaccaattaaatatttaaatgaatcattataaaaaggcatcgtacgacatatcgataatattattgatctacattcagatatatttaatttcgaattccgttttacatttttaacattaaatttgttatcataaaaataaaatattcgtaacgctataattaattcgattatattcgtggtaattttcggtaaatatgtaggaaataaataacgtgaccaatgtcttaatatacgtaaatgattttctgcttcaatatcaatccataagttataattgattaatatatcattaattaatttgttttgtaattcgatataatttaatgattctaataaattaaataagtttaaatataaattataattccgataattcgatggaagttttaataaactatttaatattaaatcaaaccctttatactcaatgaaaaatatttgtgcttcatcactttcattaaataaagttgaaaataaacttaaaattgtttctgcgaaatgtggaactaattcattttttgttgtttttaaaggtattaaatcaaacaaaggaattaaattctttaatttaaatgaatgaattaatacatctacaaatgaattatgaaatgtttcatgtgaacaataattagttaacttaaaatcgccattcgtaaaaggtttaaaataataattattatcattaactttcggctgataaaagaataaacatgaatttaatgatattaatttgttaaaacatgggccattatcgaataaactttgtaatgttacatcatctaatgaagaaaacattccgaaacatgtaattaatgatgggaattcaggtgtaatactatcattagtaataccacctatgaaacaattaattaaagttttttgtttccatttcattgttggtataattatttcttcgaaatgacttaaattaattgatactttaaaaagtgattcacctattttattactcggctcatatgaaaaatgtattaatatccattctttattaggtatttctacttttaaattcccataagtttcatattcaccattattttgatatatattaacttgattagaaaataaactaacttcaattgattttgttgattctattaaatgtaatattttcggcttataaagtggaatagttgtatcatgatgtacccaaaatactgaatgaaaagattctaaatgtgttgagtttaaacctgaaatagaaattatatattcaggtgataatggtatagttactgatggttgaattttggaattattaacaattgagtttaatgagttaaatatatcgatgtaataatatgaaagttcattactattatttataggctttaataatgtattaaattttttaatgacttcaattgatgatattaatgatgagatttttacaataatttttaaacatataataatatattcattaactttatcattattaatgtttttatatatgaagtttaaaagccataaatcaatatgatctaaatgacatgaaatacaattatgtggtgagaaagaacataaatcattaatgaattgtaatacatcaattaactttggcgtattttcaaatatggttaaaaaagtagttaatatctttggttgcctgatataaaaacaaggatttttatagattaaaccattcgctgctaataattgaacaattgtttcaaatatattatcagatggtgaattttcatatacattttttattgcattttcgatacataattgttcttcatcatttaataaatgaatatttgatattaaaactaaaaatgataatgaattatataaaaatgtttttgagtttttcgttgtgtctaatgttaaaaacgctttgaatatgatcggagttaatgattcatattgtagtgctaaattacgtcgatgtgtaatagattcattaattttatttaaaacgtctgagactaaatcaatataatcaatatcagggaaataattacaagcattttcaaccaaacgaataatgattttaagtaaattatgatcaaattcaacttgctctgaatttgttaaatatgttaatgtttgatctaaaacaaatgatcgaagtggtacctcgaaaactaaagaaagaaatgaacaactaaaaaaataatcattaaaaaaacatattaacattgacttttctaggaatatatgtgagataaaatttaaaattcctgttcgtgctatttcaatacttttattattagtttcgttactaaatgattgataatataatgcactcgaaactaatccatgtgctaaagatattcgtgcatcatttaaatcgggaagtatttgatgatttgctatgatcctatgtaatgtttcagtaaataataatggatatggcattaacctatgtaagatctcttcgatataattctgtgatatatttaatattaattcaagtgaataatatcgaattgaatttagatgatcaaagtttttacatggataaaatactgtgatttctggattaaataaaattggattcattaataaatcaaaattaacttctccaattgaatcaggcggaaataatttacataaataaaaaaaagatgcatagaaatcaaaaatatgtattggtcgttcactagttttgattttaagcaattcaataaaatttgcgataatcattttcatatgttctttgttctttgaacattgagcaataattgtaaactttgagataattgaatcatgcattaattcattaaatgtattagttttaggtatttcaatgttttgtgatatttctaacccatttggaaatgtgtttttttggattttaaagttaaattcattgtttttctctttaggaagttcaatgaaatttggatctgttgaatcaaaaggtatatcattaataacaggctgtaaactaatacaatcaagaagttcaattggaacacgcgataaaaaagcagacgtaaaattaattgatacaagttttaaaaaatctggaatatatggaaaaatagtataattcgattgtaataaagattgaaaagtaattgttacaagtttttgtgcaacagtttcagggagatcaagttgcgataaatatcgaaaaaaattatcagtgatctttggatttgataaataattgttatatacccattttgctgcatttggtaagatctcataacactgttctggaataacacggcctcgttcgaaaaataagtagattgctgatagaaatccatcaaatgctttaaaattttcattgctaaaaaatgttgaatatatttgtgtatatgctgaaacagaaattaattttatttgttccgaattcccataattccaaatggtaactaacgcagataataaatctatgattgtggtatcaactgaaattgaatctccatatgcaatattccatgctaaatatgtaagaaatgtaaatgatgaagcatatatgtaagtgtttttattcatttttctaattaaatcatcaagaaaatttggaaaaaatggaaaagcaaatgaatgattaagaagtgttgttttgatatctaagcctttttctaaatctgatgaaatagattgtaactcttttttattatacaatggaaatttgattgatgcaaaaattttttgatttaccaacacatcaggaactgatatttttccgactgtttgaataaattttaagatttcaacacatatttctttttggttaagaagcttcttcatgcttccacaaaggccgtttatgatagcattccaaaacgaacgttaaagaaacatggaatggtatattccaatcattatccaatttgcaatattatttgtaattctaattttttatcacacaatggaatatatcatatcaaaaaaatttcatccaaatcatacaactcttgcaaattgtttggttacaccatattcaattattgcatacttgataagttttgctgaatatggcgttgaaagatatttttgggaatataaatcaaatttaaaatcaccagtcatttggattggtgtggttcttgtaataattggattaatcattagatttaaagcaatgtatacagcaggaatgtcatttactcatgacgttgcttatgaaaaagtagatgaacatgttttaattacaacagggttatataaatatattcgacatcctggatatcttggatttattatatttgctcctgcaacacaatttatactcataaatccaggatccgcagttttattctttgttgttctttggtttttctttaagattcgcattcatgatgaagaaaaagcattagttcaattttttggtaatgattatgttgaatataaaaagaatacaagaacgtggatcccattcatcaagtaattgtaaatagtaaagttaaacttttatgtaaaaaataagattttattttccatatttctaaatctactctaataaatttttggtatagaattttagtatggaaaattatttgcacgtttgaagttttcaacatcagcatcaatttcatcgcgatcatgaactttatttcctggtggagcttgagcgatgtccctcttccactggtcaacgggtggctgttcaaaatctggttggattccgctttggaccagaacgtcatattctgttcttgccgcaagaagttgatctctgtgttcgtatattggatttattctttcatacctcttcttacgtcttgcactcattctatgtccgccagctgctcttcccattttggagaaatgtaggaaattttggtcgtggtcgggcgttatttcacatcaaatttcataaaataatttcatatcacatgtctttaagtttttgatgagtgacaaaaaaaacttttctaagtgctcaaagtctgcagtttccaatataattactggtgtgaaagaaatttatgaacctttgccaagggcagtaatttctttgtatcaaatcgctgatatttatgataattcaattcaaacaattgaatcatcagaagaaaaaagtgataaattactctctgaaatgacagatataatagatgatttccaaaagcgttttaaagaaattctttctcaatcgcaattacttgacatcaaaaattagaagaatgaatctatttaatcacacaaaaattagcttgaaagcatcatgtaattctactttatataatttatgtttactccagtttttttttaataaattaatttcgtaacaatttttatctttatttctcataaatttttgttactcacaactatgttatccggtacgacattacacttatcataatctttgttcttatttttgaattttgataaataataatttttcacatttctgaattttttatattttttactgttttagcaaatcaaaatatggaatttattgaaagatgtctgaaaatgtgacttttttatttagtctgtcttagctttttctccttgtggtgctggttgaccttgttgaccttgctgtgcctgtggggctcccattccgccttgtctgaagaacatcatgataagcattgggagcattggaaggaaagattgtaaaagacttggcttcttctgtgggatttccttgataaggcgatagattgtgaatccttcgttttgatagacaataagttgtgctgtatactgatcgagaatgttaattgagtaacgaagattttctgtggttttgccatgggatgacttcattccatcaacacctgatttgaaggtaaatgtagaaacttcttcgaagttttcggcttcactttcagaaattgagaacgtgaaagttgtattatcatctgtgggtgaaatgagaattttatttaatggagtagcaacaccatcttcatcttcgccaattagatctccaataagtgatccaatttcactgcctgatgataattctaaagaataaactttaatttcttcttctttttcttcgccatcagtaccaactggaactgctgttatgttccaattgccttcaaaaaatgatgtgtagttgaaatcagcctttgctaatgcaatgaaggaaagtaaaaccaacattggattggccaaatatgctgcgtcacttttacacaaagttttgaaaatatcaccgcaaatatgttctttcagcatttctccgaacacaaaaaaaaagttaggccattagtcatatctagaaatatacgacttttaattactttattatctaaaccaaaaataatctcatgagattataattgtaaaatcatttattttttttaaacatgtgtttttgaacaattactgtgataccatttatgtaatgttaatacattgaaattatttgtttcagttactgtgttttgatacgaatacaaagaaatggatgacaatttgcattgaatccacagctaattgaatacatattagcggaagatttagttcagatagatattataacaaaatacgcagaacaaattcggcatttcgaacttcattgtttcgaaaccaaccaatccaccagctcaacaattaggcctaataataaggttcagtcggctctttaagaagacatcattcaacgtcattcggtgacaactgtgcacatgtcggaagcataataatgggttcattcagatcattaagaagtctaccaatgcattggtaacgatatcgttgtctggtcaacacttgtattacaatttggtgtaaaatgcgttcaagcattaattttaacaaacagttacacaaacatttccaaaactattatcaacttacaatgtttaactcattttatttttaaattgaagcgaaatttgtttattattagatcattcttgattattcattatataatacatattattctgctttttatattattctttataatgaagaaaaacgaataaaaataaaaataaagaaacagaagaaattcttctaattgtaattgtttgtattgtaattatttttatgatttcacttcttattatctttttaatttatgatcatcaaactaaacgaaatagtgttttaagttatcaataaaatgaaaatgcaaatgcaataaataacaatattaatacggaaaatgttattaatttatctcattttgaaaagtatccatttgctaaagattttgaagaaaacgatcttgtatgaaaatttaatgtttctattgcatatctataataaacatataaaaatttaatggaaggaaacataaaatttgccaaataacaaaaatgtttgtatttaataaattaataaataaacaaaaaattattttgttcttaaaatatgtttatttagatctgacatataaatttttcttctttgaaatcgtttgcaaatggatcttcttcaatatttgaattattaataccaactgaaaatgtattatcgatttcattaattttattattattttcttctgaaatgttcatttcttcttcatttagttttcgcttctcattttgatatttaatcataaaatttattattatcattacaaacacaataattattacaattataataacaattataatgataattaatgtattattatcattagtgtttattatcattagtgtttattattacatcttcgatataagaaatataaaagaaattcgaataataagtaaaatattataaataatatataaaatcgacataaatatatttagtttcagattcgatgaaagtaattgaataagattttaagaacgtataataataaattgataaagtttttataaacgataaagaataagttaaagtataaggattaacgaaagtaaaattcattgaaaatgtattaacgtaagtatttgaatcaaaattattttttgatttcgtaaatgtattcgatttgataaatgtattactaattgtaaatgtatttaaattggtgaatgtatcactttgtgtgaatgtgaatgtgagtgttggtgggagacattcgtcaagtgttgttcccttagtagcattcatatttccaaatgttccattttgatatgtttctattgtcataactgttgtcgcatttatattaacaaatgcatcattttgtatttctagtgaagttcctttattaaaatgaatacattgaagtgatgtacaattagtaaatgcacatgaatttatataatgtacattttcaccaataaaaattgtttctaaacgtcatcattttcacaattcgaatattcaaaactcccctaaacatcaaataattgaagtttgataaacttttagaaaaatttgaatagaatagaaaaagttgagacgtaaagtcaaaaaactgagtcataatgaggtgcaagaaatataacaaagtttgattaattatgaaaaaattaacaagaggaaaattaacagtaagaatggttttacaagaagttttatgaagtatttaaaaaaatgatttaaataacaattttattcatttaaattaatttttaatgtattaaggaaattttccatttgtgtttgttttacagggtgcttaattctataaaacattcctttatacgaagcaccagtttcttcacatcttttttctatttctggtattattctatctattttacttctatcatttaactttctaaatgaaagtgacttcaatgtatattcgacacattctgccaaatcgaacagcgaattatttaacaattcaatcatattatcaacaatcaaaggcacaagtactttaatatgctcaggtttaaaaactaatgactcaagcataaaatacaaaaaatgtgaacaatcattcatattaatatcattcttagcaagttttggaagtaacaaaaaaaatattggtaacatttggttccggatatcatctaaagaaagaggttcaagaagatgagaaaatgcatacgcataaaaacaaatggatttctctttctcgttggaacatttctcgctcataactttaaggaaacgtcggaattcatttcttttatcttcgatttgaataaggatttcttgtgaataaagttgcaaaaaatgacttcgaacacgcgtgtcactaatgctttcagtaagttggttaaggcagcgacaaggatcaaaatctttggggagtggttgattaagtaattctgtaatgtcttcttcttcttcaaatgattcatcctcttcttcattgggttctatggctttctttggtaattcttcttcctttgtgaattgatctttttcggtaattaatgatggttcttcttttaattcttctatttttttgagttcttttttcgcttgttgttcttcgtattcttcacgaatttgcttttcttcattttctttttcaatgcgtatttcggaaatacgatttacataagattcaaaatcaacttttggaaaatgctgttctttatgtttttttgtttttctttgaaatttgcgtccaggtggtaggatagcctgaattggtatttgcttctttggattttttaaaagataaagttctcctatcatccctgtgctggaagacgtttatctgtactttttgtaaaagatacaaaatcaattcacaatctttagaaagttccgaatacatatctaaaataaatgattgtaaatttaagtgttaaccattggatcagatcaacactaatatttcacacctattcatatggggttggtatttcaatcatttcatgaaatgtatacttatcgattctagtgagagtactctcacataaaaatttgtttagattttgaatcacagtaagttctataaaaaaaaattggttaatattttaataaaaattaaatatcaaattccattcaattcaaattttattgttgttctgctttggcttcttcttcaacaggacgtggaacttcggcagcctttgtaacagcacgaccttggtgaagcttcttgagttcgtcaccgctgaaggttggtgccttaatgaccttaatcttagtaacatagacattatcaacttgcatgatagtcttgcacttttcaacaatagccttttcgattgtttcgttgacaattgtttggcacaattctgggattgtagacttttcaattgtctccttcatgatagcaatacaagcatctctaatttcacgcttcttggattgttgagcatagcaagccttcttgtttggattcaacttcttggtgaaaccaatgctaaaagcacgaagaatgtatccatctgctgtacgaacatcaacttgagcattgatgagtgtgcgatacttacgaaggagtgaagagagcttatcgtttgtgagtctcattccagcgaaaacagttaatacgtcattattttgaacatcaactgatttccagctgaacaaacggtatgcatgagattgttcgtcaacaaggtcaccatgggagagttcgaaaacacggttgttaaggtaatcagctggtgtctttccacgagcgcatttatgtgaaacagtgaatccaatatcacgttttgaaaagaatcctgggacgaaaacatgacgccactccttctttaagaaggtatcttgcttgattttcttggaagcctttcctttttgctgagcttttcccatctcaaaaggccgaccataaccgtcagaaagcattcaattcaggagaacgtttatctggggtcgatttgatttggtcgtttaaacttaatgagaagaaaatttagggcagatgaaataaacaaacagatattaaatgaaaatgacgaagaagaatcaacgtctgaaagtgaagagtacattgatcaagaaattgaatttaatccatcaagattaagaacagatgcaattccaacagaaggaatttatgaaggacaaaaagtatcaagaaaagaaatagaagcatcagagccagagagtgatgaatctaatgaagatattgatgatacttattctgaaagtgatatgtacatccctgaaccagatggttctagaaaccttgaagccgaacttgaacttcttgaaaaagatgaaggagctggccttcttgattccttaaaaaaacaacaagaagcagatctcaaagttgctcgaggtacttctgctcttcaaaatcaatattctgctttactcttactaaggctaaaaatgcaaggtgcactttcagctgttaatttattgccatcgaacgtacataccgaagaatcagatattactccttttcaagctgctacagaagatcaagaagttgcttccatgcttgctgaaatcagtcagtctgccattgctcttcaagagaaacttcatcatcttaaattggaaattgaaaatacatatgaatgggaagagtccgaagctgcgaaacggatgattgaaaacatatcccactggtctcagcgtataagactttcatctggaatgaagaaaggagttgttatcaatcgaccaattgatcaacagatttcagctgcccttagtgataaggagattcttatacagccaacaagacatagagagcggggcgacaagatctttggctttgagacgcagcctgaagttgtgaatgatgtttataacgattcgaattggtataaacggcttctttctgatgttgttggaattcaaaagaaggaaactaaagttgttgcaacaaagccaaagaagcagttgttaagaagtcggcaaatccattatgatataattcccgagttacaaaactttatgacaagtgtcatacaaccaattccatcttatgcagatgcattgtttaattctttaatgaaataaatataaatttttggattattacgtatttttctggatgatgattatgattaatttttaacaggtcaaaacatctctgaagccgccaaattaatgttaaagaatactccaaaggttgcagtcaagaaacttacatatacacttgtgagaccacaatttgcaaatctcattaaataaataacttcaataatttaaatttgttataaagatgaaatcttatgaatattaatattgaacgaatttattgaaaaaattctctcaatcgaatattgtatgaaaatgtttttaattaatttttaagcataaatttttttatttatgttttttgatatcacacaacaaccccaaaatcgattcaataattgagaatagaagattcataattcaatactttcagatgggacacatcacctcacattcctacctcctttgtgctgaaaatattttcatctcatttttgaagaatgatgattcttttacttggcttgataagctgtaatgatttctgtatatcgaatcattgataaagataaaaaactgcaacaatattaaaagcgccagataaaaattttaaacttatcacctgataaattttgtaaaattaatggaattaattatactattattggtattgaagatgaagcttttaaaaattgcaaagatcttagaacagtcagaatctcagataccattaaaacactagggacaaaagctttgtatcattgtacttcctttaatagatgttgatttaggtgatgttaaatttattgatgaaaatgcttttcaaggttgtacttcaatttataatgtattatttggaggtttatatgatattcaaggatgtcataatttattcgataaaaacatcacaatatttgttgataggaattatcaagacaaaacattctgtggttataatgttgataaatctttagaattattcatttatgcaggtcccgctgtaatatataaatggtttaatgaaaataagaaagaaatttcattatatagatcacttgaaaaaggtgtttatacaattccaacagaattagttacaaaagaaacttataaaatagtcggaatttatgatggtgcatttcgtaatagcaatgatttaactgaagttatcattcctgatggtattaaatatattggtgaagaagctttcattaattgaaaaaaaaaaaaaaaagtaacaatttcatgtgatgttaaatatatcggtgaaaatgctttcaaaggttgttcttctcttaatgaaataatatttgaaggtttatatgatattcaatcattgaatgtattcgatcattcattaacaatatttgttgataggaattatcaagataaaacattctgtggttataatgttgataaatctttagaattattcatttatgcaggtccaactgaaatttataaatggtataacaaagataagaaatatgtttctttatatagaacactcgctaaaggaatttatactgtttctactactgtttcaacacatcctgattattctgtcatcaaaatttatgataatgcattcgaagatcgtaaagatttaactgaagttatcattcctgatggtattaaatatattggtgaagaagctttcattaattgtgcttctttacaaaaagtaacaatttcttcttctgtcgaatttattgatattaatgcttttaaggattgttcttctttaagttatgtatatttcaatgggaataatgaaattaattataatgatcctgttttcccttcatttacaaaaaatttatgtttctgaaaattataaagatgatacattttgtggaatgaatgtaattaaaatacaatcaacttcaatatcaacatcaacatcaaatgataataataactttaacaataataataataataataataatttagaaattcaaataggtaataatattaaagatgaaacatcgaatgttcaaaaaagaaggaaagaaattaaatatgatattaattggatgtgttgtcggaattgctataattgcaattattgttggtattacaatatttattaaaacaaaattacataaagaagaagaaattgatgaagaaccaatgcttggtaaagattgtaaatatactgaaatattggatactgatccttaaataataataataaacattttaattcaataatttttattttgctatttttcatcaaaaattttaaacgtgaaaaatgattcaattaaaataaaaattaaacaaataatgtgcctttacttgggtgaacattttttaaattgattatttgaatgatacttataagaaaatatatttataaatatattttattaagtgatttagtgattttgtcatttgtttttgataaaaagtaaacaggatttaatttcggaaggtaagatataacaataaaagttaccaatacatttaggtaatactatggataaaaaaatgaaaaattaagatacatttaaatcaatataattttaaaatacatcatgtaattcaatatatttttagagtcttgcacataggttattaaatctagcaaataagatgctaagctttaatctacattaactttttatatatgcacctttttaaggctgctacacgcttatcggttattttaaaggtttacgccatttttgagataaaagtgacattagaatttgttgtgacataagcgtgtagatgaattcattatcatataatgggaagaagaagtccaaactcaaaaagaataaaagttataatcattagtgtacctaatggcatggtaacttccattcctctttcaagaaggcactttgaatgaactagatcaaatctccaaaataattagaggaaatgttgaacaacctcttgataattcagaggctatttcgaactcgaacgaaatttgtttaagtaattttgacgaatttaacatcaaccctttcctttttggctcaagcgatgagcaaacatttaacttcaacttctgtgacttttgggattttgagtaaattatcatatcgatttatttaatttcttgcacatgcagctatcaatatgaacatttcctcttggttcgcaaaaaattatttattcacatttcttgatgaaacattactatttcagatttgcttggtatcgattcttttatattacatatgatacataaaagtgttcaattctattgtaacatggtaacttacaattttctacttcaaatctattttgaaatttttgtaacatcgacttaaggaccaaataaaatagatggttttttgctctaagtgaacaagcacgtatttattcttgacaacaagtgagaaatgaattaaaaaatcaaaaaattaatgaaagaatgcactttaataaaaagttaaaatttgggcaaaaatctaaattcaggttacctttaatttctttaaatctctcgaatatacattatatatttatactaattcgtatttatatatatatattaattgtaaagaatttttttatatttgcaaagtttttatttgtaactttgatctggagcctaaataattattcaagtagctactgacattattacctctaatttttatgcccacaatcatactaatgttatcaccgctaaaagaccttttggacaggtgcctaatatataacattttttaatcagaaatgtggtatctcgctttcaaaattgtgttgtgcttcagcaaaactataaaaagtgataaacattgggtgtttgaacatttccctctttgttgacgattttaagaattttttatttatatatgttatctatataaagtttatataatcatgagtaacatttttagactcttttaaaacccaacgaaaaatatgttttaaaggtttgattatttgcttctacttgattatgatgataaatcaatgattggtagattattaataattctgaaattttattggagaattacttttatcattcatgatctgagtttattcattggcgtgttttagtagattgtgttatataattctaacaaaaacaaaataaaaattattgaattaaaatgtttattattattatttaaggatcagtatccaatatttcagtatatttacaatctttaccaagcattggttcttcatcaatttcttcttctttatgtaattttgttttaataaatattgtaataccaacaataattgcaattatagcaattccgacaacacatccaattaatatcatatttaatttctttccttctttttgaacattcgatgtttcatctttaatattattacctatttgaatttctaaattattattattattattattattgttaaagttattattatcatttgatgttgatgttgatattgaagttgattgtattttaattacattcattccacaaaatgtatcatctttataattttcagaaacataaatttttgtaaatgaagggaaaacaggatcattataattaatttcattattcccattgaaatatacataacttaaagaagaacaatccttaaaagcattaatatcaataaattcgacagaagaagaaattgttactttttgtaaagaagcacaattaatgaaagcttcttcaccaatatatttaataccatcaggaatgataacttcagttaaatctttacgatcttcgaatgcattatcataaattttgatgacagaataatcaggatgtgttgaaacagtagtagaaacagtataaattcctttagcgagtgttctatataaagaaacatatttcttatctttgttataccatttataaatttcagttggacctgcataaatgaataattctaaagatttatcaacattataaccacagaatgttttatcttgataattcctatcaacaaatattgttaatgaatgatcgaatacattcaatgattgaatatcatataaaccttcaaatattatttcattaagagaagaacaacctttgaaagcattttcaccgatatatttaacatcacatgaaattgttactttttgtaaagaagcacaattaatgaaagcttcttcaccaatatatttaataccatcaggaatgataacttcagttaaatcattgctattacgaaatgcaccatcataaattccgactattttataagtttcttttgtaactaattctgttggaattgtataaacaccttttttcaagtgatctatataatgaaatttctttcttattttcattaaaccatttatatattacagcgggacctgcataaatgaataattctaaagatttatcaacattataaccacagaatgttttgtcttgataattcctatcaacaaatattgtgatgtttttatcgaataaattatgacatccttgaatatcatataaacctccaaataatacattataaattgaagtacaaccttgaaaagcattttcatcaataaatttaacatcacctaaatcaacatctattaaagaagtacaattataaaaagcttttttccctattgttttaatggtatctgaaattctgactgttctaagatctttgcaatttttaaaagcttcatcttcaataccaataatagtataattaattccattaattttacaaaatttatcaggtgataagtttaaaattttatctggcgcttttaatattgttgcagtttttttatctttatcaatgattcgatatacgaaatcattacagcttatcaagccaagtaaaagaatcatcattcttcaaaaatgagatgaaaatattttcagcacaaaggaggtaggaatgtgaggtgatgtgtcccatctgaaagtattgaattatgaatcttctattctcaattattgaatcgattttggggttgttgtgtgatatcaaaaaacataaataaaaaaatttatgcttaaaaattaattaaaaacattttcatacaatattcgattgagagaatttttcaataaattcgttcaatattaatattcataagatttcatctttataacaaatttaaattattgaagttatttatttaatgagatttgcaaattgtggtctcacaagtgtatatgtaagtttcttgactgcaacctttggagtattctttaacattaatttggcggcttcagagatgttttgacctgttaaaacgcctttgtatggccaggaaatgacatatgatgcgcctccaacaagtccagcaagagatgcttcgacaagtttttgggttgcaaagttaggaagctgtggaagtacctttggaaagactttggctgcaaagtattcatcaattccattcttaactgtgtgatatccaacatcgtttatgattgatttaaagaggccatcaaatggttgcttaacatcagttttccttgagttttggagtggggttgcaaccaaacgtgttaaagcccacattgggagacctgtcattgcgccaaaaataaatgggtttttgacagataaattgtataagtaaggtgattttttaagtgtatttttgctaaagtctttcgcaacttgttgtacaccagatataacacaagcatcgcgataagctggtgcaagtaaattttgagtattgagcttcctactttgaatcaacatgtatgtttcacctgctacccctgaaacaacagcggtgcaaaagctagcggcatagctctttaactgctgattatcatttgttttttgttgcttttgaggttttttggccttgaacataaaatgtgaacagttgtaaatggccatttacaattttcaatggcaatcgaccactttcaattcaaaatgaatagaggaatgatagcaaccttttatgatcgtaaattattcttctttgtaggacataaaaaaatattctagtcgtaaatcatttagtgaataaacgtcgtgcttcttgtgaagctagtttcaaagtatattgaacaaaatcatatttcacaatttctaatttgaaatatggacatctatgtgagtgtggttaaacatttttgaagcatttgactttgtattggaatatatgagaaatgcggaaaggtaaagaaatcgttttgagcaaaatattttgtacgttaagaacaaatggaagaaaatgaaatcaaaaaattgaggcataaaaatagaaatttaaaaacaaagattattaatcaacacagaaaatattcatataatttagaaatgattaaaaagcaaaatcaagatcttcataaatcaattgaaatggaaaaaaataaatatgttgaaatttttgcgaaactttccaatcaaatttctgaacttgaagcaagaattcaaagatccaaccagaacaaaaagtacagttttcaaattccagcatttccaatgcaaaaaaataataccaaaaagagacttcatgaactagaacaagaaggagatcaattgctggggaaaacagatagagttttaaaaaattgttatttccatgaatttaataataaattgtcttttaacaacgcgtcaactccacttccatttaagcctattaaaatacaacttccagaacctgtaaatgatcaacctttaaagaggcgtttaagtttttcttctttaaatgaagaaaaatatcaacaaacaaacaaaaatgattcaaaacgaatttcggctactttggaaatctctgttccaaagcattttcaatcatatgaaacaatagattcggatactgataaaacgtcagttacaaaattttctgatttgatttctagtaaaagttcatcaagttatcaaaaagaaaatatgaattatcaaacaaacagacaatcaaaagaaaatatagaatatctattaaataaacagacaaatgaagtacaattgaaatcgaatatccaagaacaagaaagcatacaaagcataacaaataaacaattaaaagaaaacatagaatataaactaaataaacaaacaaatgaaaccaaattccaatcaagcaatacaaaacaagaaaatatacaaaatcaaacaaaaatagaaaacatacaaaatcaaacagacaaaagcgtggatgaaaatcttttaagtaaaataaacaaacaagaaagtgaaaatacacaaaaacaagaaattgtaatagatcaacaaaaaagtaatgaaattatagatccacaaaatcatattgtagacacaagacaatttaattcaaacgcaaacatcgatattaaaagcaatttgaagcaagaaattcacaatcaacctattcaaagaaagaacgaatacattgaccaaatgaatgttcgacattttgtgtatgaagattcatcttctgaagaagaagctagtgaaacaattgctcacttcaaaccacaacttgaagaagagtcaatgcaagaacaagaagaaatcaatgatcaaagtaatgcaccatccgaaattaatacaacattatttgctggaatgcaagattataaagataatgatgaagaactttctttagaattccaatctgatggctttccttctaatacattagataaaacaaaaacagaatcatcaacattgaaacaaaacgaaaatgatttagagaatgagtctttcgaaattgaatttcccgatgacctggaagatgatgatactgaaggttggggagcatgataaaataaatgtttttttaaatattaattaacatatccttatttgcgagtatttatattttttcttgtaaaataataaatatatagttttcattttcacataatttacgctaataatcttttttataatttgtagaattatctcaataaacataaaatttaaaacatagacgcaatgaaaaacctgtagaccaacaccttaatataaacctacatccacactgtagcattataaataaagaacatatttggttaaatatttaataaaaattttttcgatttaattttgtaattttcgcaatattcctattttcactcacttcactaaggagaacgttgtcatgaaaaaaatcttttttctctattttctttacatattttaattaattcatatttttgggactgaatatatgttaaaatttctatttactaacaaactatataaaaatttatgatttatctaaaattttgttgaaaccgaatgaataatttaaaatatttttataacaatttttactaatcgaaataaattatttctcattttcctcatcacacaatatatttacaaggttcaccaaatcctttgctgatatttctccacttttatcgcaatattttacgaaatcgtcgaattcattctttttaacgttaacatttaaattctttgtttttttaacctttaacaagaattccaatgagttcttaattggattaatatttctttgtttataaggctttttaatattattttttatttctttttcacattttttcgcccaaaatttaatcgaatcatccgaaaacattaaaattaatcgttgaacaccaaaagtaaagaaaagaatcgaagtattattctcataaacatttcgaaatacttcatcaacttcatcacaattatcatttgttataatcattccaagttgtacacttaaataatcgagtgcttcgaaaattggtttctttaatgatgaaatcgattctaataatatactaaatgcatcttcggttttattcttttgatgtaataagaaagaaatatcattaataaaagcaacacctgataattgattattaacattaattttttcaatgaatttgtcctttgaaatttcaatgacctgcttctgaaaaactgaatcgattgtaaaaagtacagttatgaaattacaaacggcctcaaacaaaatttgtgttgtattttggtcaaataactttttgataattctgttaaattgtaatttttgttgatgtaaaatttcgacaaatttttgatgatatttttggttttctttttctttaataaagtaactaataaaacatgataataatgatattagataagacaaatcttttgaatttggagacttatcaattaaattaataattttcaaataaatttctttattataaaattcttcagtcgcttcgaaatatcgtttaaataaaccctctaaaatttcattaaataattttgtgtttgtactattcctatgcattttaattttgtcccaaacttttgctatgataatatttatgtcttttttcgatagattttcaagacttaaaatgaatttaataacagagccattacttaaacaataataaagtgcgcgttcgaatattttcgagttaaagaatgcgcttgcgaatttagttggataaaaactaagtaaaagattcatatttcgaacgaatggacttggaatatatttatctaataatgacaaaagatcttcgatttgtttttgttttgtgaaaaattcatttgaaaatttattagttaatgtgttattaaacaatttaatgaaatattcgaagttttcagcaccgaaaatatttccttttgatactgttatcattgtatttattaaaatgatggaattatttattaatatttcttgtgacgatgattcatttactaaaaattctaataatgaacaatatgaatctgttggcgttaatttctttttatgtattgatgaatttgcacaatataattctttttgttgtacaattttctgtaatgttttcaaattctttaataaaatatcaattaattttatttgtaattcttttgaatccttaaaaactattttaaataatgaaacagtattttctcgaacattagcattcgtggaaaacaaaaaattatttatccaaaatgaagaattatttataaaaatattcgataattcggaatttaatgaatttattaattgttctataaatgagtttttataaaatgatttttgtgtttctaaaaaattataaaaatattttatatcaatttcttcattctttgatatatataataatatactaaaataatttgaagcttcataactttcaaatttttgaagattttctttaactgaatttataaattcatttttccgattaacatttaataaaataattgatgctaaaaaagaagtaatttgacttccatttaatttcgatttacaaaaacgtgcaatgaattcattagaaaacaattccataatttgatcttctgttaattcatttgaattcattaattttaataatgaatcaaagaatttaccatattttggaattttattattttctaataaattcaaaaatatttttatccatttttcataatctatttttaagttatcgataatacaaatgaatggaataaaaacttcttcatgtttaacattttgtaaattaagaatatcttcgaaatattctaaaaatgatttagaaaatttaatacataaaatagaattacataaaatttcggaatataataaacgaattgaaatattatcgaaatcatttaaaaatcgatcaattaattccttcgaatttaaaataatatttgcattatctttattatttttacaattttcattaactttcatcaaaagattttcgattgtttcaatgtcatcagttttaacaagtttaaataacaaaaattgtatatcatcggaaatttcggatatactttcaatcaaatctttataaaaaggatttttagttgtttcatttaatacgattgattttaattcatttgaaattttatcgaaaatttttgtatttatcgaatttatatttaacatttcatcattcgaattattaattcttttcctataatataataaataagcatttgtaccacttgtgctagaataactttttttaccaccaaatgcacaataaggtatcattcttggatcgaaatcacttacaatatcatcattaaattctagccaaccatttttacttgtatttatataagaataataatgtcctgaagtagcacaacccatatgcatttgtataccgattaagtcataaatttgttgatcagttgtaactttcattatcgatgttaaatttaattcattagggaattcaaatttactattaattttattatattttccaatattaaaatcataagaaaatcgttttaaatgtattattaagattaatggcgctttaagtatcttatggcttctttttgcatcgatttttccatattcttctgttaaatattgatctttaccagataaatcatctgggattaaaaacgattctaaactttcttgaatatttttatatcctttaacatcgagtgaaaatgttataaagttttcattactttcacatcgataatcaacatcattaccaacagtttcatgtacaattgtacctttaaatatagattcgattgaaggtattaaatcatttaagcgatcaattaataattgaataaattctactgcatcttgttgcttataaaaactaattggctcatcataccaattaaatttagtaatgaaaaatttcggatctatagaaacaattggtaaaaaactcatttttgctataagtttttgaaatgaagttatccaattatcttcttcaaatgtttgttgtaataaagcgtttttaaattcaggaatgttacataattgttgaattgatgaattaatataacatgttgcacctaagttcttcaagcctggcggatttccatttttttgcattctataaattgtttttttagatgatatcattggaatattaataactttcgagaataaaatattcgaaagtttcaaattccttttaatcattaattccaaaagcaaaaataaatcttttttagggatataaatatgataattattaagtaaaatttgatcaattaatatagtaaacaaaagtttttcttttggaatattttcaactttttttgctaagatataaattgttgaaattattccatcaataaatgatttattcggcaaagaaaacataattttctcaaattcattattaaattcgatattaaattcctcaaagaaaacatttaaaacattttttaataattttgttggatcatctgtttttttagataaaacttttaataaataaaaataacgagaacaatgttgtcctacagaattcggtaacatattaattaaattatcactaaatgcttgataattaaaaaatgatacaatacaagttgtatattctctaatcgttttattctcagaaaagataaacctttcaaataaagttggaatatttgaaacattttggaaaattggtgattccaaaatagcaaattgatataatattgttaaaaatgtttcaatcatttctatatcatctgattctaatgaatattttgtaatttcataaataattttctcattcattaaagttaatttaacttttttatttttcattaattctaatatatatttatatgtgttacaaattgattctgttaaatatttatctttaaatggatcaaatgattcatttaatattatttcaaataatgtcttcgctccattagaaacataaaaatgatttaaccaattctcttcttcaaatattaaatgttgaataatgtttatacgatataagaaataataaggatgttctaatgataataacttattccaatctttattttttgttttctttaataataatttccgttctgtttcatttgttggtaattgatttaagatattataagaaactaatgataattctgaattatcttttaataaattattaaataaacttttaataaattcaggtgatttcattaatattatcgatggtaaattttctttttcgattttcgatttagtttggatttttcctgtccatgaaacgactttaaaatgaatgtcatcatataattgaaatgttttctcgataactaatttatcatcaacataaaaatataaataatttcgtggtacttttacaattttcgaaacttttaaacaaaattcagaaaacgtaatatcagttggtacttgtaaactcatattaagatcaccttctaaatatacatcacacatatcgaatgaaggtatgaaaagattcatagttaatccgaattgttttttatcaattggatcttgaataagtttaataatttgtaaaataccttttaatgcatttaattcagatgaataatttaaacaacgtgaaataaatgaattaatattaaattttttaatacttttagaatatatttcacataaataacccataatcattaatgaattaggtatagaattccataataactcaattccttctaatttttctgtgttttttggtgtgtttttcgtaataaattttaatttattgatttgtttaaatataaatataattaaatttgatatttcatcattaatatcttttaaatttgttaatttctttaatatatataataaatattcttttgttaatatgtcactttctttaataattgttttatagaattcataaatagattttgaatcaatatcaattaaatttaatgtaaatttaaataattctttgaattgtttcatatttaactcttttatttgagttaaaagatattttattgtacttaaaaattgtaattgcgttgaatgatcaatttcaataattgcagaaagtatataacttaaaaatgattgcgaatcatttgcatccattactttacaagaagcttgaaataatgttaaagcaaattcgacgttttcatgttttttaatcatttttatacaattcttttgtatttttttacagaaactttgatctaaaggaacaatattatttaatgcctcgaataaatttgtttttaattcaatatcattatcgattttataataaaatttctttaatgcttcaaatatttgtattttattttcatttaatccaaactctgatatataattaataaatttaagtgtagcaatagaaaattgtttactttctccaattaaattccataaaaatttccttaatgatatacataaaccggaatatataatttctaatccattacaatatatatttgctgttgcagaattactttttgtagatgaaacattccaaaacaattctaattcttcttcagatactttcttttgtattgccattaacttaaatatgttacaaaaattcggtacaagttcaatatgaagatcaactaacatcttttggatgaaatttgattcatctaaaacttgatataaatattctttatctaatgtaccagtcataagttcatttttaatagctgctaaaccttgaaattgtttattaatatattgtgataatgcatattttaatgataaattaaactttatcatatcaacatttttcttttgtttatttgatatatattgttttaatgttttaaaacattcttctgtttgtcgttcatctgtaccatgaatatcttcatcttttaaattgtctattagcttggagaaaattggaaataataaatctgatatttgtgtttgaatttttggtaaatttttgtatatttttatgatttgtaaaatccaacatgcttgttgaaatgtaaagtcataggatgattttaacttggaaataacatctgaaaaaaaatttgttttagaaaatgtacttaagttttcagaatatgaatgagaagttaatccatatggattcataaatgagtaaaatttgcaattttgaccaatgataattcgaaggactggcttaataaaactttttgcatcactgaaaaataaaatgggaataagtggaatagttgaatttaaatatttgttaatggtatttgtatgtaacttattaaaaccatgatccaaaatatgagaaacaatatttggaacaaaggtattaataaaaaaatcagtttcgtctgtatatggagaacttaatttttgtgatttaatatattgtgatactaaatcttgaaacaaggataagttgtcatcgataataagttgcttcgaagggtcttttaaaattttactatttaagtctgataatgtcattttctccatattaaaacttaaaattatataattcccacaaaaatttcaaactgaaaatttaaacgttcgacgtgaataaccgttatggtcgaccttttcgaatgtcacaagaagttgttatccgcgttcgtgtttggggaggagaatccggtgttactgcaaaacttgccccacgcctaggtccactcggtgttaactctggtcaagttggtcaacaagttgctaaggctaccgaagaatataagggatatcgttgcacagttcaaatcacaattgttgatcgtcaagctacaatctcagttgttccttcaacatcaactcttattatccatgcccttcaagaaccacatcgtgatcgtaagaagacaaagaatgtcaaacacacaggtagccttactcttgataacgtcatcgacattgctcgtcaaatgagacataagtcaatgtcaaagacacttgcaggaacagttaaggaagttcttggtacttgccaagctatgggtgctcaatgtgaaggacagaacgctaaagctatccaaaagaagatatcatctggcgaaatctcaattccaaatgagtaaaggttccttttttaatatttctgtaactttttggaaattaaaatcgatcaaatctgattgaatttattttctgttgcacttttcatttttgcacaattgctaaaagtgacaatgtcaaatggcgaaagtgatgcaaaattgaatttatatttgttcatacgttgtttactttcaatctcagcggtcactagtggtgttttcattggattttgatcttatgcattttgaattttgtaagtgttattacattttatcctcacaaaccgttcttaaaatcaaataattttatttttattaatgtttcattttttatttgtcagttattttcataataattttatacaaaaaacacatgttaataatcagcatgacatacaatttcaagaattttttttcaacatcaataaagattttttaaagcaatcacaacaaatcatgatcataattagctttcatcaaaagattatattcccaatgagttttatgaaaaaaatttcttatgtatttactcatttcttacagcatgataacatagttgaaaactttttctttttttatttaataataaaattttttactattgttttaattttcctgattattgtacggaaatttatttcgatctctttcttttttgatcacaataatttcacaccatttccctttatttttgcattttttattatcgatacattagaagtattttcaaatggaacacttgttatattaagtcccaatgatttttcaaccctatacaagagtgaaactatcaatgttatcattagtgctggaataattgatattccaaatgaatgttttagtgaatggccatttttagaaactgtaaacattagtaattctgtaattgcaattggtgaatatgcgttttctaaatgtttaaatctaaaatcagtaaacattggagaaaatattactaagataggaaataatgctttttatgtttgcatttcattaaaaagtattaacataccaaactcagtaattaatattggaatatttgcattttttcaatgttctggactagaaaatgtaattattggaaataatgttacaataattggaagtaatgcatttgttgagtgttcttcattaaaaaatattactataccaaacttagttatgattgttgatgaatttacgttttcaaaatgctccaatttacaatcagttgtttttggtgatagtgtttctacaattggaaatagtgcattttttagctgttctaaattagaatcagtaatatttggtaaaaatgttaaaacaattggccaatttgcatttactgaatgttcctcattaaaaaatattacaataccaaactcaataattttcattggaattagtgcattttcatatacagattttattaatgtaatgaatgaaaataaatattattcaaattatgaaaatgatggtattctatataacaagaatataagtgtacttatttgttgcccagtttcaagagaaaaaattaatattccatattcggtaactaaaataaatcaatatgcttttcaatattgttctaaattagatttaataattatcaaaaatatcgtggctttaataggagaatattcttttttatgttgttctaatttaaaaacagttattattggtgataatgttaaaactattgaacgttttgcattttacgaatgttcttcattaaaaaatattactattccaaatccaattgtttccattaaaagaagttcattttcgaaatgttttaatttagaattggttatcattggggaaaatgttaaaacaattaaaaacggtgcgttttcttattgtaaatcactaaaatgtatttattattatgggaaacatcaaccagatattgcatatgatgcatttactaatgtaaaagcacaaacagtaatggtacaatctttttatcaagagacaaaatttggtattttgaatgtaacatatgaagtaaatgatggctgtcctaaaaatatatttcctcatacaaatacattcacaaattcgaatactttgatagcaaatacatcttcgcaaatatattcaacaaaaactacacattcttcgatgttaacatattccttaacggaaactattgtagcaaattcatttttatcaaatacaattttgttaagttattataattcaacatttattatttcatatacacaatatatgtattatgaatataccattttaaaatatttttcacaatttccttattcaaatttcttaacttatactaaaacaactgaaaatcatgataaaggttccaaaaccatatttatcaatattattattgtaagcgtagttatagttataataatttttattatagttattattatattaacacgaattaagaacaaaaatcatgagaactcaaacagtgctatccaacaatctgaaattgaaggtaataacaattttgttgctgatttttccaacattgaagcagatccatttgctaaagattttctagaagataataccatcaattataaagatagaatgtaaaaaaaattcgatttatttttataataaacttttaaatttcaacaattttttacttaaataaaaatttttattcgagtttaaatacacaaaacaacttttattcatatacatataaatatgatcatgatcgcactctcttcaatggatgtgcttccgttgtaaatacataatcatccaaagaaaatgtatcgtcatcacaaaatatcagatacaaatatttcagtgtctctgataaaaagaacgagtcctgtacatcctcatacatcacaacttgttttgatgtatcttttactgttgagtatccacttcctgtatcacaatacttctttatcgattcgaatattttccatgcttgaattcgagcttttacattatgtgtaactctccaacaataaaacaatgattcaacaagttctggccttaatttatatgtgtcatcataccaaataacatttggataatgacttaaaaatcgtgctgattctcctccaagtcctgttggttgcatattatataaaaatacagctgtatcaagaagttcattagctagcttaaggtaaagttctttatattcatgctcaataagtgatgcaagatataacgttcctggtaagaagaacgatagatgcgatatttcatgtaacatttcaccattgacagaccttgctaaataattgagtgacgtcttgcgtgatgtaaatccgagacgcgaaataccttcttgcattgcaagattaaactcattttggttggtttcattgcttggtgaaaagtatttgagcttaataagatattcaaaatatgaatcaccatatgcatcaaatgaatactcttctcgtgttggaaaaagatagtcatgatctatcatagtgggtggaacaggaccaagaagaagaagagaatttcgtgctttcatggcagcattgaaatattttggatcacctgtgtgaatgctgagatctaaaaattcaatttgacatgtgcctgcatcagcaagaattgtgctttctttacaccaggaataatcatctgattcaccagttttgagatttataagaacacgtggaattccagtttgtgtattgaatgctggaagtaatgagtctccaaatttttttgcagcgtctaagaaaactttatcgcctgtctgctcgtatgctgtaaggaggcctccaacacaacgaacaactgtttcaaaaagagaaactttggaatttaattgtaatgaagaattgatccaatcacgtgctttccttagttcatcatctaaacccataattatcagagaatctagtgagtcaattattgtataacttgctccaaaccaattaattccttcttgtgattgaggacctaaaaaatcatatccccatgcatatttacagtaagcgtcccatgactctttcataactttgcggatttcatcctggtattttttcagatttcctctttttccaaattttacgtacttaatgaacactaaaatataattgattccataaaacaaaagcaacaaggcgaatatgataaagagaatttttatatttctcttgtaattcatgaatgaagggttgaagccctcgccttgtaaaataaacgtcctccgtcaccaaggaaaattggaaattaaaaacattaaaaattgttataagttttaatcaaatgtttaaaaaaaataaggttatttttaatacatatgttttttgtacttatgagcatttaagcaaagagttgaataaaattatttaaatgaaaataagatctttcaaaactcattttatgatttacaaatatcgtttttaactctttatgaattataatttattttaaatctgtaatggtttaataaaataagtattaaatctttgtgtatagttaaaaatttttgattcttattatatgaaatttttagaaaatcaaagttttaaaataattgaaaaattagctctactaaaaagatgtataatcgaagagacaacggaatgatgtatatgactgaagctaacaggcttttacaaagcgcaatagcatttgatcgctcaggaaattatacccaagctaagcaatattataatagtgctaaagtaaaattcaaattggcttcagatcaaccaacattaaacccaaatgttaaagattgctgtattcaacgtatgaaacaatgtgaagagcgtgcaagtgcacttgataatattcaagttactccaactattgaatgttcaagtggctccacattaaattcaaggccaagtagcagaggtaaatatggtaatggtggtagttcctcaaatggtgggactaatagtaataaaaaagatgatgaaagtggagaattcaaagatcgtatatctagtgctattcttgttgaaaaacctaatattaaatgggatgatgtagcaggtttagccgaagctaaaagaaaccttgtccaagcagtcatactgccattaaaacttccacagttctttactgggcaacgtgctccatggcgtggtattcttctttatggtcctccagggactggtaaatcatttatagcaaaagcaacagcaacagaagccaataattcaacttttttaactgtttccacatctgatcttgtatctaaatgggttggtgaatcggaaaaacttattcgagcattattcgataccgcacgcgagaagaaacctgcaatcgtatttattgatgaaattgattcacttctttcagaacgaacagagaatgattctgaaggagcgcgtaggattaaaacggaatttcttattcaaatggatggagtaggtaagtctatggatggaattcttattcttgccgctacaaatattccatggggaattgatgcagcagtaagaaggcgatttgagaaaaagatttatattccactcccagattatgaagcacgacttgcacttgttcgtcttaaaacaaaagatactccatctgaacttacagatgaagatatacaagaagttgcaaggatgactgaaggttattcaggtgcagacatgaatattcttgcacgtgatgcagcaatggcgcctgtaaaccgtatacaacaagcagaaaactttgttgaatatcaaggacaactttatccttgtaatccaggtacaccgaattcgattcatatcactgtacttgaaatgacaaatgagcaactttcaatgattaagccacctgcattaacaattgatgattttcgtggaagtattcagaaagtgcgcccatcagtctcaccaaaagatcttattagatttgaagaatggacaaaagaatttggacaagaaggtaattaaaatataagcatataaaaacatttttatatttcatacaaataaaaagatatattacatttacacattacgcattattagataagttttttctgtgactaaatttgatatttgttgctttgtttgcaatctgtttgatgacagcatcgaaaattatatgttcggaactaaattcgcgaatttgaggttttttccaagaaatttctccttcttctgaatagaagaatctatcaacccttcgaagtgaaagatcttgtgatattcttattggtatttctctaagttctttcccttggaaccaactcatttggagtgcttctggtatcgtcagcctttttgaaaggtttacagtcatcagccctttgatgagctgtctgcattctttacttaagtatgtaggaatttcatattggcctcttcgtatttgacctatcacctgtgaaataattctgcttttccaaggcatttttccggtcaacattgcaaacataatgactccacaactccatatatcacttttacacccattgtaccgaaaaccactaagacactctggtgatgcataaaatggtgagccaacaggtgtggatgtaaaaccgtttttatctacaaaatttgatagtccaaaatctgagattctgatatcattgttttcgtctattaaaatgttttctggtttgaggtctcgatgacaaattccttgtgaatgaataaattgaagagtgcttaataattggtaagaaaaaattcttgcttcatcttcttttaatcgttttttctttactacgtagcttaatagattgcctttagaacagtattccatgattataaaatatgagtttgaatcagctaacacatccaaaattttaacaatacctggatgatgtatttgctggtttgtgcgtatttcgagttgaaaacgtttgtaatggttcggatttttaatagaacttttttgaattattttacaactatatgttttattattaatttcattgacagcaagcctaacaatggaaaaagaccctcttccaataacttcagaaagaatatacggtccaattcttgtttggtttgaaatcataaaagtggtgttaacgctctaacgtattttattttttcggacagaaatttcaattactcaagtgttatatcttaagatacaattgttaaattctatgtaaaaatctcaaaataagtaaataggaaatttccatgaaaatcattatttattcaattgtagccgtaaatgttttgggaataagtattgatgcgttttcttaaggcaagaacaatgtcatctttttgctgtatttcaacaagcaatggataaagttcatccattaatacatggtcattatctcctccatcccatgaagttattccaatacaattcattggctgtaaaagagcagatccaatggaagaatcaaccattacaactctttccaatggcatacctattcttcttagatcttttattgtatatccccatttgaacatacaattatccctacaaaagcaatttttttctgaaacaaatggtgcgattttgtggataatcttcattgcaacatctctttcttgggaagtaaaaaaataaattgtataatacatcgaaatgctttccagaaatgttgccatttttggtctttcttctatgaaaacctttcttttgcttgtaatatagaaatctgttttacttgtatgaatttgcgtttgcctcaccattacatggtcaagggccaaaacaagggcaggcttttgatatgaattcgtaagttgctgaatccaaaaagcaatgatatcttcttctgtcttgtccaaattcgttttgtgcagagttctcaatcttaagcggttttaaaaagggttataataagtttttctgaacaataaaatcttctattgaaaatactgaacgtcaattttttatttctggacccaaaaccggttgtgaaaattttgaccgtaaaatctaacgtcattgtcaatattgaattttaaacattttgcaaaacttttcaaattattttaaattaagtctttatgataagttttttaaaactgtccttggcacatatccattgccactcatattttacatttgtttcaaaaaataattgaaattctaagcatatattaaaaaagattttttctttatcattgctaaatttaatactatttaccaaataaatttgttgaaatcaaattcattaaatgaagaaatctgataacttggattgatgcctttttctttaaattcacgttctgcatcttcaaatggtggatgtatgaagcaagttgccattccagcagtgttagcagcctttattccatggaaagagtcttcaaatacgagaacattttctggttgataattgcctaatcttttacttgcaacttgaaatatttcgggcgatggttttgcagcagttacatcatttccacaaattgttacatcaaataatgagtataaatctttgtaattggatgttttggtttcatggagtgatctttcagaacttgtagcaactgcaagaggaatgtgtttttcgtggattgctctgataattttgtcaactcctggtacaagttttgaagttgggaatagttcctgaagaattttaaatcttttttcacataattcttctggagtcatatcgagatgaaaatgttcaataaatattttgctagcttccatatctgaccttccgttcactcgatcaatcaaactttgttcaaatggaggtggaacaattcgagccaaagcttcgtagtaaagaggaagggtatcaagaataacgccatcgttatcaaaaattactgctttgatttggtttggccaagcaacgctttctcccattgtaaatagtcacttttcattttcatatttttcttctgctttgcagtaacacatctttctttaaatgccttgactaaattaacaatatatacaaaattgtcgaacttattttctacaaaacaagtttaaattatcggctgattgaattatcttttgtgaatagattctgtaaatttagatggagatttacatatgtactttgtttttttgttacacaacatgctgtataaattaggtatcaaaagttttaatttatttataattttcgttgtgctttgatgatttctgtttggatgaacatgtttgatgatctttctttaccaatcgtcgtcgttgggccatgaccaggaagcacaagagtatcatctggaagagccattaaatgttccattatgcctttcattaaacttttgaaattagattttgggaagtcagttcttccaattgatgattggaaaagagtatcaccaacaaaaaccattttttccttggaagagtataaccctgttcctccaggagtatgtcctggaaggtctaaaacctttaatgattcatcaccaaattttaattcttgaccatgcttaataaagttcaaattttttatgaaatccttaagatccacttcaaatcccatattttcagacaggtttaatcttggatttgttaaaaattccaaatcattttttgaaatataaacctttgtttcagggaactcttctaatatacttctaactcctccaatatgatcaaaatgaccatgcgtcaaatatatatttggtggttctactttagatttttccttaatccaattatttacgtcatcagatatagctccagggtcaataaccaaacatttaccattgaaatccaacaaatagcagtttgtttctaaaggacccaaaacgccagattttaaattaaattttcttctcaacaaaccacaactcagcatcttctgtaacttggaaaccaaataaccattaaaaaagtgaaaataaagcgatagacaaattcaataatcagaaaaacattatcgtcattttgaaattcgtatcgtttcatctagggatcttttcttccctaaaaacttttttgctgaccacattgttgtatctttgtgcacataccattttcatagtatatacaattttttaagcttgcattagaaatcccgattttaaaattttttaacgaagagatcatcaaatcttttcagcaattttctttcttattgaagtgttattttaataatctcttttttcgccatgaaacgcgtaaagtatttttaatttaacacaaattttttaaaaaagaaaaaaaattcgaattttttatttcgcaaatttattctggttctcttactgggaaaactctgttcaacatttgtttttgtttaaacatctccaacatttcctttgatgcaagatgtgttggtagtttaccttctctattataccatttatttgggtcagcgccatattgcaacaaaactttcactatttcttcgtcaccgtttttcactgccaacgacagcggcgtatttctttcgttatcattattcggtgcgtttcccaacgctccgttcttcaccaacaattccacagcttcttttgatctttgacttacagctatgtataaacatgactgatgattttcatcttgtaaatcgagatcacatcttgggtcttctaccaaatgttttaatattgaaattgcgtttgattttacgcatctacttaacggcgtttgtccgattgcatttcttacatttaagtttaagtttggtaaagataacaacgccttaaataagtctggatcataagtttcattatttccactatcaaagaaataatgtaatggatgaggtaatttatcagtataacgatttggattaaagtctggacaacgttttgctaatagatataattgatcttcaagtttgtacttgattaagatatgtgtaagatattcttcatcagacgttggatagtttaagtatgacgaatcacaaaatgttaaaagtttttcgaagatgtcataatacccacatttaatagagaagattaatgccgattgatgtaagtcctttaacgtttgattaatggaagagccattactcgctaagaagtttgtcttctctggaagtccaatttcgattgatttagttaaacatgtttcactttgtttatcacctaaatctacatcaatatcattttcgattaaagtttgtgtgatcgatgtggatggattacgtaatgaataaaataatgctgttcgtccatcgccatctcttttgtttatatcttttttgtttatgatcatcttaaggaactctaagttatcagtgaataatgatataaaatgtaataatggcgatgaacgttttttatatgtatttaataatgaaccaaaatgttttaattggaattgtaataattcggcagaattaatctcaaatgagaaattaaaatcactgatcttaagataattaaataacttgaattgatacgcacgatttgttgaacatgcaagttcaattaatgtggatttaatatatattaataataattcttgataatcatcatacgatggaacattaatatattcagagattttgaccttagaatatgaacaatttaaatatttaatatgttcatcttctttaggaaactttaattcaacaattgggttttcatgtgagaccatagttttaacctttcgattatttgcataaattttatcgaatttctcgataatacgttttataggttcacaaattttccaattttcaggtcccgcttcaatattcgcattaaagttatattcattacctatacaaggaaatgatataatgatctttaagttaggtattggtggttcgataattgatgactccaaattgttttgacagatatttaacattaaccaaaagtcatgtaatgattcgaaagtattaaagtcaattgttaatgttcctttcggtgtaaataagacacctataggtttatcgaattcgaattgtacaaactttacacattgtattggagcaccataaaataatggatttataataccacaattaaaactatacgttaatggtaatacttcatgcgctgaatcttctttacgtggcgcaaagttcattaagttaacaaagccacgtgttaatattaaaaagtattttcctgtttgtaatgagataaaatcactatatacaatgtagccataataattaatgttttgcatcggcatcaacttagaaaaaacaacttctgatgaatgaacacgttcaatgacatcgctcggaaatgtggtccatcgtgagatatgtatcgcaattagcaattcagtattcgaatcttccttaatataattgggatgcgcattttctttggtggcaatgttcttgaggtcagaccatttcaatccgctgatcttactgttgaaatatggtgataagtaatcaattattattgatggaagaatttgggaaagtgcatctttaagaatctccttttgattctctgaaaggggaatagaagttttgcgtataaatccttggagatttttgatggtaattggaataaattctgacggtttggaatatttaagaatacttaaaaggtcatgacaaaatgcttctacgctagctacatattggtcacgagctggtaatgttggcttttgtaattcaggagtgacaaatacatcatatgataattcatgtggactaaaaacaccatctgatgtaaataaatgttccataaggtcagcaactttggtgttagggaagagaaaatgctcttcgtcattgacaatttgtttaagaagaattaattctggtggaacatttaatgttttagcaaactgtgtaagtgatttttcaaatgtttgatctccgactgcatttataatgaattcttttaagttggttccatcataatcgatattagatattggaattttgataacaaaagtttcatattttttctctgaatgagcaaaattgatcataatacttttgctgtatttggaactcggatctattaaactaagtacagctttattatccattgtttcatctaattctggtgtggggttttctggttgaggttgttggattggttttccttctggtggattaggctctgttggaacagaagtcggatcttgaggaggagcttcaaaatgtggtctcatttcaagttcatattttaattgaggaaaaattgatagtggttctacatttggtgggagacagaagctgaatgttgggctatggaaaataactgaatttatttcttgattgtcaataaataatggttttttcttaaatgtttctaaaattttggttgctgtgtacttttgatatggctgccatttagtctttgtgtactcgctttgactttcgcgggtaacgtaaaaaaagttggctttgatcacgatattttcttccattttttaacaattatttgacatgtgaattgaaattgtgatatatgccactttttcattgatattgattttattaaatattcgatattactcacataatgacaaaactaaagttattagtataacagcattattaaaaaatcaaacttaattaaattatactatagtttagtggcactaatcccatagaattttccttcttcagcctaaaattcaaatcgacaagtaataatttttgtcttgctccaactcgagaaatctttggtggtctcattttcaaaagttattaaatttttcaacagatctttgccgagcgaatataaagacgacttgaaaagcaacgtaaacagattcttctgaagaagttaatagccctcatgaccatatcccagcaacgtgttaacacagatctatattattgcttaacacagtcggatcaaattagcaaattttggacttgcagatctcatctcaaaagcagcattaacacatcaaagatccacatttggaaattctattgatgaatcagttcaaaaaaactctctgaacttttataaacatagaatttgaattttgttttcgtaaatttgcaaaagtatgaaaaaattttatcgcaaatacttcattacataattaataattacgtaattattcagtgaaattattactttgaaatgaaacaaaaagtataagttcgaaatattttttataaatattaaacaatagaataaaaattcttttctactcaacgtcaactattactttcgacattaatattttgtgttttcatcaaattcccaaaataagtcacagcccattccacagctgatgttccatattttgctactgccaaaaactccaaaatcttttcgttacttgttgttatatcgctttgtttatatctttgaattttcctacaaattccgaacaatttatataacttttcttggtttgtcattgccaaaaccaaagcagcgaacacgaatactccgtgaccatatttagcgaatccattaatttcatttgagtctctatttgcttccatcaaacaatatacgaattctattatcgaccaaatcgaagcgaatcctttcatatcgttaccattttcttcgaacaattctttttcgtatgaataacctaacattaatagatcagataccattcttaagaatatataatcataactttcatcgaatttcggtcgacttaataatattttcattgcgttttgttgttcagtatcgaaaagtttttcgatttcattaaattgtcgaccattttcatcgacgtttgttaaataattagttaattgttgagtttcatatatgtccattgctaaagcttgatcaatcattaacgatattgcaaatatattaccaattctttgcattgaacttagtaacttaatgaaatctaaatcattaaataagaatttatatgcattttcatatcgtgaaaaagctgattgcgtatgagtaccaaatggaggatctttaattcttgtaagtttcgatttaataatttcatatttagttacaaaattattaaataattttggtatttgttgtttaatcatttgatctaataacataatttcaccacttgatatatctttaataaatgtattaaaatgattcacagatataaatgtaattgttggttctaatgcttcttttaatattttacctaaacctaatttacctaataaatcagcggaaagttgttgtttcttaggtggtattaatctcattggatttattaataatataaacttaggaataacattatgtaacatatgttgaacaacatctttaaaatattgtgatataaatattcggatactttcatctttagatgcacgaattatatcattgattggcattaatggtaatccttgttctgtcatcatattatgtgtttgtcgtataatattaatcatatgtttaataactaatgatgatgataaacctaaagttttaccaataccaaataaacgatcaacaaaattatttaattcttgatcaactcttgaagagattaatgtttctaaagcaacttgtttagataataaattatattgattttgttgtaataatgttcgtaatcgataagcttgtgatttaggccaatgtcttaaatgatttttctttaaatgttctttcattgaatcaggtatttgatgtaatgttgcaaaagttttaaatgcattaaatgtaaattccccaattaatactgataatgtatccaaacaaacattagcttctgcacatatttcattaaatattaattgtgaatttaatttatggatagcaatatatgctgcatcatcataaatagataatggataaaagataatatcagtgatatctggttgatcataattatctaatgcaaattcacataatataaatggtaatgatgcacggactggaaattgtacctcttgattaagatctaattgtacttctttaaagtaaaatgaactttgatttgatgcaacaattaacgtttgatctaaatctaataaatcaatccaattctcacttatctctaagaaatcttcaattgtcttcgcacattcatcaatccatgcatgattatttcttttatttttcgcgttttgtgatgatgatgacgaagatgatgatgatgatgatgatgaaggatataatatcgaatttaataaatgttgtaattggattcgtacaaattcaattaattgtggtgatggtgctgccgttcgaacatgtatttcatgtttcttagtttcgtttttcttaaataacatttcttcattttgttgccaatcaccagcgaatgttcgaatttgtgttattattttacataagaattgtttattctttttaattctatttgtgactttttcaagtgaattcttaatgaattcttgaaatgttaattgtaatgatgaacaaagtttttgatatatcgatggaatattataacgaatgtaatcatgaagctctcgacataacgcaagtaattgtaaaattgctttaagttctaattgtgtaaatcctgttcgtactgatcgttcatatggtttcattgttttaggttcaagtggaggattttgtattcttgatgaatattgttcacgaataatatttgttgtcgatgaaataagtttaattgcttcagctgtaatcgatactattgtttcatgtgaacgattttggactttttgtcgtatttctgtttgtaaacgtgataaaacatctaaaaatttcttacgtaaatcatcatgtaattgattaagatcaacaacataaatttgattattattaatggagccaaacatataattcattatattatatgaaaattcatgtactaaaggaacacatggcgtacgttggaaaaagctttttattaaccctaaatctgcagaaggtataattgatgggaaaattcgcttaaaaaaggcaagtgaaactaaatgtgaataacgtgtttcgaaaaaaagtggcgttttttgaagtgatgttttcaagtggttataaacaatcgaaagaattgatgttaacttatcttgtggaatcgttttcattttacttgatagttcgtcaataattggtgaaagttgtttaagccataacttgatggaaagatcaacaacattatttacatgaagatgatcagaatattgtttatcaagttcttcaaaatcaaaaaggatttgctttttagcaccgcgaagtgtgtcgaaacaaaacaatttgtaaataagaagaaatatattatcaagaagttcaacggaccaaactgaagtggtagtaaaaattgtgtgaatttcattgatggagcgtttaacagaatcaatagaattggacaaaaattgaagaagaggtttaagatattcatgtgagatttgacaaaatttcttgggttcacttattttatgcgtttgaagataggacttaagaggccccataattgaccttcgtgaataatattgagatatacaataatcaattttttcttgatgttttttaagattaattataaaacggatatcatgagttgctgacatatccgtgttaagataaagttcatgatctaaacagttttctgttggctttctaaggaaagttgcatttggtgctgaattcggagtagtactaactaattccatatattgaagatcatcaaaatctctattttcaggcatcattggaatcaaaggattagccactgagtgtacactccttggagatcttgtcatcgatgaattgattatcgttcaattaaaaagtagttatttttgtgagatgagacacgttatgtctaacgttttaagtaaacaattttaacgtataaaaaaatgtacgttaaatttttattttttttatgtctgtttcaaatcaacctcttttagcgaactattcttcaaatagaagaagactatcaatagcttcaaatcaaaggtatacaccaagatcttcaatagcaagtaatgatgttgaatttttggaaattcaagaacgagttaaaaatgatattgaacttacaaaagaaacatcaatgagattagaacgggcattaaaagatcagaatatagcagaaaatgaagaacttaaaacagaaaacgaaaaaaagaaacaatttctaaatgatttgaaagaacaaattctggaagttcaagacagatttatatgggaactttcatttgcggttaaacaataccttgttcagcaaaaaggatgcacctcaatggaaggaatatcaatttcacaaattccagtacaacaaattcttgaggatgctgatgcagaggatccacagtcacacgaatgggtcgattggattgaaaataagtttaatgaatatgcataatttttggtaaaacatgttatcatttgagtactcattttttttcttatttctttgaaagctttccaagatttgtttaggttaccgatcaaaaatattcaaaaagccttaattttaattttttcgagtgtgtaagtcttgctctcagttattaagtcgtaccgattttcacttgcaaatcaaacaaaaaagaggtatgattcaaaaaatgaaaacttgcaagttaagattcaaccacttgctaaaattgcataatcgtcgattgaatcgcatttgatcgtttggtccaattccttttgtgcggttaacggttatggtccacctttcttggtaaatgttcattccagccgacatccgcaggaagatcctccgctacttctttgaaaatggtgttattgttgtttcagcaaacaatgctggaattcatgaagaacttgaagttcttaacatctatgttttccaacttggccgttcatttgttaacaagggattcgctaaaaagcaatacgcatggacccacgcttactatacattaaatgacaaaggtattgaatatctccgtaaatatttcggtctcccaccacaagcagccccattaacacttgctccacgtaaggctgacttccttagagctgaacgcccagcagcacgtggtggccgtggaccacgcggtaatttcagccgtccaggacgtggcaatttccgtaaccgtagatcagaagataagaaggaagaaacagctgaagcaccagctgaagccgctccaacagagtaaaacaagttaaattcctattttatatgactttaaccatttgatcattttttgagtataataataatctcatctcataaaatgaattaaaatgaaaaagatgtgttaaaattgtttacccactaaatagttcattgattttttatatcctcattcatctcatcttttactgttttaaatattttgaataaatttcatattttatttagaaacataaaataaatttaatatcttgaatattgaaatcgattcggcctttcataataaataattgttttatatcttcataaaatgatgttcgaaacgcttttaatacagtaaactccaaaataaacaaatattcaataattcaaccaaatattttgaacattaatgttaaaattaatttaaaaatccttatgttcaagaagtaatttaataatttcagcaaaattctttttgttgcccaatatagtgcagaattaaatactaaaaaaaatttccaaatattattttgaaaccttaaattatttatatgaattttaaattaaacaaataaatatcctttgaattgacatcaattccttcatgttgaagaagtggttgcataagtttatattttcctcttttagctgcatatgataatgctatatatattcatagacaacaaatattatgattgatttaatcgataatgcatttaaccatcgttgcattctaaatattttttaggaaataaaaattttctaaaatgaattttttttattaacattaagtcatcaaatattagaatcatatgaatcagcgtctaatatttttctttctcatttattaatggttactgaattgctttcatatttattcctttaaattcagtccattcttttctttgattatagaaactatttcatcattacaattcctggaagcataatttaatcaataaattattaaaataaatatcaaataaaacaaataaattcttttagcattatcaattccttcttgttcaaaaagtaatttaattatttctaaataaccattttaaacttacaagagttgttgttaataatttatatttatttagacatttttttattaagtaattctaatatttctggtttattagatgctaaattaagtgctgttttaaatattttaaataacttccaaccattattttgaaacatcaaattatttataaaaatattaaataaaacgaacaaatatttatagtcttaatatcaattccttcttgttcgagaagtaatttaactatttccgtattaccattagaagatgccaatataagagccgtattaaataattcgaataacttccaaatattattttgaaatccaaaattattaaaatgaaatataaataaaagaagaaaatatctttagtattaatatcaattccttcttgttgaagaagtaatttaactatttctgtatgttcattttcagatgcccaaataagtgctgttctaaataatttaaattatttccaaattatatttaataatattaaattataaatataaattttttataaggcatttaaatatcttttatactaatattaatatctttttgttgaagaagtattttaactatttctgtatgaccattttgtgatgcttttattagtgctgtcctaaataattaaaataatttctaaatattattttgacatataaaattattaaaataaatattaaattaataaaataaatatataataaaataaataaatatcttttgcgttaatatcaatgtctttttgttcaagaagtattttaattacttctaaatgaccatattcagatgcttttataaatgctgtattaaataatttagattattcccaaatgttattttgaaatataaaattacttaaacaaatattaaatacaacaagtaaacatcttgtgcattaatgttaatatttcttttttgtaataaaaacaatttaactatttctatatgacctttttcagatgcttttaaaaaagatgtattaaatattttatgtaatttccaaatattatttagaaatataatattatttataaaaatattaaataaaacaaaaaaatatctttagcattaatatcaattccttcttgttcaagaagtaatttaactatttctgtatgaccattagaagatgccaatataagtgccgtattaaatattgtatataattaccaaatatatttaaataaaaattaaataaagtaattatttatctttagcattaatattcattcttttttgtaataaaagtaatttaacaatttctatatgacctttctcagatgcttttataagtgctatatcaaacaaaatcgataatttccaaatataattttgaaataccaaataataaaaataaatattaattaaaacatataaatatctttcacattagtatcaattccttcttgttcaagaagtaatttaactatttcattatttccattccttgatgcaaacgtaagtactgttctaaaatatccaaacaatttccaaatattattttgaaatatcaaattattaaaatgaattttaaacaaaacacattaatatctttagcattaacatcaattccttcttgttcaagaagtaatttaaccaattccgtattatcatttttggatgccaatataagtgccgtattaaatagttcaaacaatttccaaatattattttgaaatatcaaattattaaattaaattttaaacaaaataaataaatatctttagcattaacatcaattccttcttgttcaagaagtaatttaattatttccgcatgatcatttttggatgccaatataagtgctgtatcaaataaattaaataatttccataaaaaaaagtcaaacagattaacaatcaaataaacattcaattaattatagaaacacttttgccgtgaatatttataatattttctttaatcaaatagtcaaacagttctttattttcaaaaattattgaagtttcaaaaaaatttatagaaatcagatttttttcatgaaaatattgagccaaaaatgtatttcctgtttctatagatttaatgatcaaaactttattaactttcatccattctctttcaagaaatgataaaatttcataattataatatgaaacacatatatttcctaactctcctaaattgttgattttttctattttattttcataaagataataaaagatttcatttctatgaaattcaattgctgctttatatgcatctttaaatgatgaatgatgttgttcacataaatgaatgatttcttcatttccacctgcaactgcatatttacctgtattttctacttttgcaccattcatgagtaaatatttaaaacattgaactgatgaaaaaaatgctgcataatcaattaatgtaacattattttgattaataaatgaatatctttcataaagtgatggttcaattgtttgattaaaatcaaaatttgtttgtgatgatatttcttgaagtttttcgaattcatcatttcggattattttcgcaattttattgggattaactccttctttaacatatttcttatgaagttcccaatcattcttttttaattctttaatgttttcattaaaattttgataaggtttaatatcttcaatttttttatattcttcttctgaaagataatgtgcgaaatatagatttcttttatttcctaaaattttgggttgaataatttcctgttcaatcatttttccataaagatagtttgactcttgtgtataatatgtatgatttaaatatgatatgaaaacatttattacgttattatgtaaattattataaatttcattttcttttaattcaagcgctcttaaatattccaaacatatttgataatgaccttgtgaaacaaaatatgaaaataaagttgagcaaataatgaaattaaatgaatatgaatatttttcattaaaatattttaagattaattcaactgaagcaataatattatcattatttaagtcaaaaataatgtgctctatggtgttcaatatttgaagatttttgctgaatttcgtttgacttcccaagttccccattattttataaaataaactgtaaaattaacaaaaagtacaaaacttctttataaatatataatacaaactatacgttgttttaagaaacgtcaaagcaccgtggaacaattggtttagttcgtgaggctcataacctcaaggttggaagttcgagtcttcccggtgctctttttttattttttatctaaagtttaccatcgcaaactaaaatgaatccagaaaaaacaattaaacaaaaaagatcacctttacgaccaagtgaaaagaacatatttacatcaccaataatagctaattttacgaatggaaaattattgaaatctcccacaccaatttttaaaattacaccaacccaacaaatgcttgatgctcggaaaattccgcaaaaacttatcgggaagcctcgtataataggaaattccgaacaagttgaaatacttttcaatcatattaaaaatgtaggaaagttattgtttactccacaatttttttcatctttgtttcctaaatcactttctcaactatacaattatcttattactacgtataataatagaaaatcaaggattccacaatctcgattagataatcaaagagtgacaaatccaccaaatttctttgcaaacactcaagcaagcttgaatttgtcgcatcctttccaacaaatcaaacgaatgatgagaatacgaaaatcacaaattttggcaataacagattttttacttttatactttgggttcattataattgttggagatgatgataataaagtacactcgttaacgttattaaaaacgttacttaatcttgggattccatcacgaccagatgagtttagtattctttttgccataactattaagcaaggaaatacgaatgaaataatacataatttatcagttgatatccttaaacttttatcagaacttgatcaaaatatttttgaacgtgttcaaacaggctcaatgcatcatgatgatggaattaaatctctctgcattgatgttctttccaagttaaatcctgaaatgattcaacaagaaccaccaaacgaagaagaaacttctgacggtgcaataaattttttaatccgatctgaagaaatgtttgaaaatggtgaaccaccatcaaatgtacttgaatttatatataatgttattcatatcatgcaaatttatccaaatgtttcgacaatatttgaaaaaggatcaaagtgtttaatgattgttctttcattatgtgaagaatttccgattgatatgataagtgaaatattaaatatttgtttttctattttaagtggggatcaattacttgaaggagagaattcatttaatgctgccgagtcaatacaacttttaactaattatatatttgatttaattccatcggacatattaattaaatcaattgctttagtaataagtatttctacagattcaagattaaatttaatattaaataaacttcaagagtatgtaaatcattcagaaacagatataagtcaacaacaattggatgaaattaatgcatctcttgatagatatcatcctgatttcgttaataagccaagttttcttttgggttctgacataaaagatgaaacaattttgttaaaagatatttcaaatgaagaattagaagattctattaatagattaaaaaatggaaatacagtcttcattgagatggaaacaattgttaaaaaatatgacccaataatcatactaaagttcccgttgtatttaaggggattcttgataagagctttcgtaatgtatggtatcgatataccatttcaaataagtaatgatgaacacgaaatgatacaaaaaatgaaaaattattgcatcgaaatgaatgaagttgacctggaagataatgggaagtttggattgaataccctttcacaaagtttaattgctttaaaaaaatgaaattgtttttgtaaaatttagaattttttaatatttttttcccatttttatgttctaagtttaagcatcccaaacacttcagtttttgaatataaatccgatgatttttcattcattcgattctatcgttggaaaaaaatattttttctaaattaaggtttttttgcacacagtgcaaaaataataaaaaccaatacaaaatacacactcggtttgctgacattccatttataaaagaaatattaaattttgggcgacatactatttaatcagatttataaacgaacttattgttgtttttctttcgtttatattgccttttaggttgtggaatttcagtgagttgaagagcttcttcttcttcattgcttaagtcatacttgaatgaatcagaaattacacaagttcttgatgaatcgtctccttcaacagtttcaatgaaaaatgtttggacaaatttatgtgttatttcactttcaatttttccaaaaacattcaaaataaagccacttccaacatttaagatgttataatccatcacactgattttgctccctctagctatgtgaggagtcaaatcctttttggcatctataaaaggaataccatttggtgattccatagattgacgccatattatagctttttcctgattgtaaaactttggtaaatcatttggtgcatacgcaagcttattgtaatatgcagaaatgaattccattgcaatttcgttgttgttactcatgccagctaaagtggccacacgtagcacttttttaaacaatgccattttttgaatatataacgataaaaagtgtcaccatccaacaaatcttgcgaaaaataatgttttttaaaattagtcacaccctcaataaggttttcatataactcaatatgtcaacatatagaggataaagtgtcgatgataactgatttctgcatgtggagttctctgaattcgtttttattcgattagagcaatatctaatcaagtataagcacttggatcatccccaattttttactttctataaatcattttaaagaataaaactcaaaagaaatcaatttgattaactccttcaccaaaatttattattattactcaatcagtaaaaggtatttcttgtgattaagagagatgctcaataatcatatattagtttaaatagtattccaaatccaattcaaattgaaaggaaaaaattgtttacatgcaggaactgtgatttttttttcttttttacttcgtaaagtatattaacataaaacggggaaatgaaggagataaaattcgtcaaacaaagtgttgtttcaagtcacattttcaacattcttgtggtttagttcatcgtttctcatgagaacacttctgaaaaagctcccttctttcaaaatttgaacttcttgattgaattgaacattctcaaatttgtcaaaatgacaacaattttcatagtcataatattatcacacccttaaacaatgattttttgcttcgcgtggtgcctcttaagaaaccctaacatcaaacttaaacacgataaatttgattctactgatacttttttattatcaaaacctgttgtatccgttgattcgtccaaacaagtataccccaagattatacatcatttttaaaagacacttattcagaagcatcattggaagaaaatgatgatgttcttagcaatgattatggaggaagtaacccccgagctcggttattctcagcagttcgcattaccaaaggaattaaatcaaccagaaaatatttttcccgtaatgatattgaagaaaatgattcaaattcattagccggtagtaaatggatagaaacttttaaatttcacaataaaaggaaaaatatttgaatgacaagaagtaattttattactgatgtttgaataaaaatcaatttttcattaatttttgcaaatatttttttagccgttggtaatcttaaaaaacaaaatgctcactacaaaaatcggagaataattatttcaacagtttgtgtttaatttggttatatttagtttggtaaaatcaatttattggttttcaagtaattgagcgatatctgtgtgcccatttttagttgccaagagaagtgctgtattaaataatttaaataatttccaagtattattttgaaatatcaaattattaataaaaatataatatgaattaaacaaatacctttaacagtgatatcaattccttttttttcaagaagtaatttcactatttcaatataaccatttttagaagccatcataattgctgtccaaaatatttcaaataatttccaaatattattttggaataagaaattattaaaataagttttaaataaaataaattaatgtttttaatattaacatcgattccattttgtttgagaagcaatttaacaatttctgtattaccattttgagatgcatataaaagtgctgtattaaataacttatataatttctaaatataaaaaacgaagttcaactatcaacagaacaaatgcgtattttgaatgttagtattaattccttcttttttaagaagcatttgaattatttctaagtaatcattttgtgctgcagaaataagtgctgaattaaatgatcagaattatttttaaaaactatattgaaataccatattataaaattaatcatttaataaaataattgtatatcacaagcattaatatcaatttcttcttgctcaagaagtaattgaactgtttctttgtgaccatttttagttgctaaaagaagtgctgtattaaatattataaataatttccaaatattaatatgaaattccaatatataaaaataaatcctaaataaaatgaataaatatctttcgcattaatatcaattcccttttgttcaagaagtaactgaacagtttctaaattaccattttctgatgcatacataagtgctgtttcaaataatccaaataatttccaaatattattttgaaatatgaaattatcaaaacatatatcaaataaaataattgaatatcttttgcattaatatcaattcccttttgttcaagaaagaattgaacagtttctaaattaccactttcagatgcaaacataaatgctgtacgaaataatccaaataatttccaaatattattttgatatatcatattatcaaaacaaattacaaataaaataattgaatatcttttgcattaatatcaattcccttttgttcaataagtaatttaactatatctttataaccacctataatagcaaacataagcgctgttctaaataatataaataatttccaaattttatttcaaaacatcatattattaaaacaaattttaaatcaaacaaacaaatatctttagcattaacatcaagatcttttctatcaagaagtaatttaactactttataatggccatttttaacagctaaactaagtgctgttttaaaaaaatttaataatttccaattttttttattgaacatcaaataatttaaataatttatacgtaaagtaaataaatatttttaatatttacatcacattttttttgttcaagaagtaattgaaccactctcgaattccctttttcagcagccagcataagtgctgacataaataaatcaaatagtcatcaaatattatttcaaaatgtgaaattattacaataaattctgaataaaatttataaacagcaacagcattaagatcaatattttcttgttcaagaagtaatttaactacatgaacattaccttctttagtaacagctgcttttataagtgctgtttcaaatgatatgaataatttgcaaatattattttgaaacataatattattaaaatatattttaaatgaaataattaaatatctttatagttgatatcaatctcatcgtgaaaattatcaagaagatatttaactaaatcagcattacctatttgagctgcacataaaaatattgttttaaatatttaaaataattcccaaatcgcactttgaaacgaataatttaataaacaaattacaaataattaatataaataggtaatattataaagaaatttctcttgttttaacatcgatatacttcttttcaaaaattaacttcactacatctaatctaccacattgaactgcttcgaatagtgcttcaacaaatattaagttcaaattttaactttttaataaatatatcaaaacttttaaacaaatttttttatgagctatgtggagtccaatatgttcaagaattacttttactaaatcaatgtagcccttaccagctgctttacatagtgcagattcaaatattttgaataaattccaaataaaatatgcaattataatatataaataaaaataaataaaaattattaacatttttcatacttaaacttaatatatctattgcttttaaggtaatttaaaacttcatcatttcccgaaaatgtcaaaatctcataaacatatattttagtaggctttttttgaagtaaatattttaaaagaaataaattaccagtttgaattgccttaatcataaatgacttatcaatttccattcctttactttctaaaaatgagaaaatttcaaagttgttgtttgtaatacattttttccctaacgaaactaaaaatttaatttcaattaatttgttttcataaagataattaaatacatcattccgatgaagcataattaacgctttacatgcatctccaaattttaaatgattttgttcacataaatgaattacctctaagttaccacctgcagctgcatatttccctgtatttgttgttttgcactcatttaatagaaaatatctaaaacatttaactgctccaaaaaatgctgcataatcaattaatgttatatttttattattaataaatgaacatctttcataaagtgatggttcaattgtttgattaaaatcaaaattttctcttgatgatatttcttgaagtctttcgatttcatcatttcggattattttcgcaagttcacctggattaattccttctttaattaattttttatgaagttcccaatcattatttgatagttcatcataatgttctgatatgaaatcactaaaatctgttttatataaatcattttcatcgtttatatacacaaaatatggtaattttttgtacctgagtttgtctgtacaaatcatttcgttttcaaccattttttcaagaatataacttgattcttgagtttctttataaataagaagatgatctataaaaatatctataatagatttacatgtattgcccataatttctctttcttttgtttgaactatttttaaaaaatcaaaacataatttataattatcttttgatacaaaatatgaatacaagaatctgcaaatagctaaattaaatgaataagaatattctttggaaaaaatattcataatcaaaccgacagattcattaatattttcttcatttaaatcaaaaataatttgttcaatagactgtaatgtttccatgttttcgttattattgccttttatttttcttttgcttctaaaaggtaaattcatttgatatcaatgaatattatgtataacaagtaaactaaacaaaaattctaataaataaaaagtgacgagatttacttcgaacacacatttgacttatcggggtgtcacaacgattttgcaaaatctcacctaatattttttatattgaagtattgacacttttatcaacgagtggtttatgttaattctgtgctaattagcatacaaaaagtgagaaacgaatcgcaaacggttgccttgattgaaaaagtttgacataaccggcaaacagaaacaactcaagttacttaattcgagtcgactgtaaatccaagctttttgccaacgaaaaatatgttcaaacatacttaaagttaatattttaaagtcaaaatatcatactaatctgactaatttaaatttgataatttcaataatataaactatattaatctcaataaatttatcaacacgaaaaatttaaatcaattttagatgaaaaaaatgtgataatccaaatttatctaaaaaaaaaaatatgaatttttcattcttgaaattaaaaatttaatataaggtcaaatccattgatcatgatcattaatcacatgttgatttagattttgatcagcaatttcaaattcgctggaagaagaactcttattgcttatgttagatcttataactaatttatttttactgcgttttatcacaaaaataataattccaataatcaaaagaaccacagcaattgcaccacaaattaatcctatcaaagcttcattacttaatttgttgcttttgtcttctaaatcactgcttacaataatagaataaaaattcgaataaaaaatataataagtcgaatattttatcacttcataatcataaaaaatatgctttgtgaaaatataagtaactgaagaaccattaattataagaaaaacagtgtttgataaaaaggaatttttaatggttattgtttgagtaattattaaggaatgagtaaaagttacaaagtttgtcaatctcgaatctggtggaagtgaacctgtgaatgtatttgattcagtatatgtatttgatttggtaaatgtatttgattgagtaaatgtatttgattgagtatatgtatttgattgagtatatgtatttgattgagcaaatgtatttgattcagtgtatgtatttgatttggtaaatgtatttgattcagtatatgtatttgagttggtaaatgtatttgattcagtatatgtatttgatttggtaaatgtatttgattgagtatatgtatttgatttggtaaatgaatttgattcagtaaaaaggagtgtcggaaatgtaatctctggacattcttcaattgttgtaccttttgaaacatttaaagtgccaaatttttcacctttatattgagatgatgtcataacacatgttgcaggaacatagtgaaaattttcaaataacatttctggctcattttcacctaagtaataaatacattgaagtttaatacatgaatcaaaggcactagatttaattgtggttatagattctggaattataatactttgcaattcacgacaaccaaaaaatgaaagtaagccaattgaaatcacagaatttggaattttaacatttcttaaagaataacaagatagaaatgtaaaatctttgattgtatttactgaatttgatatatcaacccttgataatctagtacaatattcaaatgcatattctccaatcgaattaacattatttggaattgtgatactttttaaattagagcatgcaaatgaatagcatttaaattttgtaactgacttcggaatttcaaatatttcattttcgtttcctgcaggataacaaatgattgaagtaaattgtttattataaaggacgtaatcgttgttataattagaataatataaattttcatcagaaactttaataaattgaagttttgtacaactttcaaaaacattttctccaatatattcaattgaatttggaagtgttaaatttaataatgaagaacaatagctaaatacctcgtcttcaattgaagataccgaatttggaatcgtaacacttactatcgaagtactggcaaataaaccattcttaagagtttttatagaattcggaatatcaatatgttttataggagatatataagataaaccatatctttctattgttgttacagaatttggaattattattgatactaataatttacaatggcgaaatgcatattcttcaatcgaagtaacagatgatgaaattataagattttctaaacgacaatattggaatgaatatgatccaataatatttactgtatttggattttcataaaatttattttcgtttcctgctggataacatacaattcttgtgagatccttggtataaagtattccatccccttcgaaattagaataatatacattttcagaagacacttcaatggactgaaggcttgtgcaatcataaaaagcatttgaaccaatcgaattaaccgaatttggaataataatattgcataaagaagtacatgacataaatgcattcttccctattgtatttaaatttccccctattgaaattgttcgtaatttagaacataaacgaaatgcatagtcaccaattgagcaaactaaatcaccaatttcaaccgaaattaattgttcgcattgaaaaaatgctgagcgaggtatctcagttatttctccttcaattataacatttattgcatagtttatgttttcatcttcaaaatcactactatcaattatcgtaagtgtttttgtatcagaatcatatgattgaagagaatgaaagaaaaataagataataaaaatataagcataagatattcctgctttggttctttctctattattagaaaatatcttaagtaaaaattttatcattatattaagtacaactaataaatataaaaaacatttaaaattagtttttaaatctaaaaaatgagaacatgaaattttttgataataaaatggataaaaatatttgtttttaatattttttgaatatctattgacctctatataacaagcataattcggaattaatgatgtttttgaacataatgatttatatgtatttttgcatacaccagaagaaacacataatgttttttgattatagaaatggatcattgatgaacaacatttttggttgaatgttttgattacatttttcaattgatagtgatcatgaatataatgattaatttttttgatatttatacaaaatttatcactataaagtgcgtaatagtgttgtattttatcaggaaggaatatatacctgtacatgataaagtataaaattacacgtacaattatcgatgtttgttcaagctgacacattctgattttcatcattaaattgtgggcaagttttgaggatctatgataaataattgagttgtgttttgaaaatttctgttaaattatatcaaaatcctcgtttttgctgactttcttgacagaaaaaaatttttttttgtcgataaagaaaaatcatcttgatattagtgctttcaaaactaattatatttaaaatatcgttaggataaaatgatatcataatacaggtatttttttttctgcctgtgtcaaaatgaattgtgcaaatcaatatgattatcaaaaaatgattggtaattaataatttgatatatatcaggaaaaaatgaattctttatttcaaaaatcatattttctacttccatttcatagaacaaaagcagcaattgaaacaaattttgcacaccaacaaattgaaatttgacattcaattgaatccaaaacgatatattcattcaattttttgaatcacaacacttcacataaccgcctgtgataaagttttacatttgtatatctattaacgtttattatgataattggaaggagtttaacccctcgtgtattgccagcataatcttttccttcattatttccttggttgtatatgacgggactttaaagtaatttgtacatgtcatcacagatggtaattgcgcatttggatcgattttttcatcatcaaatgacctcttcgcaatggttaacttcggttcaagtgctgcaagccctccaattggtaattgtgaatatcccgtaataaattgaataagcaaacgttgttcttcttctgtcatttcaaccattatttcgaacaacattctaatctgtggtgagttcttttgatatccatgaagaacatcaacattctgttctaaatcttcatatgtgaatttggaattatcgcctcttaatattttacatatttcattttcatcaaagatcttcaaatattcgaatgggaatatttccgaaaatccttctaaaaatgcatctcgaagatcatttaatttgtcaccgcaagtataatccctaatcagtgaaacaaactcgttaaggttactttcttcgacaattatgtcttcacctccttctattaatggaaattctaatcctggataaataaatgttaaaccgactaaaccctcaggacgagataaagactgagccagcatagggtcaacatcttctacatttacattctcgcctctaataaatttaaacaagcaaggattaatgttgatgtcaattaagtactctgtttgaattgattttgccaaaaaagtgccaaagattttagcggcttttatcggcatgagcggtgaaaagaacattccgctcttgcacgatgccattcccggctcattcgtgtcacttctgaataaccttcgttctgtcttacaaagctcatgtgaaaacaaagtgaaaaattcacgtgtaggacctaacccaattcctggctcatcattaaaaattacttcaagtttagataaattttgactaaatctttcgaagagcctacacccgtctgtaaataatgagtctcgacttacatgtatctttaattgttctgttgaaggtaaattaaatagtttatgatcgatattgaattctttaagtaactttttgaatgcatttttcggttctaaagtcaataatttgaatgcaaaaagtcggattttgaatgggaataaatatggatttgaatagattatatccaaacctaacgatttgttcagaaatatttcaaaaggattaaataacaaatcatgaactttacgcgaaaagtggatattttctggaagtcgaattttttgagaaagtttttgtaataggtttaatatgttttgtaattgtgatggatacaaaacactttgttgaatcattgtttgtggtggtctaaaattttcatcttcttcttttagtactatcaaatattgggtgaatccaacctcgttctcaatttctttgaatgttccaattctgagcaaaggtgaattcactgtgtaaaataaaccgttttgttcttttacgtaaattttttgataattctcattaaatgctcgatccaatattgataattgtgttactgttaggtttcggtaatcttccattgttataaaatgttgcatttgtatattattttgaattgcattaagtaaattttcaactccttcatcattaacttttaaattatataacccttcaatggtagaaattgattgacacaactttactgatctttggattgtatcaccatttgggattttaaatgtaacaaatgtgttgcgcgtaaacttgtcaacaaagttatcaatgtctgcatttctttttgaaggtatcggcacgaacgataagaaatcgttaagaaattgagccaaaatttgaatctgttcatcgttcaagtgttcaaaatcgaagttttcattgaaaatttcagtgcagttattgtaaagtttgaattttgaaatttctcctttttttatagcttctataatttcatctgtacccatatttgcgaaatcatttgttgatttacttgagtatgacttttcagtattttttaatttgttaaaattttttgtgtaccaagatttatctcttgaattgcattctgtattccttaagtcatccaaaattaatgactcataaactaatggatctttatcataatgtaataatatcattaaaacaaaatgactttcacgttcacagaacccttttaacgcggaaattatttcgtctgttaattcgaatttttttacctttaaagtcgaagcaatgcacattaacaaataccgaggacacaatgggttttctaataaaactttgattaatattggctgaatagtattcgcaaatgtggttgagttctttggtcgtttatgtcttggaaaatcatatgatgaaacattggttattaatggtaacatgttgagtgcaaactttaagactcgttcttgtgcttcgaatgttttcgattcgttaaataatgattcgaagtcaacattggatgatatgattttttcagaaaattgttcttttgtggataaattaattaacgtggttaagaatttggtgcttttacataaactgctaatgactttttcatcaatcgatcctggagagacatgagagccaatgttgttaattaccttaatggcactatccttcatggcggtgttgttggtcgtttcagatatcgtgattaatggctcaatatacttggaaaattcatcagaaacaaaagtatttgtaattcgtaatgacgcttcaatggctttacgttgtgtgggcaatgaaaaagcaccgatgttgtcaagtaatgggccaattccaatttgcatacctacttcgggcgctcgaaatttggaaataatatcaagcgctaaaatgcaattttcggcagtttcatgccattggatatcggtaagcttatctttaagaacttggagaacattggcttgcataagatttgctgtagaacgatgatgtgcttccaaaacagcatatatacaagaagaagctaaattcccaataacctcattatctgtggtagaaaggatacgaacaatttcggcacagatgatttcaattggaaatgatgaaagaagttctctatcaccataagttaaagttgttgaaagagttgttaaaccttctatttgactgctctcatttcctcttatttgttggataatgttattgtatgcttcaatagaatagtttctgaaatcaccaaaatccatacacaagtttggagagaatttcacactttttcataggtttacttaaaatttttatagttcaaaatggtcaaacacctctgaaagaaaacagaatgaatgagcatgacacattgttgtaaaaaaacattttaacaaaaaagttgtaattttttttatgaattcgaaaaattatctgcaaaaattgttctgttattcatttaccattcaaatagattggtttgtttccaaatgtaaaacttgaagatgttgcatccttcttctcatttgtttctattggtttgttcccaaatgtgaaacttgaagttgttgtatccttcttttcatttgtttctattggcttgtttccaaatgtaaatccagtggatgttgtatccttcttttcatttgtttctattggcttgtttccaaatgtaaatccagtggatgttgtatccttcttttcatttgtttctattggcttgtttccaaatgtaaatccagtggatgttgtatccttcttttcatttgtttctattggtttgttcccaaatgtaaatccagtggatgttgtatccttcttttcatttgtttctattggcttgtttccaaatgtaaatccagtggatgttgtatccttcttttcatttgtttctattggcttgtttccaaatgtaaatccagtggatgttgtatccttcttttcatttgtttctattggcttgtttccaaatgtaaatccagtggatgttgtatccttcttttcatttgtttctattggtttgttcccaaatgtgaaacttgaagttgttgtgtctttcttttcatttgtttctattggcttgtttccaaatgtaaatccagtggatgttgtatccttcttctcatttgtttctattggcttgtttccaaatgtaaatccagtggatgttgtatccttcttttcatttgtttctattggcttgtttccaaatgtaaatcctgaaaatgtcgcatccttcttttcatttgtttctattggcttgtttccaaatgtaaatcctgaaaatgtcgcatccttcttttcatttgtttctattggcttgtttccaaatgtaaatccagtggatgttgtatccttcttttcatttgtttctattggcttgtttccaaatgtaaatccagtggatgttgtatccttcttttcatttgtttctattggtttgttcccaaatgtgaaacttgaagttgttgtgtctttcttttcatttgtttctattggtttgtttccaaatgtgaagcttgaagttgttgtgtctttcttttcatttgtttctattggcttgtttccaaatgtgaaacttgaagttgttgtgtctttcttttcatttgtttctattggcttgtttccaaatgtgaaacttgaagttgttgtgtctttcttttcatttgtttctattggcttgtttccaaatgtaaatccagtggatgttgtatccttcttttcatttgtttctattggcttgtttccaaatgtaaatcctgaaaatgtcgcatccttcttttcatttgtttctattggcttgtttccaaatgtaaatccagtggatgttgtatccttcttttcatttgtttctattggtttgttcccaaatgtgaaacttgaagttgttgtgtctttcttttcatttgtttctattggtttgtttccaaatgtgaagcttgaagttgttgtgtctttcttttcatttgtttctattggcttgtttccaaatgtgaaacttgaagttgttgtatccttcttttcatttgtttctattggcttgtttccaaatgtaaatccagtggatgttgtatccttcttttcatttgtttctattggcttgtttccaaatgtaaatccagtggatgttgtatccttcttttcatttgtttctattggtttgttcccaaatgtgaaacttgaagttgttgtgtctttcttttcatttgtttctattggcttgtttccaaatgtgaaacttgaagttgttgtgtctttcttttcatttgtttctattggtttgttcccaaatgtgaaacttgaagttgttgtgtctttcttttcatttgtttctattggcttgtttccaaatgtaaatccagtggatgttgtatccttcttctcatttgtttctattggcttgtttccaaatgtaaatccagtggatgttgtatccttcttttcatttgtttctattggtttgttcccaaatgtgaaacttgaagttgttgtgtctttcttttcatttgtttctattggcttgtttccaaatgtaaatccagtggatgttgtatccttcttctcatttgtttctattggcttgtttccaaatgtaaatccagtggatgttgtatccttcttttcatttgtttctattggcttgtttccaaatgtaaatcctgaaaatgtcgcatccttcttctcatttgtttctattggcttgtttccaaatgtaaatccagtggatgttgcatccttcttctcatttgtttctattggtttgtttccaaatgtgaaacttgaagttgttgtgtctttcttttcatttgtttctattggtttgtttccaaatgtaaatccagtggatgttgcgtctttcttctcatttgttacaggttttgtttctgctgtttgatttaaaaatgtaaaccctgaaaatgttgtgtctttcttttcatttgtttctattggtgtgtttccaaatgtaaatcctgaaaacgatgcatctttcttttcgcttgtttctgctttaacttctgttgttttatttagaaatacaagacctggtgctgctgatgcttctttcttttcagtagctgaagaagttgtttgactaccaaatttaaattctgatactggtgctgctgatgttgctgatgcttctttcttttcacttgaagatattgtttggcctccgaatttaaattctgatactggtgctgctgatgtttctttcttttctgttgctgaagaaattgtttgactaccaaatttaaattctgatactggtgctgctgatgttgctgatgcttctttcttttcacttgaagatattgtttggcctccgaatttaaattctgatactggtgctgctgatgttgctgatgcttctttcttttcacttgaagatattgtttggcctccgaatttaaattctgatactggtgctgctgatgtttctttcttttctgttgctgaagaaattgtttgactaccaaatttaaattctgaaactggtgctgctgatgcttctttcttttctgttgctgaagaaattgtttggcctccaaatttaaattctgaaactggtgctgctgatgtttctttcttttcacttgaaaaaattgtttggcctccaaatttaaattctgatactggtgctgatgatgtttctttcttttcacttgaagaaattgtctgattaatgaatttgaaacctgatgtttctgttttttcttttgttgttggcaccgaattgatttctgtatctttaacttcggatttatttttatttgtgaaattctttttaaaatcgtgtggtagaatttctggttcattaattccttccaaatcatctgtacctgactttaaaggaagctgtttaaacccccaatcaattttttctttatttgtaagaagaggaatttttctcattgcactcgaccacaaaaatcagttaaatcttaaaagaaaccgtttaaaattttgagaacgttaaataaaattcccaacaaaagatcctacgatggaatccaagcaaataaattccccaaggatcgacaaagtatctaaagatattacaaatttggacaaagagattcagaacatatcacaagaattagataataatctagatcaattagaaactgtatcaaataaaaatccaacaaaagagaaacgtcaaccaccaaaaaataaaattagtaaaaaagcaagtaaacatattaatgctgacgataattcattatctaataatagttctacagaaagtgatggcttaaacaatctaataaataagccacctcagaacaaaattaaaattttaaactacaagccactttcacaaagaattcaagaaacacaaagtaaacgaaatgatttcattcagaagtctaaagaagaacaagaggaaaaattcaagaaagaatgtacatttaagccagttattgtatcacagtatcaaactccaaccaaatcaattccacaaagggagacaaagcaagctcattcagcgcaaccacaaaaacaaaaaaaatacataaacaaagtttcagagaagattatttcccattccactaaaaagcatagtttatattcaacagaagtatatcagccaccgataatcgaaaggaagaaatcacatagatattccgaagaagaacttacgaaaacatttcgaagattatcaactccaaagaaacaaatttcagatgataatgacgaagatgaacttaaaccaaagaaatatgctgattattctgtgataaatagacttgcagatgaatctgtcgaattaatgaaaaaaagaaaagaaaatcaaatcgatgaaacaccaaagaaaaaaaataaacagaaaaaatacgataataatagagatcgatcatgtgagctatttaaacaatctgttcagcttatgaaaaatcgatatgaggcaagtcaattacataagcagttcatagaaatgcaagaaatggaggaatgtagtttccatccaaagatttcgcattcaaaagtgacacattcccaaacgaaaagtgacgtggacgatacgtatcgtaacattgtcaaaaccgctatacagaaacggttttctccaaatcaaaacaataaagaaattataattaaagaaagaagaaaagaatcattaaatacaccagaaattgatcaaatattgtttgaagctgaatcaatgatggattaatgatgttaattaacaatgaataataaataatattttttacggatatattaacgacctcttcttgttgcgttttttcgactattcattctctcgcaacctgttacatgatgcttaagagcatcttcactcattttacgaccacaatgtggacatgcaaccaatcctggtggttcttcgattggtggtaattctggtggtggcccaacatttcttccttcttcaactgctttttggtatgctgcgtacttacgagcagctctaatgctttcaaccattttgtcatgatctttttgccattttggtacatcatctgtagatttttggcttgaagctgtttgcacacgttttgttgatgatcgtgatgaaactgattttgttctatcaaatgattgttcttgttgacttgaacgacttcgaggtgttgattgttctagctgagcggaacgagcttttgtggtggattgctcttggcttgagcgatttcttggtgtagtttgctctaatggagtggggcgacttcttgctggagattgttcaatttgggagaattttggtttctgtgttgattgatttgttaaattttgtatatactgtagtagaagtagacgttttccaattgataaaatacccatgtctttcaaatgttcttcttttatcatcggtaaaagatctcctgttatatcattatcaagaaatatgtcggatgcataatcatacccgtttgatgatagattgtttgaaacatcatgtgcatcccatgacatgaagtttttatccatcattttatgtcaaaaaaaaattcatagaattttaatgacataaatatgttttcaatcaaaataatgagtatgaaattcactttttcattgttagttcgttattattaaacgatagataattctgttaattttgatcaatatgccttcaaatatttttttggaggtaacaataaatgtgatcataatgtttcctttttcttatctgattataagtaggttccactgtgtatgttaaaaactgcatatattttatttgaacataaaaaatgtgatttgataatttgatgatcaaattaatacattcagcaaaatgtcttcgtgcaactgaattattgctgggttatgactcttagttcgaataatgaaataatataattttattttcttgttaaaaaatatcaccaaaaaagtgacaatttgaccacaatggattgggaacaacttatattaaaaaataaagccaagacaaatttattatttgaagcatctgaatttcaacttccaaagacagatacacgtgaaattcgtcttggtaaagattcttttcattctaatcgtgtttcaaatttccttccgtctgtttcaaaaccacaaaaagttgaaactattcaacctactcaagttattgatcttcgtcctgagcgtggtaaagagcatggtgaaacctttctaccagctgctaaacctcatcgtcaatggtataattatacaacacttactggtcataatgcctgggtcaaagctgttactgttgatccttccaatgaattctttattacaggttccattgatcgtatgcttaaaatctgggatcttgccaaagcagaacttcgtatgacacttacaggccatattggtgccattcaagaccttgaaatctccaaccgctctccatatctttttagttgttgcgacgccaaatgtgtttattgctgggatcttaatcaaaattccattgtccgtgacttccatgggcatctttctggcgtttactgtctttccctccatccaaccattgatatctttgccactggttcgcgtgatgcgacatgtcgcatctgggacattcgaacgcgggactcagtttttgttctcgagggccatgaccttactgtctttgacgtcaagatgcaagactttcaacccaatgttcttacgagttccgccgatgcaaccattcgcgcgtgggaccttcgcaacggcagtaaatgtctttacacactcacgcgccataaaaagaccgttcgtgcacttgcgttacatcctaaagagtggagttttgcatccgcaagtcaggacgccatcttccattggaatggcgaagaatcgaaactatttaaagagttcaagtaccataaaagcatcaaaaacgcgctcgcaattaaccaagatgacgtgttcgtaagcgctggcgatgacggtactataaagttttgggattggggaagcggacaatgtttccaagaagtcacttcgattccacatccgggatcactcgattgcgaaaatggtattttcgactgcgcgttcgatatgactggtacaagattaattacatgcgaggcagataaaacaattaagttgtggagggaattcgatgaaaatggtaacccttactgagtaacgtgaaagtaaaatgtaattaatgtaaaatttattaaagtttgtaagagccgattttgttataaaatgtttcgaaagtgaatcaaaagaaaaaaaaatacacagaatgaattatataagattatcaaattaaaatcggataaacttactttgttgctgtgatcttttgaatttgctggaaagaaaaaaaaatttaattatatatatatatatatatatatatcaaactcaaaagttaaaacagaaaatgattaaacttagtatatacatctttttaaaatcaataaacagaaaatatgatgaatcaaattaaaatattataaggtatacatcaaattttaatattactgtatataaaatcaaatcagaaacaatataaacaaaaaattaaatattaatatcgcacagtatgagataaaagaaaataatacagaatgaaactactcagaatcaattaaatagaaaaaatatatgaatcattgtggaattaataattaaatgtttttcgataaaaggattcatatatattttcatctgaatagtattttcttatcattgatcatcaacatcattaccaaaaagttgagtgaattcttgatcaatttattcatctttgcttggaattccaatatattttttatgtgaattaaattaaaaacatcacactgaatgaaataatacataaaatgttgtgcataacgaattaacatttaaacaaaaacttatacatttttatggttattattttcatttacttaaatttcggcagcatccgaatcaatagaatacgtttccattacgttacttactgtactagaactagtggatgcgactgagtatgtaaatgttgtacttccaattacgataagctaatgcatcatgaacttggacaactggatggttgtccatagctaaagcccattttaaatgctgaatttgtaacaggcgcatatgctatgtatgcattatcagttgatgagccgcataagactaaccacgagttattcagattattatctgatcgtggataaatcaatcttaggaattgttgctccaatcgaatctcgcaatttcaaccatttcatctacaatcgctcgcatttctgaaactacatcatatgttttggcttcgcgctataactctcggagcttggctttctttggaaagcaaaaacattgtcatacccatttgtgctaacaagacttttttgttctccactgtgggattactgtggtaccacagttgtagttacatcgagttcaggtcgttcaccttctccatggaggcatattgcgttaaggaaaccttttgtgttattaaataatttttaattttttcttcgttatttaagagatgtgttaaagtgttttttatgcagaatttagcaaaagcgatttttgatttttgaaaatttcgattttttcccaggaaattggggtgcccctattcctgacactttttgaaatgtcctttggtggatttacatttaattggggatcttttaatcagcaaccaaaagaagaaaaaccaccattccagatgtcagaacatatgctcctaacagaattaccaaatgatttaaagaaagattttcttgatgtatacaaaacaattcaagcacataaagaaccagctgcaaagtcaactacatattcatcaaaaaatattgaaagtttagtagaaagcattaaaaaagaaacagtgaatgaacttcttacaaaattaacatcagttgcaaacaacattgaccacggaaaagcagaattagaagaactccaaagtgagttaaacatagcaaaatcagaccttacaaattcttcacatattggagatcctccaactcctttcattaggagatatgttgcaaaaatcaacaagatggccattgatctagagaacatgttagcttctgctggaagatatcttcagccacaacaaaagataaccacaaattcatcgcaggtcatggtcgatcttttatcacaagaacacgaagcaattgttagatgctcagcacgtgtttcccaagtacaagcaaaacttacgtcggtaagatcagaacttgaatctaaattaaacgtatcacattctcaattagatttcagtgattatcagtttgaaagttcttaccaacaaaacattcaagtaaagtataaacagtttcttaatgataggaagcgaaaagttacaaagcggaacgaagaatcagatttgcttggaaattctactaaacctgttcaaacgcagggcacaggttttggatttggatttggatttggttctggtggttttggtactggtagtactggttttggtagtactggttctggtactggtagtactggttttggttctggttttggtggtactggtagcaatacttctaccacaaaaagataatgattttcatattatataaaatttttacaataataaatcagtataaattaatgtttctaattttttaatagcaaaatttttgaggggtttcatacgtacccaactgaacaaatcaataaaatgattacaaccattgttaaactttaacagtgaaatggaacttggtatttgtttactttagtctatgtatgcatatacaatatggattatatacataatatagtttggataaaaatattcaaactaaataataatgtatatacaatatatattatatataaagtcgccttgaaaaaatgtctactttcaaacaactatgaaaaattaattttaaaattctaaatatttttacagcattttattagcaattttttcataatgaaatgattcatgatgtatacctcttctttctatagaaagacagcgctaacattttctcttagttttcaacaaattcaaaaataaataatttttaaatatatcattaataatgcataattatagaatagataaattaatattaattttattttaaattctaattttaaataaatttacttttaagatatcatgcatgattatatattcattccatgtaaaaaatttaaataaaaatatcttatatgcactcaataataatcttcaaatatattttattcattgttcaaaacattccaaaaattttgctgatgtcaaatttaaaacaaagaaatttcatgtgaaaacaaacaaagatagtcaatttttcaaaatggatgatttcacaaactggatcatagatgatcaaataaaaaaaatggaacaaaaatcagcgaaagaaattgaacaacaaaacatgatactcgaaaacaaaatcaatgcatatcgtaacatggtacgtcaataccaaaatcaaaagactcatatggaagaagatattcgttccaataatgaaaagatacgtcttaaccgtacacttccatttcttgttgctcatgttgttgaagtactttcacttgattctgatgaatcttctgatagtgtttatcgtggacttgactccaagtccgccgttgtcaaaaccactactcgtgagacagtttttctccctgttcctggattagttgatgcatcagatcttcagccatctgatatggttggactttccaaagattcatatctcatatttgagaagcttccccaacattttgattcacgagtgaaagccatggaagttgattccaagccgactgaaacgtatgatcaagttggtggattagaaaaacaaatccaagaacttaaagaagcagtagttttacctcttatatctccctccaaagagcgtattaagaagcttggaatccaaccaccgaaaggacggcccgacacacttgaccccgcactgatgaggtccgggagattggacaggaaaatagagctgccgctaccgaatgaagacgcgcgggtgcaaatattggaaatccattagcgcaaaatgaagacgggcaacgacgttaactttagggagttggcgagatcgacagaagactttaatggagcaatgctaaaggctgtgtgcgtcgaggcgggaatggtggcattaagaagaaacgcagacgaaatcgtacataatgattacgtagaaggaatagcacaggtgcaggcaaagaaaaaggctgtgttggattacttcgcatagtttagagatatatttataaatgtttgaaatgtttgatatgtaatggtggaatagggaattgaatcattaatataattttcgtttcgagaaagatattatttgggttacctgcactcaatgctgagcttatatttgtattattatattattatattattatattattatattattatattattatattattatattattatattattatattattatattattatattattatattattatattattatattattatattattatattattatattattatattattatattattatattattatattattatattattatattattatattattatattattatattattatattattatattattatattattataattttcccccacagttttatccgtgatagataaaaactcctattcagaaatttaggtatttaatctacttgttgtaaaactcactttttgatataccatacacaataaattctatgaattctatcaaaaagtgggaagtgtgaagtcatgcttttttctgtttggatcaaagagtattaaacggtttcttggtcagggaattttttttactaaacatttcatccaagattaactattattaacccatggaatcttatgaattcattggtgttaatgatgatggtgatttaaatcttcaagaccttaagacattagagggatatagtgcacttgctgatgacaatttggctgaagatgcagacgattttcttgaacatattgattcaatgaaaccaaacattgtcaatttagttgcttctgttaagatgtgtaatagctttgatctattaaaaatatcagaacatataaaaaatgcagaatttaatccacgacgtttccaagcagttatattacgtattacaacacctaaagctacagctatggtgtttcaagtaggtaaagttaacatagttggaacaagagaaaaagaagttgcataccaagcagccaaaaaattttgtcgaattcttcgaaaagttggttacaattgtcgcattgaggaatttaatgttacgaatcttgttgccacaattgcttgtaactttcgtattcgtttacaagaaattgcaaatcatccgggtcatcgtcaacttgccagatataatccagaaacgtttccaggcataatatatcgcatccctgatccaaaggtaacacttcttatcttcgaatcaggtaaaataataatgactggtgcaaaatcatatgaagatctccaaagagcatcaaattggattcagccaattttgacgttgttcaagaaaacacaagttgtaccgccaccagcaccagctcctcctcttcctccacctgtagcagagattaaaccaccagaacctgttccagagaaaaatgaagaagaagatttgttccacaaaaagaaaaggaggaagccaagtaatccatttgttaagcctccgcgaagttgagtataaaaatatagataagaattggttttaatgtcaaagacattttttgtgttatatataatgtttattttgataattttggctttaaaaataattcttggaaatcatttaaaatatttaaaacagcgcttgaatctgcaactatgttctgtaggacagagattgctgttaaaaacaattgtttccgaaataaaaagaaattgctatcaatgttaaaaacatttttgaaataatacaaatctatacattaataaacaattgtaaattatactttgtgacgacttttatcggctagccgatgcccatttatgaaactatctaataacgactcactgcgaaccaaatgtttttaataaaaattttttcaattttttcgttactggggaggaatctgttttcattgaaataagatgacagaaataatttcattgaaacaaaacggttttaataatttttaaattcaaatatctttatttattatcattaaatcaaatatttttttaaattatgatataaattttagttattaagtgtttttaaatcattcattattttcaagataatctatttttcgagatacgtgaaatcgcattcaatttttgacggttttgaaatttcatatatattatatatataaaataagatctataatattataatagattctgaaatatttcattaatattgtatttagaattaatttttttcctcttctttttttttttttgaattatttcttaaaatttataatacgtagtacacttatttctttgtgataaaaatgcataataaattaaattatttaatgtatacattataacaagattaaatgaatatggtaaattaaaatcaaatatttttgttgtatgtttagctaacaaatttatattttcttctgttagattcattatgatttattcaagctcagatgataattctagttctatgttttggggatatatttttttcttttttacttgaatttgttttgcgttttcgcatgttctcccaaatactatatgccatggtttaagtcaatagtttattgaaaaagtgcgttaagtatccatttataaaaaggatactcgaatcaaagcaaaatacgtaagtctatttgttctggtttatatgttggcatttcttctcctgtctttgttcataaaatcttttttagcaagtatagtaaaataaggtcttatcaaatcctaaggaaaaaccaaatacactatataatacaaattatttttcaatattacaatttgatcttcgccatatcaagcaaatacacactcaactctataccaaccaattacaatttcaatgaaattaataatacttttctcagacacaatatatgttggtctcactttttttactccagaaaattgaagcttgtgttttaaatcatgttactttcggattctgattcaattggcattttttgatcagtgttgttatcaattttaacgatgtttgttcgattttgaattttcacatcacataactgattttagctttggtcgttaaatttggtaaaaattccatatggcgcaagtcagaagggcaccaaagaaatcaggacttttccaaatggatcacagtcttggtcaaaatttattaaaaagcaaagttgtcgtaaaaaatatagttgatttcggagaaacacatccaggagatgttattcttgaaatcggtccaggtaatggtaacatgacacaagaaatgctttctcgtggatgcaatgttattgctgttgaaaaggatccacgtatggttgtagaattacaaaaaagatttcaaagacaacttcaaacacaacttagaattgttcatgcagatgttttaacagtagatcttcctcaatttgatttatgtatatcaaacataccttataatatttcatcagcaattgtttttaaacttctttcacggcctacattccgaagggctgttcttatggttcagaaagagtttgcagagcgtattgttgcacgtccaggatctggtggttggggacgtcttgcgataaatacacagttatttgcaaatgtcaaattagtaatgtcagtcaacagaaagaactttgtacctgctccaaaagtcgacagtgctgttattactatccaaccaagacagaatcaaccaaacatcgattttaatgaatgggatggattaattaaaatttgttttaaccgtccaaacagaacactccaagcgaccttcaagaagaagaagatacttaacttacttaacgagaatcgaaatcagtttttgattgcgcacaatttgacaactgacgttccgattgatgtgtttgttcaaaagtgtctagaagatcttttaattatggactcgcgcccaatgcagttagatattgaggatttcatgtcattattacaaaagtttaacgaaggcggacttcattttcaataaatattttatcaaatttttcaagttaatggaaacaatttttttttctcgtttatatattttgtaaagagctttactaaaagtattactttaaaaaaaatacccaattttttttttaatctacaaaaaagaacgagatagaaatttggttaatgccataggtatcttggtgcaatttagctatttctttgaaacatgcaataattttagatgctaaagtaagtgctgtccattaaaatattttaatttccaaatcatattttgaaattctaagatttgtgattgatccaacatttattgagaaattttgtgcctttgaacctgatgcatacataaactaaagtaaaccagatactattataccaagctccttctaaagttaaatgatttattaccaaaaactgaactggggagtaggaaatttctcaaaaaatatctcttattgctataaaaagaaataaattaaaaaataattcaaattaactctttttgaaccaatacacacgagatcaaaatgaaactattaaacaacttttatgtaaatatacattgataaccttcaacttaactcatttttattataatatatttctttataaattcaacaaaatcaaataaattcattgacaacatattaaattctgtttcaaatataattttgtgttctttcattaggaacaatgagcaggaacatccacacataaacacttccttcatccattattccaataatgccttcacgaagtcctccgcaaatccaggacaacgtgaatcgcacaacacaaacaatccgcccaatttagtcagcggctcattaacttgtgcgaatctttgatctcttgaagtacttaatatagctgactcaagtgcttcaagatatttatttgtattactttgattcgttttcggcttagattccacatggactgtatcaaatacccagaaatcattttgatcttcttcctcttcttcttcttcgtactcttcttcttcattgtttacttgtgaagaatatggtttcacttgttcaatgtactcgacgataagatctttacgcttggcactttttataaaggggtgccccaaaagtgtgctggcacttggacgaagtttagggtctttcgtgaggcatttggagacaaagtctttgaactggggcgagaaatcaccttcaagtgtgggtggggcattctgtggaataagcataagaacacgttgtggatgcatatcagcatatggtggaaggcctgtggccatctcaatggcagtaatgccaagtgaccatatgtcacatttttcatcatgcccactttccattataacttctggtgccatccaaaatggtgtaccaacaaatgtaaatgctttgttacgtgcttcaagtgatgaagctacaccaaaatcagctagcttgacatcgcctttgttattaagaagaatattggctgctttaatgtctctatgaatttttctacggcgatgaagaaaatcaagagcatgtagaacttgagaaagaacaatggcaatttgaggttcaggcatgactttgatttgaatgagttcacgaacagaaccaccacccatcatttccatcacaatccataatttagtgccaacaagtgtacaaccataataatgaacgacatactctgattcacatgaacgaagcatgtcgatttccctttgtatttcaattaaatcgtcatcactttcttcaagatcaatttctttgattgctacaatttcatttgttttcttacaaattgctttaaaaacaacaccaaaattaccgcgtccaatgacgccttgacgaatgtagtcgcttgcagaaatcccacttcctgaagacattgtatgaattcctggcggctataaacggttgatagtcttttcttcaaaaaagcgaaaaggaaaattctttaatttaataaaataaatattattttacacgaagtacccaatacataaacaaagtagttaaattattctgtcgatataatgaaaaagaagataagaataaagattttaaccaaaaacttttgtagtcaaaaattaaaatgcaaaacgatcatttttagttcaaatccaatatttgaagaatctccgatcaaaatgcaattaaaaagtgtttttcgttttttctatcatattttgacaagttttgtttgggaattgcgtataaaaccgtcgccgataataaaatcagaatgaggggtgtaagttgtggcatactttcaaaaaaatgactaactacgcaggttactccacctctgatcaaataaatgggttccccacaaattttaaccaaggaccagaccagcttattatttatccaccaaatattaatccaataaattacaatcagccatatacaaaccagccttttaatagcccaaataacataaaccccattattacaattacttataatcaagggattcaaccatcgttaacatttgacaaattaccatattttctacgcttttcaaaaaatcaaacactcatatcagataaattttctaagcatagctggccaaataagaaggaagtcatagttgatttttatccaagagccaaagttccagtaacatatattgaatcaactgataaagaacttttttactatcttcaaatacactatcaaaccccacctctattaattgaactccaacaaatcgatcacaatcaaatttctttatttttaatatgttccaaaaaaggtattttatgtattcattatgtagataatgttcctaatccaactatttatagtttccttatgtcaacgcaattttatatcaaagatcaaaaagacattgaaatattacaaatgtattactcaagtaatttttcatatatcaacttgagccaaatattaaatttaaaaaatctctcgaaaaacacattttcattgtcaagaagatttttaggtgagcctaatattaattcaaagaattttaatccaaaaattcgaaacaatcaatctatttcatgtagtcaaattctttattattcgtataaagctgtatctgattttatgcttataccaattattatgtcagcgcccattgtaattaagaagagtttttctaccaatcaaaaatttgaagaacttactgaaattccatataaatttattaattcaagttcggatctaacaaagattacatatatacctaatatgaataatgatgaaagtctaattaaatcgaaatttgcttcattatatgatggttattcatatgtcataggaaatcttaagaatttttatggatatggtacatctaatggtatattaattacacaacatccaattagaaacattaatagtgttacaacaaaactttcgaatgctatttataaacaacatgaaaatgaaattaaagttcaaagaatgaatgaaattacacaaaacaatgatatatataaaaccatttttatattagcaattaaaatcgtaattaatcttaaatatattaaaagagaaagtgatcctattaaagaaattgtagaagcaccaaaatggacaaaatttgaaacagttaaatttgatttacctgatggagttaaacgtgcccaattagtaatctctaaatttacgattatttcattacctattcccactagtttatatcaatattttgctaaagatgtatttgaagaaattcttcaattacaagaatcaggttttattatagaacaagtaaaaaatattaacattgaacaaatatattcgagaatgattataggcataacagaagttatggataatatcgaagaaataatttcatcatttcctaaaattaaatatgaagaattagttgaattattattatctattaaagtacaagcacaagatgaagaaattattaacaaagttatattatcattaaatttcgattcatttacagagaaagaaattcgatcattattaaatgcatttaatcatatttttaacttaagaaataaaaacattaatcaaatccttagaattataggaagatataatttagataaatctcaatgggaacaagcaaactcattaattaatcaactttttacatgtatagtaccaccatcaaatataaaaccaaaattaataaatttcttatcacaatttgatatcagtgaacaatcattacaacaatttcttataaatattaaagaaataattgaaaaaatggatgttaacgataaagataaacaaagtaaaatattacaatatatcaaagaaatatcgacatatttcaaaactaataagaaattaccaggtcaaatattattaattcaacaatcattttgtaacttactacattattatgaaaaagaagaaaatacaaatgaacaaaatgatttatatcttgaaaatacattaaaaacatttaaagctgtttctatatattttaaattcttaagtaataaatctacgattaaacaaattgcagatttattctttgatttaagtttcaagccatctgatgaaaattcattatttacaaggatttatccagtatatttaatacattatgaattattaaaaaaacatgattctgttattatgttaaaaagttctacaggtagtggtaaaactcgatgttcaccatttatatttgcacttaaaatattaatggaaaatttcaaacatccatattttataatgacacaaccaagtgcaaatataattacagataaaattaatgattttaaagatattatgcaagatacagtcattttaactaatgatattaaaacaatgattaattattataagatttcaagaaatgaaattaataaacctatcattggtttattttcacctcataacttaataagattaataacagaaacagagaaagaaggtattgatattatatctaaaactcgattttgtcttgatgaaattcataaaagaacagtagaaactgatgtattaatttctttattatcaagaaaaatcaatttcaaaaacacatttcctttacatatattaatgatgtctgctacacctgattattcaataaataaatgttttaaagatgttaagactataacaattgaagattcacaacttttccctgtagaaaatattaaaatagaaatccaagataaaaataaagtaacaaaagtagcagcaacagaaactataaacattattaaaagaatggctaataatgaattagaaattggtcatattattatattttcatcaggtaattcacgaattaatgaaattaatcatgatattttaggtctgattaaaactttaaataatgaaaaacgtaatatacaagttattaataatatatcatttaataacatcgaattatttaataagaacattaataaaattattaataatgataaagaaacattatttatattacctatcaaatttacaggttatgtaacacaaaatcaaaaagatatagctaagagaccgataaaagatcatgataatattatcaaaatcattttagctacaaatgctatagaatcatcagtaacaattgatcaattaaaagtagtaattgatacaagtttatataaacaatctatatatgatccaacatgtggattaacaataataaatgaagaattaatatcaacacaaaatcaaacacaacgtaaaggtcgtgtaggtagagtatgtccaggaatatcaatacaaatagttatcaaagatatgccaatgaaagattcattattacctgatttattaactactgatattagttctaatatattatcattacgaaaaatggatattaaacttgaaaaacttacaaatttaccggataaaattgagcctaaattacttgaacaatttatgaatgaattatataaatttaatgctattaatccagaaacaggtgaaattacaaaatatggatcaaagatttcaatgtttcaaacaattccaccatttttagctaattctattattaatgcatctaagaatgtagataaagatacttcattagttgaattattaggttcattaatagtattaatattttctactaataatttaataactgatgtatatgcaaaagtattacaacataatttttgtaatgattctgatattataacaattcttaaaacatttttggatttaacaaaaatagatattagaaaatggaaatgtttaacaaatgattatggcttaaattataatttagcatatcaaatttattcaacaatattaacaatatcaaggaatttaaatattcatcaaaaagatatatttaaacaattaaataaattaattaagagaattgatttaatgaaatttatacaaaatattattgattctacaatatcttctaaagaagaatggtcattatgtcgaaaagttatgtttgaaacaatagaaaatgttgaaaaagatccattaatagtttataaaggtaatgaaaacttaacatttaataataataataatcaaaaagaatcaaaagttatagttaaaatgaggccaggatctataggttatacatcaccaagttgtgtttatatattaaatattgtacataataaatctacagaaactaatgttggtacatatattcatcgtgattttaatcatgaacgaaacttgtcaatacaaaacaattatatattatataaaccgatatcattaacaacagattatgtatttaaagcacaagaagaattttcatctattttacttgaagaatatttaaagcctaatgaaaatgaattttgtaaatttaatacaaagaaattaaatgataatgataatgaaaaaacattattttgtatctcaatacataaaaatcaaagtgtaataacttattcacctaaaaatacaaatgccgaaaatatatttaatgaagctattaaaaatgtttcattacttttaccttatacaccttcatctatattaattcctcactttaatcttcaatgttgtatatctcttaaagttattggctcagaaaaacaagattcgaatataattttctttaatgaaaaagtattatatccatatcaaattaataaggatacattaaattatttattaacttatattagtcgacttaatgatgttactaataaattaactatagctatgactggtgaaatgttatcattatcattagataataatcaatattcttatgataacattaaaaagccgataattaatcgtaatttaaattatgtttttgatataaataatttttcacatttaataattttatctgataaaaaaattccaaatcaaaaagaaatgatttggttcaaaaataataatcaacaaaataattttaatatgaataattttgctaatactatatgtcctaatttatttacatttaagaattatggaaaacgaatattcttttgtaataataataatataaaaaataaaatacaaaaattatttaatgatttaatattaaacaatattaaaaataatcatttagaaaaagaaattccaataaaaacattaacaataaatcctactggaaatgtttttaatagaattgatgataaaattaaagataaatataatctaataaaattaaatgataataatgaaattacacttgatataataaatgataataataataatatagataaaactaataaattcatccaatcatttataagttcaattacatcaattattaaatatgataatacaaatattattcaaatgccaatttatgaagtagaatttaaacattcaaagaattcgaattatacaaaagaacaatttatccaaaaagtacaaaatgtaatacaaaactttggatttataatatataaagttaatgaatatattgaagttaataataataacttaaaaggtatcattaaagcttatatgtatacaatcgaatttattacacctttagcttcaatgttcattgatgaaatcttaggtaaagatattaatgtattatatattccaacgaatataattgatccgacattattaactaagaagaaatgtattaatatctttaatgaatatcttaaacagcatcaaatcgaattgaattataataacaatgtttggtatggaaaaatcgatcaaattaataaagttaatgaattattacttaaagaaccaccaacatttccatataaacatattactatacctggtggaattaatattcaaatcttaactaatgcaattcaaaacaaggattatccgagtgaaaagaaatggttaattaatccatcgaaacgaattattatagtaccgaattctattgatgataatattgtgataacatttattaatcaatttaatataaataatgatcaaaataattcacaagaaattttaggtaattatgtaaattgttgtgaagaagaattaatattatcgaagaaacttattagtatttattatcaaaatcgtacaacgcaaaacttaaattattgttgtgtttgtattaaaagtttattaattgcagcattaggtaaaatgtatgatgaaaattctgaaactgttcgtatagataaaatatatgaaaacaatgacttaattcgaccaatagaaatctttgagacgaatattaatcaattaggaaaatggccgataataccatttggacaattaatatgggcgtttattcatgaaaaagaattaacaaatgtaaccaaagcttatgtaacatctatagctgttaaagcattaaaagcatcaccgaaaattacatattgtccaaatcatatgtcaatattatatagaactccacagtcacatacattactgagatgtaatgtaaatggatgtaatttcattctttgtaatgaatgtaatcaatggcatgaaataggtaaatgtaataataaagtccacgtgccaaaaggttttagaatttgcccgaattgccataaaataatcgaaaagactcagttctgtaatcacatcgaatgcacatgcggaaaacacttctgttactattgcggcgcaggccctttcgaagtggaagacgactgttacagacatctgatgaaagagcacggtaacttcagtgaccacccgcccgactacataaagtattgcatgagaaaagaagtgaaccagcaggagctcgagaacttttaccaaaaatatccccaattcagagatttgacactataaataaataaaaattttaacgtaaattttcgtttaatggcgtttaaacaaaaaatgcattggaaatcaatatgatttttaaggggtttgaaatgattgcaatacatcgaacagctcaaacttttttgtaatccatcaataattttcaaaaagataatgatttcatgtgtgaaaataataaatgtgttgacttaatattttattaattttaggttttaaaatatttctgattttggttttttcgaggagttgtgcgttttttgaatatgaatccgatggattctttggatgctatcattgggaaatctttctacaatcactttaattctctttatgaaatcttgtgtgatgatatgaaattaaaaaaatcagaaatacaatacttttattttcaccttatatactttaaaatatattatgtatttaaaaaaaaaaaaagcaaaaaagaatatattgtgtaatgtgtttcagcaaaaattttatatctggtcgaatttttgaaatttttatgatgaaaacgattaaatcgctcacaaatcacagaaaatggatttcgcatccattgctcttctattaatttcatcatccactatcctttacggatgtacggcatcagcaggattgctgttcgaaccacagcatcaacaaagtagacctgattacattaggccaactccagatgaacaatcagaaattacaccaaaatttcttgttttaatgcttgttttaagttctggagttcttttaattatatttttctttgctgaatcatttttacaatttttgaaaataatcattcttttcccatgttttgtttcttctctttttacttcatgggactggttttggatgatatttagacataggttgataaatctaattgtcacaataatcttttcaataattattccattaatttggtttattacagaacattggcttataaccaaccttataacattttgcatatgtgttacaggcattacatttcttaagattaattcactaaaaatatgtgtaattgtatccatatgttttgttatatatgacgtttggtgggttttcttatcaccattagtgtttgggaagagcgttatggttgttgccgcaactagtgcctcagcacatatacctgcaactttttctattccaaatggcaaccataattcattaattggagcaggtgacattgttattcctggtcttgttttagactttttcatgcgatatgacctgaaaagaggtactcgatatttcgaaatatcatttttaggatattttttaggagtgattatttcatggattatggtacatgtaatgaatcatggacagccagcgttgctatggatatttccttcggtgttaattctgaccctttcggccgctgcgtgcaataacgaattgagcgaaatgtggaaaagtggcatcaaagggaaaacagaagaaggagcagaagaaagggatggaagcgacgaagttaatgagcagctacttaatgaaaataatgagcttcaggtaatattgtaaataaatatttgtttttagatattttaattcatttcaaaatttatgattcataaaaaatcaatatttagtttacttaaatgaattcggaatgattacactttgcaatataataaaattgagccaagaatgttgataatatttaattaaattatttattaaattgatatttatctattgccctttttaatttatataaatacacttgcttctgttcgattttatcttgaactcttgttttaaatttcgaatttatttttgatttctgtaaattccatatttcttcaagtagtttgcagtataaaaactttgagtttagtaatataataacaatttcttgctttttatgaaaattttgatgtgaaagaggagatggaagattgtgaatcttttggataacagtatgtactgaagctgttatcgaataggttttatctgagactgatgtaaaaaaattagttctgttagaaatattttggaggcttacatttaactcaaagttaggtggaaataaaagcaatgatagaagattctcaaattctaagagaagtttttcattatgtttacgttcttcagtttcttctatttttttgtgtgatggcttttgagaaatagaaatgatttctgattgaacttgatgaatttgtaacttcaaaatttgattttcttttcgaatttgtctgagttcaattaaattttgtgacgaacattcgagcattttttgtgctttgattgcttcatttagtgatatttgatgactttcacttttttcaatttgataattgattaatttttcctttgttacaattacttcatttcgttttttcttaatttcattttcgagccctttgattcgattttgtaattcttcaatagcttttgctgctttattttcttctgatttttccattttagcaattataaacgtgcataattcaattccaaattgtcatcaaaatttgaaggtaaagtaacctgccaataaacgtctttatgaatgcaaaggaaaaaactgttcttttcttcattattaatacattatctctaattatattatttatttcacgacacaatccctcaagaattgaaaaagacacaaaatataaaaaatattcaaaaaaagtttttgcattatactttggatgttggggcacaatagaaaatgataaagctttagtatcttggtcttatcaaattcgctcttcttcaccagaaagaattgttccaccagatataccatcaactttatatcctaaattaggaatatattcgtcacataatgaatctatcctaagacatcactgttctatcctatcatcaattggaattgatgctatatttttatattattttggaaccaaccattctgatttctttaatgatggttttgaaaagttttcaattcaaacacttgatcttttactaaaaattgttcctgattataacattaaagtaggaatttttatacctttttacaattcacaaaattattattctttagaatcagatatcaattatttttatcaaaactataaagagaatccatccgtattctctattgataacaaacctgttatattattttcagagtcaaatttcatcaattcatttccaactttgatatctaaatttccaaatcttttctttataaatacaatcacttattcaagtgatgttggcgcgtcaatggaagagggatatgatggtattttcacactagatgcttcagaaggtcatatttatgcatccacaatttcgaattggaaattgattagttctatttcagccgaaagaaacatgttctttattcccacagtatcacctggtttcaacgatacacaaacaaggagatggagttctccaattttgcaacgtagtcgtgaaaatggcgaatattacaatcgaatgtggaaagctgcaattgaagcaaatccacccgctgtgttaataaactcttttaataattggcttcaaggaacaatgattgaaccagcaatcgaacatggtaaattcaaatataataaagatatttggagcgaatatggcgatccaatgaaatatataaatttaacaaagcattggatatcaaagttcaaaaaactttcgatatgaaaattcacaaatcatttattgttatttataaaatatttttacttaatttttctatctcgttcattttgtatcatgaagatccaatttaattctgaaacttttgtttccatttggaaatgaaaacgcaaatttattaaaagtaaaatgttctacagtaagtatttattgataatttaagatcattttttagcatttcgagtcaatgtttggttcttagtccataattccccgatcaatctcaatgcagactgatgtttctctctaagttccgcctgatttctttctgattcgtcaaatttctgattcatttcttttaatttttctcgtaattctttatttcttttatccgaaagatttaatttctcttttaattgcgacatattaacaattactttgttcacgttttgttttagttcgcgtgaaacttctttgtttttgttgtatttactttttatttcgttcatttcttgtttggttgatgaaaattccgataaaatcgaattaatttgcgtcgatatcagttcgacaagttcggcatcatttaaagaattgatgttgttaatcgaacctttgatttttgctatttgttgctcgagaataattaaattcgattttattccgttatcagttttgattgatttcatttgtatttctgatttgttgttgtctttgttagaattcgcttcaactgataaaatatttaatgtttttgcttttagtttttggcacttctgttccaatttgttaatttgattatctttttctttaattattttgtcgaaatcgttgtctttatttgaatttacttgaagatttaatatttctgtttttagtttttgattcttttgctttgttttatttaaaagttctttctgtatttctatttctttattttgttgctttatttgtgcttcaagttttgatattttttcatttttattatcatttgaaactttattttgtaaatttttaatttcttctttttgttcattaatttttaactcgagttttttaattaaatcttttgatgaatttatttgattatttaaatcttcttttttattatcattttgttgtaactcatgaattaagtttttacttttttgtaattcattgtttgaattatcgatcattttagtcaacttttcgatattattttgttgattttcagatatttcttgtaatttaataatttgttcatttttttcctttataattttctctttttcttcatcgaaattctttatttcggaattcaatttcttgttttgatcaattaaatctttgatttctttttgtgttttattaacttcgaaatttaatgtttcattttctttaatataatttttattttgtaattgatattctattaattgttcttttaacttatttaatgtttcattttcattaaaagtattttcatttgatgaaatatttttaatattacatttaagtttttgaattttttccttttttgattttaatttatttataagtttttcattttcatccatagcattaacaagttcattttctgtttctgtattcatttgttgaattcgagttaattcatttgtgaaattttcagaatcgaattcttttgactttttaatttcatttaattcttgttttaatttatttatttcattatttaaatctaattctttttcttgatttctaattttaatttcatttaattccttttcgattaattcatttgtcgaattatttttgtttttatttgaaagttcattttgtaaattttcaataacttttttgttgttttgtatttgtaataataaatctgaaactttttcattatcatttgattgattactgttatttaatttttgttcaagttcaattttatcttttaataatttttctatttcttttttagagttttgtaattcttgatcaacttgttctaaatctttaatatgctttttagctttatcaatttgttgtcttaagtcatcattttctttaactaattgattagttacatttgatgaaagtaatttatcttttaattgttgattttcttcttttaagttttttatttgatttaataaattttcttttgtttcattaaattgttttaataaatcattatatttaacttgtaaatcatcatcatcattgcctaataatatattattagtattataaagttttgattttaatttttcgatttcttgatttaaaagttctttttcttcattcgtttgagctatagtttgttgttgatcatttaaacatttttcatatgtcggtataacagtttgaatttcttcaatttgttgttcaagtgattcaattgtcactttattttcttcgattttcttattaagttcaatattttgttttgttaattcgtcatttttttcagttaagtttaatatttgtgcttgaaaagttgaatcgttttgtatttcggatttaatatctaaaagattttctctgtttttacggacaactcgaacaacatcttgaacaaaatcataccaaattgattgttcttctaaagaatcgacataattatttatcgatgtaatcaaaactgatattcctatacgtgctttaattaattcgattaattgtataaatacttcatcattagtcttaaataataatgattcaagtaatattaaacttgtaatactctttagcaaaggttctttagtttcatcaatacataaagatattaaaaatataatcgttgattgtttatctttcctttgtaatgatgaaatcgttgatatgaacaattttgtagctgttgaagattcccaaattatcgcagaaatgaattttaatattacgggtaatacaatcgaattattgttagtaatctttgataatgtttcaattgaatacataaagaaacttttgtcattgttcaaattattaacataaaaaatgtttttcgtttcattatttgttattaaacatgaacatgcaatgttataaatcgcataattctctgttatcatttcattgaagttctgtaatatatttgataatgagttatgattacataatgcttcggaaactgattttgatcctttaatacaataacattcaatgaaaaatagtccgcaattttgttcttcattatctttagttgttattgttaacgtgatgattttttcaagttcatttgatatggataaacataactctgtactccctcgaattatatatcctaaaagttttaaaagtgttttcgaatttgtgctatgattcatgataccgttaattaacggtggaattaaaccgctgtccaaaataaacggtcgaaatgatgctgcatctgttgattgaaacaacattgttaaaagtgaaattgctctgtcatctcgtgattttataagtggtaagagtttagttaaatgtcccgtttctacaaataatttttgaactttagaattaccatcaagcaatgattgaagtgctggaatcacttcagcagatggaagagtggaaatacgttctgcaagtggatccataagagaaaatgccatcatttgttgaatgtcattattgccttgaactaacgatggaataagatacatgaaattagagcgaatcatatcaactggatcatcaataagattgcaaagggatttctgtgctcgagcagtctcgaaaaagaatgattgtacttttgatggttgaagtcgtaataaatttttgataagactcagagataatcctctgatttttgcagacttattgttaagacattcaaaaatattaggaagtgcagtttcttcatcaacaatataaccagaattagaattggaatcaagactatcatcaagaacaagttcattcaagatttgtaaaatattttgtactgcttcgttatctttactaaaatctgatagaagcttagctagaatcgtgcttgactttagaccaattattgaagaatattttcgtgcaaatggaacaatatctataagtgcatctcgaactaacttagggttgtttaggttgtccaaacatcgattgacaaactcttcatctgtttcttgagagtcaggagcaaaaaattttagtaaggacattaattagggggccttgaatacgtttaaatattttttttctttcataaaagaacgaagtcaccagtacaaaaataaacataaaattcatttttgattttaccatagtttataaaataattaattttttggtttattaattttttcaaatgcaaaactttttatgttataagaaaattgtagaatcatcaaaaaaaaaatgacaacgtttaacatcaaagaaaattcattttttccatatttttgttatattgatttcaaattcaaacttggtaagggatctgttaagctagctttttttaaagaaaaaaagaggacgatagcataattatttaacactttttgtaatgttaataaaagatgtcaaaaaattatttcatccctgcttgcagaaagaaaggcataaatcacacaggaaaacaagaaaaagcaaattttctgttattgtaaaaaaatttataaaactcaaacaaattatatttaatttaacacaagaaaattttgaaatatcaattgaacaaacaatgaaattatttgatctaaattttccatattcatttaatttgataatttgtaatttagtttattatgcattttattcaaagaaagaattaaattatatttatataaactttttagagaatattaaactcaaagaagaagaaatcaataaatataacccaaacattattaaaatatttagaaattatttagttaaatttaatacacaagaatcatgttatttaaagatgaaaatgattaaaaaaaatttaattgatccaaagtatcttaaatatggtaaaaccacaaaatataggacaacatatcacttctttgattatttcatgggtaaatcaaatgaaaatttttcaaaagatgattatggacttgataagcagttaattaaggaagggcataatccaaatgaaatctcaaaaataattcgaaatgatgaaatcgaaaaacttcaagaaataacatcacaaacaaattttgattttgatcaaacaattgaaccatcactttatgaaagatgttcatttattaatcataaaaatgttacattaatgattatgcagcattttttggatcaattaaatgttttaaatatttacttatgaatggtgcaaaagtaaataacacaggtaaatatgcagttgcaggtggaaatgaagaaatcattcatttatgtgaacaaaatcattcatcttttcaaaatgcatataaaacagcaattgaatttcatcaaaataacatttttaaatttctttatgaaaataaattagaagaaataaaaacattggaagaattaggaaagatatgtttaaaatattccaactatgaaatttttttatttttatatcaaaatggaatgaaaataaatgatttaataatgaataaaacagctaaaattggaaatttatatctgataaaatatttcctatcaaaaaatcaaatcccaaaaaatataattcttttttctacaaagtcagaaaacattgaacttataaaatacattttagaacaaaaaggaattgatgttaatgctaaagatatttatttgttttatttaaaatttattttgataattttatatttcaaaatattttttggaaattatttaaattatttcgaacagcacttatttatgcatctcgaaatggttacaaagaaatagttaaattacttcttgaacaagaaggaatcaatattaatgctaaaaatatttatttgttttatttaatatatattttaataatttagaatttcaaaataatatttggaaattattcaaattatttaaaacagcacttgtgaaagcatctataaaaggttatacagaaatagttaaattacttcttgaacaaaaaggaattgatattaatgctaaagatatttatttgttttattttggatttattttaataattttatatttcataataatatttggaaattatttaaattatttgaaacatcatttattgaagcatcttcagaaggtcatacagaaatagttaaattaattcttgaacgaaaaagaattaatgttaatgagaaaaatatttatttgttttatttaaaatttattttaatattttggtatttcaaaataaaatttggaaattatttaaattatttaaaactccacttatgaaagcgtctgaaaatggtaaaatagaaacagttaaattacttcttgaacaaaaaggaattgatattaatgctaaaaatttttatttgctttatttaaaatttattttaataattttatatatcaaaatgatattctggaattattcaaattatttgatacagcacttatttatgcatcttggaaaggtcatacagaaatagttaaattacttcttgaacaaaaaggaattgatattaatgctaaagatatttatttgttttatttaaaatttattttaatattttggtatttcaaaataaaatttggtaattatttaaattattttatacaccacttatgtatgcatctcaaaaaggtcatacagaaatagttaaattaattcttgaacgaaaaagaattaatgttaatgagaaaaatatttatttgttttatttaatatttattttaataatttgatatttcaaaataatatttggaaattacttaaattgtttaatacagcacttattttggcatcttcaaatggacatatagaaatagttaaattatttcttgaacaaaaaggaattgatattaatgctaaaggtatttttttattttatttaaaatttattttaatattttggtatttcaaaataatatttggaaattacttaaattgtttaatacagcacttattttggcatcttggaaaggtcatatagaaatagttaaattacttcttgaacaagaaggaattgatattaatgctaaagatatttatttgttttatttaaaatttattttaataatttaatatttcaaaataatatttggaaattatttaaattatttataacggcacttaatttagcaactagaaatcatcggacggaaatagttaaattacttcttgaacaaaaaagaattgatattaatgttaaagatatttatagatttgatttgataaaaattttgattattttttgttccaaaataatacatggagattaattaaattattttatgcagcgcctacaattgcatctgtaaatggttacacagaaatcgtaaaattatttcttgagaaaaagagtaaaaccaaataaaacccgaaatctaataacacaaaataaacagttatactatgaaggaatattttttaaaagtaaattcattgttttcattcatgattcatattgtttggaaaaaccaaccatgaacaatttttttgtttaatttcaagaaactgaaaatacagttttaataattttaaattattttaaacaatcgtttgagctatctattaggttaaagctaaagaatcttgatactgaccaaaaataatttgtggtgccataaattgctaattcaccataaaactgttgttttgatcaaaatgaaggttgttcttgcaataatcatacaaccgcaaaataaattcaaaaagttgatcctttgttttattcgacgttttttgctgatttaagctcatgattaccaaattataaatgaaaaaatgtctttaatttaaaaaatgtagtatgttacaagaaaagcaattgtttatatatttattcatactgtcattaataatattacaattatttttctttttcttctatacaaaaagaattaatttggtttggaattttcagtaatttgcttccaataagttgaatatttttggttattcgagttaataattatttttgtaaatattaatagttactgatatatcagtattgatccatacagttaacccttcttgtaatagcaaggaatagactatgtaaagcttatcccaaacaatatttattaaatatacaaagaataatgttcaatataaattcggttaaaagcttttcaaatagaaaaggacgaaaatgcatgtacttagcgttgtactcaaaaaaggacaaacttatgaagaaattgattacatggatttctcaatgtacagatgaacaggacacaaacgttttttcgtgcaaatggggcacctcgaacacacggattgcaatcaacgaattccatttttaaatggaaagcgatttggaaacaatattttctcgccagctccctgtttatggggttgaaggtcaagctaagctcaaagatgcaacagtcatgattgtaggatgtggtggattaggaagcacatgttcaactattctttctcgttctggtgttggtcatcttattcttattgattgtgacgaagtatctatatctaatattcatcgtcaatttttatatacacaaaatgatattggtaaatcaaaatccaaaacagcagcttcatcaccacttctttgtttatcagataacgttccagttattactcacattgataaagatacagcttatcaattaatcgaagaacatcatccaaatgttgtaatggattgtactgataactttgaagttagatatgcagttaaccatgcatgtgccagagcttcagttcccatggtttttggctctattacagcaggtcaaggtcaagtttctgtttattgtgatttggaatcagatcctgaatgtccatgtttttcatgtattcacccacaggttccacaacaattgccatcgccacctccagtcgttccaggaatatgttcaattgttggaactttacaagcacaacaagcaattgcaatcataaccggagtaggcgacaaactagtacgtgagctgttgaccatagacatgttcaagttgaaaatgaggagatttaagcttcgtgagaagaatgtcaattgctctgtctgtggaattggtcaaaagccaaatcaatgaaataaaacagaatcaaaacttgttgaaaaaaatgcctttgagtgagattgtacatttgtaaaaagtttttaaatttaattgttaagaattcgtttattctgttattacggaaacttcgacgtgaacttctggttcgagaccaatttgtgttacttgtttaacagctgctggtgtaccaacaaaatcaataacacgtttgtaaatacgaagttctaaatgatcgtatgtttcagtaccattaccgcatggagccctacgagttgtgatcctaaggcgacggcgtggcattggaattggtccacgaacctttaaatgttcggccttaagtttttgagtgaggttattgcaaactttttggagatttgggagctttgatgatgtgattgtaaggcggatacgctgttgtgcttgtgttgcaagaacttccttcttttcgtcaccagttggaatgctcattgatgaaaaggcacagccagacaaaccttgtcaaaacagcaccaacttattaaaaagtgacaattaaagacaattgtttaataactccaaaaatgatggccttttgaactttctacacgttttgtttatttcatttggacgctcttatgccagcgagctggttaagtacttctattctttttgttacttctggatctgttatttctttatcacacaactctgctatttttcgttggaattgttccactctcttctttccttgcatgttctttaatgtggataagtcaccagattctgccattacttcaatgaatccttttgattctttgtttgccattagcaagagttctttcataaactgttctcttttctttgttgcatcgctccaggtttgtagtgcttcatttccatttgcagaatacatctgtggtaataatttcttttgtaaatcctttgactcttgaattctctttgtccatgttgaaagaaggattttagaaagtgcattaatatcaggatctccttcatttacactcatcttcttttcaaattgtttcaatcttctttcatacattctaactctcaaagcaacgagttgataaaaacgattaagacgacgtgttacacgaataacatcatctaaaaattgtaaataatgttgtccacttgaatggatcctaatttcccaatcggctaaaagtgcagctttttcattttctatttggtcggatacttcttgagcaaattgaacgcctttagttgttgatgggattggattacaaccaaggaggagctcacaggtagggtcatctgccatagaagcagcaatatccaaagcagttctacctttttgatcttttagattaagatctgcataatacattaggagacgacaacattctggatcgttcatacgaacagcaaaatgaagagcactcttttcaccaatggtaagttgggatcctgatttaagtagaagatttatcgacttagtattctttacatgaatcgcatgaaaaagaggaatttcaaaaaataaaaataaactccaaattagatatataaactttttgttatataaataaatagaattaacagtatttggatcagcaccatattgaagaagaatcgaaactgcctcatcatttccactattgatagctgtgattaaaggaacaactccatttgatgttggaagatttggatttgccttaaaattaagtagtaattttaaaatatccgtctgtttatgttttattgccaagtgtattggtggcaaaattttcttatccaatatctgtgatgtatctgctccattttcaagaagatttaaaacattttgataatttccttcagatattgctatttgcaatggagttttaaaacctacaaacaaacgctaaattaaaaaattaaacttgaaccaacgcaaatgaacactttcactttctgctttctcgttctccatctgactccaaaaccttcagtatgcaaaaagtgacaattatattatacacaacaaatttccttcagcatttatgcgattcaaattatttctacaccttaacccatttgctaatttgcagcttctgcttaatagttaacaagagttactcccaaaaacgcacaaaagtaacagttcgttcccattctcattatttctcaccggggaacgttagatgcatctcaaagtggccgccacttttctgtcaaaaactcaacagacactttttctacattaagttcaaatttcaaaccattaatagtttaattagaattattccttaatttatgcatttaaattattgtcattaagatattgcttcatttcatctggagtatgacgacgagcaccaggaccgccatcgttacgttcttcatcttcaaggaagcaaaggaatgttgcgtcgatactcatttcgaacacgccagtgaaagcgccacttgctaagtaagacataataagaacaatgactgctgggacgatatagaatgtaacgtcatcttgatccttgaatatgaggattgatataccagagacgagtgcagagatgaggatacggccaaggaataatgtgaagtcgccaacccaattaagtgctgtagcacgtgcagcatttctaagtaataagaagaatgcttccttggatgccttgaagaagctaaatccgtgcattgctgtcatgatgtatgcatttctattaagatacttcaagaatttctcgaggcagcagaagcagcacttaagacatttaacaatgcatttaactgctgtgttttgtgattctcttgtcttttgttcaatgaattggatgattgcacgaatgatcttgcaaattgttatgatgagtgaaccgactgcaagtgtacctgtgtgataacgaagtgacctaagtaagcttcgtgtgcaaatgaacttgggcatgttgtttctttcgtcatcagaagcaaagtaatattctgcaacaacacctgcaactgtcatctcacctaatgccataatgaagcatgaaacccaaaggaagccaatgaagtgatagatggagaagccttggataactgtatcatattgcattgagattacatcggctgttgagattggatcgcttgaatctaattgaacaatgccacgtgttggggtacctgcaccgaataacacaatagcaactgcaatgacataaatccaccatacgaataagatgatgtattgtgcaatcgggaagaagaataatgatgggacactatagaacatctgtgagactgtcttgataacattgatgctatatacaatacgcttaatcatgaagagtaaaacaagaacaaagataatgtcaagaacaagtaagatgtagaagaagacattgaatactttgcgattgagttcttcggaataaattccaagtgtaatgcctgcaataagttgagcattgtcgaagttgttcttggattgatggtaacacatgtatgtaaggaacgcaagtgctgcagcggtaagaacaactgtgatccagacaaagacagcagcgcagcatctcaataagaagagccaaactaatgaaagaactaaggcaataacaacacaaactgcaatgatccaatatgtattgtaaagatcttggattgcacgtacaacagctgatactgaatcaattgattgtgaaacattggcaagatagttcattgtttgagtaacatcacctctgatatcatcaaaggcagctgtaactggaagacatctgctgaaatgttcttcagttgcataaccacagaaatatctatcaggatctgttgttgaatagttttcaattgctggggcaattggtgttgttgaatttgttgtagcattccatttggcgcaaacacccatatcatctgcattgtatccgtggtattttttagactgcatttgtaggtttgctttgaaagcatatgtataaagaccttcatttggacattctgcaacgcaaaagcttctagcgtaaccttttacaccaggacgtacccagaaaagtgctggtttatctgttaaatcgggtaaatcagaagcgttttcgacgttcaataattggttgttatatccgcacataagacctctgtgatcagttggtacaaagaagtactttggatcacctttaacggctgaaacgactaggattgcaatcatgccgcagatgaataagaaaaagaagatgcacatgcaaatatctgtacattttctctcgcgatctacgccatcgaaacttgggtcgtgtttgaatttttctccgtattctccagaaccttgattcgagcttccgtattccattttaagtaaacgagtattcaaaaatcttgatttctatgtaaccgctgggattcaagtcaattttggtcgaagttttgaattttgagagaatttttatacaaggaaactgaggttttaaccaatacattttcatcattaaagtttttgttcgaaatacccatatgttattcatcaaatttttttacatgagagattaatggattagaatttttaaaaatattgtttaaaatcacaaaattgaagttgatgtccacttttattgttgatttttccggtggtttttaatttgaattaacggagaaaattacattgaaaaggctcgtttcaacggttatatcatttgaattgaagtggcaatcttgggattttatatcgtttttcttcaaatgagctcatttgcaaatgaaatcattttcttttaaagtaggataaaactaaagacaaacaaatcagtaaagaaagttttcaaccattaaattgttatgaagaaatgattttcgatcaaaataatgaatataagtttagatataaacaagaaagaaataaacaacatatcaaactaatcatattcattgaatttaatgaataaatcaaatgatgtgagtgattcgcaatttgaagatttaaaaaaaatattattcatttaataaaatattttatcttttatattcatctatacatcatgttggtatgtatgtcatttaatttattttgtttttttgcacttgtttttatcaatttagagaaccttctaacggaaaaggaagtaaactaagcaaaagtgaatttctgcaatttttgatacaaaaaaaattttatgcacaacattatttttactctacttttaatatgttgactacacaaatatattatatacatatataatagatagtctaatttttctgctctacaacatataatttaatttctcaaattatataaatccgaacattaatatgtttattaacaaatcggtagtgattggatagatattgttccatgttgcaaaacgattatatttgcttcagatttgtcattaacgctaggtatattttatatgatttaaaacatatatttgtttttcattcccacttcaagttttgataaaacttttatctcctaaattaggttttgaactttttcaataatacggggcaccctgaaattcacaaagatttcttgcgactttgtttgatatttttcacttgctttccggaaagaaagtcttacgcttcataccttacgcttttgatcagggctatgaatttgactttaaagctatatctgatacaatagaggataagaaaaattcaacaattttcatattttatcacactagatatctaacgattgataaaagggcaatgcaagaatttaaaataaaattttttaaaatatcaccatcaaagcttccaaccggctcaacattttttttgttcaaagaaaaagtagcggaattttacattaaacatcaaaataatataaatgattccattatccttgtatctaccaatggcatggatgtatgtggttatttaattgtacgctggcttgttgaagaacaatcttatacaatcaataatgcattttctgcattttctaattcatttcccaatggaataacgaacccaaatattgtagaagaaatcaataaaaagtatctctataccaagaattcaaacttcattaaggaacaagatacatcaaacatcccaataccatcaacatcaccacaacagaaatcaccaaacaaacaaacaccaacaaaagatacacgcccaaagattccagtggtttctcccttaccacagccaaaagttttttcaccaacaatgtattcccaaccagaatccccaatagctcctccacaagtagtgagtccaaaaattccaatagtttcttcacaagaggaaaagtctggtgtaagaataacatttgatgaaattggcgaacctgttgattcacgtttacgttccaaacttattatgtcacttaatgtaaagtttcagcaatttagagcaacaacaccaatgacaccaatttcaagacttactccatcatcatttgaacttatgacgagtgaatattgcttgacccctaagccacatggaattagatgtcttctttacatcgcagaagatggtaactatctaattcaagagaaaaacaaatgtcaaaaaattgaattaaagttgtatggtgacatgtcacctgaaaaggcggttagcatgtcactttttgaaggttatttggtttcaattccaggacagaaaccgttatttgtaatctcagatttattaatttattttgataatgatattcgccaaaagcctggatatgaaagattgtcagttgcaacccatgttgtcagttgcacaaagaaatattccaatgatatcttttcaaatatgatatcaattgatgtgttcaaaagttttccattaacttcatttgaaaaatttgttcaaaaggatcaaggagttgtagattatccaatttcaggaattttgttctatccaaaagatgagaaatcagaaattggaagtcaaaatccatctcatatctttgagttcaaactaagcaactcttattatcctgctgttaagcttaaagtctcgagagaaacaatggtttgtgtaggtactgtggataactatgggtctgataaagaagttgttgagtttggagttgcaaagccaaatattctttctatggatgagtgtattgtggatatacaatacaacaggacaacaaatcaatggcaaataaatggaagatcaaactcaccaaaagaatggacacttagagagtttaggagtattttggatcaaaaaggtgttccaaatttaacattggacgaattggagcaaggaattcgatcagttttgtcgaaggacgaaatcataaaaattgaatgaaaaacgataatttatatgtctcgcaaacggtcgccatccggcatgaggtacctatttaaattaaaattcaatttcgcgcaacaacatacatgcactctaattttaccttaaacaacaaagttggaaaatctctgtattaccttttttatagttacatgatatatttaattttcgatttatttttatatgtattctttttgaaatcaaaaattcatgaataaaattttagattagagaatataattaaccatttatgcttgatgcatgatgaatataggttttaaatttagaaaataaaatgataatatttcgtaataaattttttttttataatttcttaattaatttatatgttatcgattttagcttatcacacacatcattcatttttaatcattgggtttcgtttatttattgatgtgtttctttttggacatattttgggtttgtgaaggttgaattgaaatggtttggataaatcattcaaaaattatgtagagtacacaaaaaaaaaacaagatctctcaaataaaaaatttgttttttcaatatttaaatgctaaaaaacatgatctttttggtttatttaatgcaaaactgttattcattatttatagtgagaaaagggttagaatcatttccacactataaaaaaacgaaggaaagcatttttcagtgaacgttattttagaatatgagcagtttatttcaaatttcagtccaaccgccttttaacccagaaagaacaaaaaattctattgaaaaagcgatagcaaattacgttaaaaccagtcatttccccaaatgcaaacctccttactcagaaggaacattaaggcttcaaaatggatggaacaaatccgtgctatgcctggatttggtccaacctttggcgcaacccctcttaatcgtatcaaaatcccaggaactcatgattctggaacttatgaaatggatggtcacaactggtatcaaacacaagacttttccatcactgagcaattgaagcttggtgttagatactttgatttaagatgtatggaaagtgatggtgttcctatgattcatcatggtaaaggagttcttgccgttatcggaaattccttggaaacagatcttgatatgatccgtttgttcgttgatggtcacccaggagaaattgttatggtcaagataaaatgtgaaaaagaactcattagctctgtttgttttatggctcgtcaaatgctaggttcaagaatttttgatcaagatccgaaaaatcctatccaaatatcaacattaacttatgatcatttaatcaatcctaatgatattgatcttagccatccagtcataatctttattgatgtaccaaaagcagattctaaaattaattcaagaattagtaataacaaattcttcccattcagagaatattgttctggaaattactcaaacagcgataacccacaaaagattctcgctaacttccgtgatgctcgtattatttccaagcaaaaaggtaaagatgctcttaaaccaaatacatttaatcttcattatttcactgctacaggtcaataccttaaggctacagataaaggccatagcgttcagcgccttacataccaactcgatcaatgcattcattctgatcaatttggtatgttcaacttcgaaattccaagatcacttggttacatttgcgaagataagccaggagaactttcaccaatcaacattgtacttttcgactttgttacatcccataaagctcaaagaatttgggcattgaatcttccaaagccacccgaacaaccacaaaagtaaacaatgaacatcttaacaagttattctctttgaaatgtaaaacaagaaatttttatttttgttccaaacagggtgccccaacggttttcttataataattgaattgctttgtttgaatccaatggtcatacaaaatgaaggttttccaaaaatatggagctgttccattttcagttggagaaatccgaactaaaacagaaatcgaagagtctaccgtctggcagaagctcaaagaaaacgaaatttttcaatttaattctgcaataaatcaaattaaattttcgcctgttgctccatattcaattgtagccctttctggcttatctggtccttggattgatggaaggacacatcaacataaattctcatttgcaaaaacaaaaacaccatttacttcagtcgcatttcgaaaagatgggattttaattgcattaggaagagaggatgggacagttgatatatacccaacggaagaccatcaaactcttctaaaaagattcaaattaaattctggtgttgtcttttctctatcattttcaccatttgctaatgaaattattgcaggaacaggaaatggtcaagttcatatcattgatatttctcaaaggaaagaaattgaagttatccaagcccacaatgatgctgtttcgggtgtggttccacttgaatcaggaaacatttgggtaacatcttcacacgatggtgccataaagatatgggacttctcaaagaaagaatgcctatctgaaattgtcgatccaaattatccaattactcatatcacactttgtggaaaccgagcttttgcttcttcaggcgaatgtgttattgtagttgatattaaagcaaaagctacattagtttcaaaatttgttgcacataccagaccaattgttggaatgacaattgttcgctccaaccttgttacagcatcaggagacagaacaatcaaagtttttgatccatcttcgttttctcttcttttccaaatgaaactccatagcgacataaccgccttcgatgccaaaagtgacgcttcagcggttgctatcggtttatcagggggggtcgttcaacttaagtttgcaaaagatgaagaaattgtggaagaaaagaatccagagctttcaatgccagcaaatttcagagttttaaatcaatacgaaccaaggaatgatgcgccatacaatcgtgaattaaaaagatttaatgaagaagttgcattagactctgttctagaaattggcgatacctcaatcattattggtatgcttgatgaacttgacagacttggaagattagatcaagcaatttcgaatcgagatcctggacgacttatgcctttgttaaagttccttaccgaaaacgtaaccaatcctgcgtggtcgcaaattatcttaaagacagttgcatctgttgaaaaaatttacagattggtaattagcgataatccaagagttgggtcattgtttgataaactcgtcaatactataagaaatgagttagaagttcagaaacgtgcttctagactggtcgggaaaattgatgttcttcttagtaataaacttgaataaattataaaaatatcatcactttgcatatgaattcattaagaaatttaagttgtttctcttattgcataatttatgttatttgttttatatgttttggtctccatctaattttagatgaggtacttaactataaactattatttgaatgattatttattcgccagaaattgatatcaataatgattatttaaataaataaaaattgagaaatgaataaataattattaatttgaaacgatatacatgatgaagacaaaacgaaaatgtaattttgatgaaatgcttacaaaattattcataaaacaattaaatattaatttctttatttttgacaattttaaattgaaattttttcattgaataaaacacttatccttttcttctttagtttcgcttgtattaccgggggttttattctttgttacagttttaacttggaaatatttttctgtgatcgatttgaataattgatcaattccattaccgtttaaagcagatgtttctataaacgaacctccaaattcttctttaagttcttgcacaacttcatcactaagtttacttttttctgtatttttaatatctgatttgttaataacacacataaccgcattattacgagattcttgtacaacaggaagccatgttgattttacacaagaaacagaatcttcaacatcataagaagaaacaaagattactgcatttgaattttgaacgcatggtatcgatatcatttttgcatcttcagatccagagatatcccaaatttgaagttcaactgtttgtttatttggtaaacgaattgaaacttttgattctgttgggattggagaagtgaatgtataattagaaaaagatccactgacatatcttccaatgattgatgttttgcctgtatatctagctcctataacagcaatttggaaagaatgcttcatttccaatgtgtatctcctctatcggttatgaacgtttactattaaacgttcgccatcatttttcatatttaaaaaaaaaagcgaaatttacttattcattagcaatttttcttgaaaataattaaagaacaaaattaataacatattcagtttatataaaatacataaaaacaaaacaaacatataactacaaaggaggatgtgcttcttggatatattgcaaacacgccaatattacccacacaactaaaattccatttggataaggcacgacataaacacctaaagcgaaatctgtagatggtgattcagttttccaaacttcctgaagcgatacttcattaattacgtcatcaatagttgtaaaagtcatacaaaatgggcctccattcattctatatgatgtatattgtgatgccaaattatcaataattgtttgataattagtatttggatcatttaaagcagctctttcacaagtttccaatgcgcttcttaacttttctgcaaattgaggattccaacttgttctttgatgttctctccatctttcaacagcacttttaattgcattatcaagttctctttcagttcttctagctaaagagtcatcggtttgtttatactctaaatgatcttcttgaggagaatctaaaggaggcattttaaaatctgatgaaaagaatggataccataacttattattatgaatattccaatcaaccttatatggttctacgtcactttgtatattagcccaaacattttcttcgttaaatattataccgatattataaaatgaacaaaatctatcttttgaattccaacaacgtcccattataggatcccataaagtaattctacctgattcttttgttataacaaaagcatgttttccattaattaaatcataacctaaagcaacataagaatccaaaccgatgcttttgaatgtattacataaaagtaacgcgtgttcttcttcgtcgccagcgttcaacgataaaaactgccctgatgtaaaccacacatcattaattgtgttgaaaacctccgcgtcagaagcatttggaatcatcgaaacgaatcttaataattgtaaaggagtattaaatccatcaggagggttttgtttccttaccatcctacaagctataataggtttagcattttttggataagccatcaaaataattcttcttttcttcttaaatttcatttcattcatcttaatcaaccaatttttagccctaagtatcacagcctcattttcgccacttcctaaatcccccacaaaatctggaataattattggtggatctaatgtcaaatataatgacattctaaacggatcttcaggcttagaatatcctaattggaaacaaggctcattaattgacacaattccatcgataataccagttgcccaaatactactaattggtattactaaagaccctaagaaacgtggctcaattagttcatgtttcatttgttcttctctatcatctgatataacttggaatgaaatttcgtcgaataagtctattcttaaatttagctttgctacatcttcaagatttggcacttgatcttgatcatttgatattgggaattcgaagctttggttccattctgcatttttcccttgtacgactctcgtttttttactttgttttaagtatgtaactttacaatatatatttgtatttgaatcttttgttgaagaatatattaatgaagaaacagtaccaggtccagtacctaattttgttctttctggaatattcattgctcgaactattctaatcactaatttcgaataagcctcgattttagttgaagtagttctttgtattcgaattggttttaatggtcgatacatacctataatgttcttaaagaatgtaaacactgctggtacagttggcattggtgcttcacgtactacgtcacttaattgtacattcgttgatacagtagtactttgtacaagttcattttcttttaatttctcgatgaaatcttttggtttctctttcttcttttgcatttgtttctcatccatttcttggagttttttaatacgattttgtaattgcattccaactgttgtcggtactaaagattcaaatgtcgttgcattaatctgtgaatctaatcgaaacttcccgacaactctttcagcatttctttgtgctaatatcgatgttgtcattgcagttgtataaggatcatttgggtcatgactatcgatatatttaagtaaatatggtactgacataaatgatgaagggtctgctgctaatcttcttttagtcttttggacttgtacatcaggacatcttaagaataattccgtgttaggatcaggctcgatgaaacatcttgcgttaatagtgcccattataagttgaccttcatcatttgtaaaatcggaagtaaattcaaatgaattaaattccggatttgtacctatagttattggtaatacaattgtcgatatataacgtggacgcttaatataaccagtttcccataattgtaatgatatcttttgtggtattactgttgttttaaattgtgttcctgctttaaagtcacaacggaatgttgagtctaatggatattcattagtttttgttgtctcatcattgttaatgaatattttgatatatatcttcgcttctgttatcgtttgtcttctttcttgttcttctttagtacattcttcgaatggtgtaacttcggcattatttgatagaattggtttccattgtgaatcgcctggcattcgtaatcctaattcgacatgtcgatcatgaagttgtttcatgacttcatctgaattaagttttttcccttcgaattcagctagtttcatttcttcttgtgtccttcgttttaagtcttcttcaaatgctttttcttcgagttgtttctcttcttccgaatatttccgactttgccattttaatgataacgatgtcgatgtaaacgaattgttcgttcgtatcttttttagctcttgccacgcttggattaatgactcgcgaatcatgcgtgagttatgctcttccatgtcgcgcatttcgcgtgcttctttgagttgtttgtaatattcgtattgtttctcggtgttctcttcggtgttgagcgcttttcgaattgcttgaattcgatctttgtaataatgtactcgtgataactcttggtctttgacataagctgtgtatagctgtcggattttcattgagagaatgtcttcagaggacgatagaggatgaacaaagaattgaacatttgtcacttcgatcttaaatgaacgcgtgatatcgacgtcttctatcccccagacactagcaggagcataatttatgtcttcatacccacgatgtgtaatgggctctaatggaaatggtggtgggatttgcgttaatggtggcgtatcaactttcatcccatagtcggccccaaaataaaattctcgacgaggatcatcccataaaagtcgatattctaatcgacgaacattttctggtttgcataatggtaaatctgggacccataaaccatcctcagcaatgtcagaacctgatacaagtggaacatcatcgttttgtaatggatatgcaacatttgcttgagataaaagtggctgatctggttcattagttgtggttttacgattaattataacaaatggttgatcaagaataggttgtggttcaataaatttgggttcatcttcaagctctagttgagatatttcttcatcaagatcattggatgattcacttttgttggattcttgttctgcagctacatttttggttaatggtgattgtagttgtgacatttgacggcggaataaatctttaagtcgattgacagtttctgcattcattgttgtagattcattttgtggttgagatggttgtggacgactttcattgatatcttgcgttgaacgaaatgattcatcaagtgaaattgtgtttggcataaatggcacagatactggagttctttgaggttgtgctaattctcttaggaatgttggcccttcattgatttgctgtctgacacgagctaaaagttcatttgatcttgcaagcacctcgttagaatcagccatcaaaattaaaacgtattttcgagtacgtttaaattaacacttttcaatactttactcagaatttgatttcacttcttttctcaacgaagaaacgaaattaaaaataagaaaatattgtttattctttgaaaaagaatttcaaacaaccaacagcctattgtcatcattattctttatcaacatttgaattttcactgccatcatttttatcattttttggaatttcttcaagacttttaatgcttataatgtcttcataactttgcagacttccgacatcttcatcaccccgaagacttccaatatcttcatcaccttgaaggcttcccatatcttcattgcattgtagacttcccatatcttcattgcattgtagacttcccatatcttcattgcattgtagacttcccatatcttcattgcattgtagacttccaacatcttcaagactttgaagactttcattatcttcattgccttgaagacttccaacatcctcaatacttttaatgcttgcaatttcttcgaaactttgaagacttccaatatcttcgttacattgaagacttccaacatcttcattgttttcattgtttctgaagcttctgatgtttccatttatttcaaatgcttcaatgtttttgctgtttacattgtttttgatgcttatattatttttgtttgtatcttcgttgttagtgtttgtattcttttgcattgcttcgatttgttgaagtattttataagtcatgttcatattttcttgtaatttttcttctgttctttgtttaaattcctccaattcgaatgtaatgttttgttgcaccaatcgtatatcttcaagttgaacttggaaatcaagaaattgtcgatctacacgatcataaagagatttataatttgatttttctacttttaattcatcgatttctttttgcatcttattaattaacttcgtaaagtgtttatgttgcgatttgatttcttcattaatttttgcaatttcattttcattgttattgtttgcttgattatgtggttcaaatggagctttcggtagttgaaatgcattcacttttggcgtaaagctgttaaatggagtcgtaggtgagttaattgatgcccttcgttgtgataataatggatttccgccaagttgaaatggtggtagtcccattggtaagccactaataggtgcagctggtttgggtttaggtttaggtgctggttcttcttctttagcttttggcgtttctgttaatccttcatattcaatgttgaaattttttgcaattttctcaagctcattggttgatataatgaattctgctttgaaaatagagttctcatactctttaatgatgtcatatgacttatcatctggatataatacaccaaaattattggaaagattaacaatgtccgattgaagcttcgaaataagtccggctggtgccatggatttatctgataaacgagttaagtcttttgtgatttggctaagtatttcttcattttccttattgatagaattgtgtaatgacttaagttttacaacgaaaacaaagcgcccatcaggagctctttgaagaaagtcatattttgtatagtcaagttcattttcatacttagatttgatttgatgaagaatttttgaaatatctgtgataaaagagctaacagccttacgcttttcctgaaatttcaatgatgtcaatatgctttttccaataacttctgtttttgattttatctctttgacattttcagatatggaaggatctgtttcttgcaacttcagcaacgaatcggacaacatttggaatgtctctcggaattcgacgcacatttgcatttcttgagtcatttggtctccaatcttcaaaattttttgccgccaaaccgttccatttcaacgttttttaactattgaaaatttactttttaatgattttattttatatcgatacaaaaaacgaacgtcgtcaaattatttttaacaatgaataatatcttatcaaaaggattcgtgttaatataattgatcaattataaaatttcttatgaataaaatatgtatttaataatcttttttttattcagaattctgattatttttaaattctatatctaaatcatctttttcgatgatcttttgcattatttcttctaagctttcaattagtattgtataattttcaaaccctaattcatttttcattgattctagtttttccaaaacatcagcaactcttaaatcatttggtataaaaattgtcaacatattatttctagaaaaagttgcttcaggaacaatacttcttataacattaagaacaccttccatatttggctctccatcaattattgtaatattataaccacaattatattcatttctcatatcaacagcagtaccacaaaatgatatatgacctttttgcatcacaacaattctagaagctaacatttcagattcttcgaatgaatgtgttgtcattaaaattgtactatctttaaaattatctaaaatcttttgaataaattgttttgattgtacgtcaacacctgttgttagttcatcaaaaattaataatttaggcgatttaagtaaagcaagaattaattgtaattttctcttttgtccaccactaattttatctgctttattattaagacattcatttaattcaagtgttgatgaataatattgaatatctttttcaatttcattttcatcttttcctgtaagtgaatcaaataattttaacatttcataaacagtaaattctttaattataatattatcttggaaaacaattcccaaatttctatatatgagagaaaaatcattattaattggctcattacaaaaataaattgttcctttagttgttggaaatgttccgattaaagaattaattaatgtagatttcccagaaccatttgatcctattgtaacaattacttctcctgagttaatatataaagagacatcgtcaagagcctttgttttcccataatatttagatatatgttcaaatcgaattacttcattatatttatgaaaattattttcttcttttttaaataatcttttccattgttcctttttaaaaaattttctccaatagattaatggagttccatataaaggcgatattattaaagtaagtaatattgttaaaattatatataatattgtatttgcaaacatacaaattaatacttctaaagttgagatagtatttaacttatacgaaatataattccatgaaagagaaaatccgcttgtcttagcctgtaaaattaatgcattaaaataagagaaacctgcaaatgggaataaaataattaaaggaatccaagctgaatctgaaattttatcataaaaggataaaagaaatgggaaaaggcgacataaacataaaagaatgataataaatatagttgatgatactttaaaataacataattgttgtcctataaaagttaaacatattatactaataatatgtaatataattccaattaaatataaagaaatatctgtaccttgtgatcctattgccttaaaacaagtcatgtatgttgttattataatgcatggtaattcttcaataaaataaataaatgcatttgttaaaaatttaaccagctccgataaattatagattctaagcataaaaaatattttttcattgcttagataataatatattaaagaatccgaagcaatagtaaaaataaatcctattaaaatttcaaaaattgatgatgataagaatttatctgtaattatacttgcataacccatatatttaatattcatttttaattttttaattttcgttaaaacataatcaaaaaatccatgtataaaatatcttctaacacttgaaacgtcagaaattagttcgaaagaataatcttttgtaagggtataaccaaagcctttatattttttttctttaagaaaattttccatttttgctcttgttggaaaacctcgaatcaaagaataattaggaataaaatcatttgtaaaattcttaatactttcattcagtggcgcataacatacatgataatccctgaattttataaattcattcagaaatttccaagagttattaatagataaaacttcaggattttcaatttcctttctttctcctttgtgtgaattcaaacctgctaatattgagtaagctatactaaaaaaaagcaaaatataccatctaacactccttatacgtatcatcatcataaatttaaaatatattttaaattgttcccatttagaaatttctgatttataattttcattattaaattgtttttcttccatgtgttctaattctaattcatttgttttatgtataacatcattcattgaagaataaccatgaaaaatctttcagttattcaccaaatttttattaataatgtgttaaatgataaaaataaaaatctcatttttatcaaactgcaaaataataaagaatttaaaatttttttatctgaaaaatttataacgatacactaacgaatacatatcgaacaaaagaattattaaatattaaaaattttagttttaaaagttttttcattgatataaaaatttgattttaacaaataaaaaaaataaataaacgacactttatattttattcaggatcacttaatgagagtttttcttggaaaatttgtagtttatgaatatcttcttttattctatttataacatttttaaatgtttcatcggatatatcatttttatcgaacatataatattgaccaatttcattaattattgtttctttccaaatattcatttcgtttaacattttttcttttattatttcgactttgttatgttgattattttctatttctatttgttttgctgctaatttttcgccaaatttttgtttttctctttcaattacattttgtaatgttaaaattttttgttcattttcatttgatatatttcttattaattcgttttctttcttaagtttttcatttaattgttcaatgttctttaatgaatcggaaagaaattcgattttttctttaaaagtttcggaattttgattcatattatcaataactttttcataattatttctgatttcgtcaattgtttcattatttttattttcatttatatatttctttaattgtctttttagatattttattgttttatttgattctgtttcaagattttcatatttattttgaagttgttgaaattgttcttttaaattattttcattaagtttattttgtttggaatgaatttggaacataaaatatttcgattttacattatctaatgttttatttgtattttcaagttcattctgaagttttttattgttattttgtaacttttcaacctcactttgtaaatcattaattacatattgtttcacatttttaagttttaaattagtaatagtttcatttaatttttcgatttcattttgtaaattattattttcatttcgatatttttcattttcattttttaattttaatatttcatcgaaataatttacttttttattttcattttgctttattattggattattatatatagtttcacgtaatttaattcttgattctttaatctttttaagtttattcattaagtttttaattattattggaatttcttcaattgattttgctccaatttgtttagcaattcgttcatattctaactttttaacagatgaattcattaacattttattcatttcattcaaacgttggtttattaaaaaaagagttgtaaataaacaaaatgaatcattatcatcatttacaagtttgtttataacttttctccgggtttcaggtgaacttgttattaatatgttaacaggtattatttctggatcattaaattctatgtaacttgaacaatttttagcaataaaattttggaattcttcatctttatcacaaaaacttatgttatcaagttccaaattaatttttgataaatttttaaggccggaaattattgcatttaatatttcttttgttttattattttcttctttcgttttcgtgattttttgttctaattcatttatgacattttcttgtgatttataattatcaagtaattttgaagtttgatttattatcatttgaactcgttgaattggttcatattgcttcattaatattatttcatgacattgtttatttaatttttcatttgaaaatggaatttttatttgcgaaatgtcgaatttgtcttgtagaacaaattgacttaaatttgatcgttttttgatcctttcgttttctttgactttatcggccaattgttcttctgttttatataaaattaaattaaaattaccaatcgcattaataagttgttcacgttcttgtgaatattttgatagttcggtttgttgtaatttaatttgcgattgtaaaaattcaattgatcttttaagatcattgttgtcttgtttaatgattttattgtttgaatggctttccttttgatttattttaaaggattcaaattcgagttgaagtgaaagtaattcatctttaagagtttgattggtaacaagaaaagaactacgttctttatttaatgacatgatctttaaattggattcattaagtaatttttcaaagtttttacatttttgtttatattgattttgttttgcaagaagctcaatgttaagtttctggattgattctaatttattttttgattcatttaattcagtgtataaactttcacactttttcctgagagataattttgaatttgttaacttttcaatttcttgtttgtgtaaagattgatggctggttaatttcttattcaaatcagcgatggttcgtttttggtcacttatttcttttttgtatttttctctttcattgattaaattttgaattttttcttttgaatcagttaattcaatttctaacttatttttagctcttacatctaattcatacttatttatttgttttttagcagagcttagttctgtttttagaaaattaatttgaagctgtaaatctgtatttattttccggtattttgctaattcattttgcactccttgtgttagtataatttcgctttctacggaagatgtcatgtttttaaaaggagaaattgtttcttcgctcatatgaaaatccgtttaatatttttttcaacattttccaaaaaaaaaaaaaaaaaattaatttcattgtataacctttacttacatattacatctcctcaccctgatttttttcgtctaagtaaacacgataataacccatgatcaagtttgctgcttcttcgatatctccttcgttattctctgtatagctttgtatgtaattcaatgtttccgaagattgttcaattagcgaatccatttccatttttttaccagtagaccatagtctattaaatattgtggaaattgcaccagtggcatttataataactccgatattttccgtttccaaaaaaggaataaagaagtcaaatgtaccatattcaacaatagccttttcaaattgttgagaattaaattgcattaaatcgcaaatgaattccatcgatttttcacgcactccatatgaagaagtttcacctaattcaaataatactttaaggattttgctggatatgaattcttcagcaagagtatcaattgtactcattttacttaacatttcaattgtttctaattgatgaatttcattgtcgacttgaagattgactgaaaatacttctaaataatcatcaggaaaatgttctttagcaaatatattatttaatgataaatatcctaataatttacaagcggatacataggcttcagaatcaatacgtaaataatgaaacaaaattggcactatgtttattttgcaaaattcttgaaatgatttttgaccattaagttgagatatggttaaagatgcttgaagtgcacaagaaacagtgtctttgggtgtctgattggtaagaaagagtgaaataaacgggattaagggttcaaaaaattcaaataaaattttaggcgggatcttggaatctgcaaataactcggtaaaagaaaaaaaacagttaatacatacaaaattaggtgggctagcaactagagcatgtgcgataccgtaaaaaatttgatcaaagctttgggtaatgagtttatcttttgggtatttgaaaaatataagattgtagagaatgcccatggaaggtataaaaatttctggatgttcattgggattgttttgttgactagaaaatgttgaaagaatagataacactgacgaagaaagagatgaatccaccaatttcattcctatctcacaaaatcctgtaaccctttcaaagaactgtaagattattgggagatttggtggattttgatcaatttgttggagaaaaggttcaatttgagctatttcattcggactgatcccttgattttcttcttctatttctgtagagtcgtcatttaattgaaatctgttcctttttctcacgttaccgactttatatccgatttgcattggtcggagaatttaacggttaattgaaagcaaatttttaaatgaattatctcatataatattttgaatattttgtttgtatattttatttacggttttataaattgcatttcatagaatatcaataaattctcatgaaaaaacagacaaatcaattacaagaaaaaaatatacaaaaagcactcgaattaacatccaaaattatttttaatttgaacaaagaaaatttacctcaagaagtaagttctatttttgaccaaatatttaatgaaaattatctattcactttcaattttattataagtaaaatgatatattcttcatatgttacaagaaaaaatgaagtaagtacaataataaattttattaaagaaattgaaatatatgaaataacacataatatagaatccagaataagtaaaactttttcaaactttcttatcaacacaaaaaaatcatatgggtcaaattacataatagataaaatggttgaaatgaaattaattgatgaacattgtaaaacagaagcagatgacaatgacgatacatatcttaaagtgaatgatcccgagcttcataagaaattagttgaagaaggagaaaatccaaatgaatttgcaaaaataattcgaaatgatgatgtagaaaaacttcaagaaatgacaacacaaaatgattttgattttgattattttcttgtaccatcaccttatgaaagatgttcatttattagacgatacatttcattgattagttacgcagcattttttggatcaattaaatatttgcttttaaatggttctgatatagaaaatatagctaaatatgcaattgcgggcggaaatttagagataattcatttatgtgagcaaaatcatgtttcattgatggatggatgtgaaatagctattaaatttcatcaaaatgatgtttttatgtatctttgtgaaaataattttataaattttgattataaaacaataacgaaattaggagaaaaatgtattaaatatcataattatgaaatattttcatacttgaaaaatgaaggaatgagtgttgataattgtattattaatgaagccgcaaggactggaaatttgtatcttgttagatattttttaaaagaaaataaaataccaaaaaacactttagcttattcaacacattcaagaaatattgaacttgtaaaatatgttttaagacatagaagaactgatataaatggtaaagatatttatttgatgcatttgatatttgttttaatgatttgatgattataaataatatttggtaactatttaaatttttttcaactgcgatcataatagcatgtagtatgggttacatagaaatagttaaattacttctgagaaaaaaaggaattgatataaatattaaagatatttatttgttttatttggtgcttattttaataatttcatatttcaaaataataaatggaaattatttcaaatatttgaaacagcacttatgactgcttctgcaaaaggtaatatcgaaatagtcaaattacttcttgaaaaaaagaaaatacatataaactctaaaaatattcatatgttttctctaggatttattttaataataatttaatatttcaaaataaaattcaaaatttatttgaagtatttactacagcacttatgtatgcagttaaaaaaggtcatacagaaatagttaaattacttcttgaacaaaaaagagttgatattaatgccaaaaatatttatttgttttatttgacatttattttaataatttgatatttcaaaataatatttggaaattatttaaattatttgatacagcacttacaattgcatccagatgatgatgatcttcaaatgattatactgaaatagttaaattacttcttgaacaagaaggaattgatattaattctaaaaatttttattaatttgttttaatataacttttaattttctgctatttcataataacaaataaaatatatttatattatttgagacagcacttattaaagcatctcaacgtggttatatagaaacagttaaattacttcttgagaaagaaggaattgatattaacgctaaagatatttatttgttttgatttgtatttattttaataattttatttttcaaaaaaatacatgataattatttcaattatttgaaacagcaattatgtgggcatcttggtatggcaacatagaaatagttaaattccttcttgaacaagaaggaattgatatcaatgataaaaatatttatttgttttatttaaaacttattttaagaatttgatattttattattatatttggaaattattcaatttatttcaaactattttaataaaagcatctgatcgtaaccatataaaaatcgtcaaattacttcttaaacaagaaggaattgatgttaatgctaaagatatttatttgttttatttaatgtttattttaataattttatatttctaaataaaatttggatattatttaaattatttaagacagcacttatgtatgcatctgaaaaaggttatacaaagatagttcatttacttcataaaaaatattaaaatgaaaagtttatatgcaggaacataaataaatttagtgtgaatcaaaattcgtaatttcgatagttttattttacaggtcaagtgcattaaattcatatatcatttgaaaattatggaaaactaaattcagtacaatatgaaccaatagccatatcataatgaaatgaatttaagaactatttttcattaggttacatgtgctttttatgctgagtaattaagtatgcaaaatgaacagatttaaactaattaaaaatatagataaaaaataattaaggtttgggatttattgtctttacttcttcttcttatcttcaacgaccttcttttcgacagcacggataacgccaacagcgactgtttgcttcatatcacgaacagcgaatcttcctaatgcagcgtattctttgaatgtttctacgacgagtggctttgatggtacgacgacgacgacagcagcatcatccttttggatccattctgggttctctgtgaccttcttaccgtgacggcggtcgatacgttggacgagcttgtcgaacttgcaagcgatgtgagctgtgtggcagtcgaaaactggttggtatccagcgtggatcttgcctgggtggttggagatgatcatttgtgctgtgaagttgatgcattgcattggtggatcacggttagcttcaccgacgacgtaaccacgcttgatgtcagagacggcgacgttcttgacgttgaaaccgatgttatctcctgggacggcctctgggagttgtgtgtggtgcatttcgatggacttaacttcggtggtgactgttgatggtgcgaagacgactgtcatgtttggcttcatgataccggattcaacacgaccaactggaactgtaccgataccagagatcttgtagacatcttggactggaagacggagtgggcggtcgaatggacgctttggtggttggagtgtatcgagtgtttcaaggagtgtgccgcctgtgtaccatggcatgtttggtgacttttcggtcatgttatcaccgacaaatccggagattggaacgaacttgtattgttctggcttgaaaccaatgttaccaaggatgtgtgtcatttcttggacgatttcatcataacgttgcttggagtagttgactgtgttgtcatccatcttgttaacaccaacaataacttgcttgataccaagggtgaaggcaagaagagcgtgttcacgggtttggccttgttcggcaataccggcttcaaaaccaccgcgtgtggcatcaataacaaggacggcagcatcggcttgggatgtacctgtgatcatgttcttgatgaagtctctgtgtcctggagcatcaatgatggtgaacatgtattttggtgattcgaatttccaaagggagatatcgattgtgataccacgttcacgttcggccttgaggttatccataacgaaggcatatttgaaggaacccttaccaagttggacggcttccttttcgatttgggcgagctttctcttatcgataccaccgcacttgtagattaagtgacctgtggttgtggatttaccagcatcgacgtgtccgataacgacgagattgatatgttctttctccttacccatgggacaataaacaaagtgaactgaatctttggccttgtaataaacgattcaattttttgacgaccacgagcccagtttttaatgatctcatataattaattgaatgtatttttcgctttttgaccggatcttaaaaagtggacttatggccaatgtgaatcttaatttgaggacagcctcggataataaacggtcatttggaaacttctatttagtttgttttttaaataaaacttataaattcatttggttattcatatgaaaggttgttcgttcatttaaaaaaacataattacagataatattaaaattataaacataaaaattcaaaaatcaaatttatcctttttatattgaataaaaaagacagaatattctgtttcaaattgacagaagggatttgcttttattttatatttcattgaatatatttagaacctagattgattttttaactaatacaaaagattcaacataacctgcaaagcattgattttttttctaaagatattgcattcaaacgtattaaaatatataaaaagttttctaattactcgtatataaaaactggaagatcttcttcatttaatttattaaatagaaaatattaacgaatgcccgttataataaaataccataagtgatgtttcaaatatttgaaataattttcaaatattattttgaaacaaaaaattattaaaacatattataaataaatatttttatcgttaatatcaattccttctctatttcgatatggctattttcagatgcttcaataagtgctgtataaaataattgaaataatttccaaaaaatattttcaattttcaatttattaaaagtattaatcaaaacaaataaatatctttagcattaatattatcataaaaataatgaaagatatctttcgctgaaattgaattgctgttacataagcattattaaatgatgaatgattttgttcacataaatgaattatttcttcatttccacctgcaattgcatattcacctgtgttatctaattttgcacattcataagtaaatgtttgaaacatttgattggtccaaaaaatactgcttaaaacctttacttcattaataaactcgataataatttttgtgattatatcatttattaagcatccctctggtattcattaaattaaataaaacaatattttttatcagtagttattaattgagttacattttttttatgtaattcgaaatcatttgctaagcttaattttatttgaagttcaaattatattaatatcaaattttttcatattaaaattacaaacacagataatagtaaagtaggtgatcaaattatgcatatgtttagctaaagacgtgaaaagattcattaaaaggatatctgaagcgatgtacttcaataaagatctaaaaagtatttataaaaatttacaaaaattagtcaaagatcattgatcgtatttgaaaaagcagattaaaaatgaataaattcatcatttgagtgtttaatgatgatgtggtggtggatgatgtggtggtggacctggtggatgatgaggtggtggacctggtgggcctggtgggtgatggtgtggtggtggacctggtgggcctggatgatgtggtggtggtggacctcttggtggcatcttaaaaaatgaagtaaaacacttttctgcttgtcagatgcaagttctcaaaatttcaattagaattcggtaattaaatgagtagccgttttccacattcaaatttcttttgaagtgacctgaatgaacttatgtcacaccaaaaaatcatcggaacgataggttgcgttttgagttttccggtgataatcatgtattaaaaacaatttttcggctttattttctgtattaccaaggttgaagatcatctaatgaaatttcacctctgactgtatcaattgattacatgaaatttagaaaaatatgttttattatctaccataagatgcaagatttaaccttacattgagccacatgggttatgaagaatgttctctagtatcatatttttaatgatttaacaaatcagaagttattagaataactgacttctttttagcatgaactgagcttagacaacaaaaggctattattattaaactttttttaatcattaaatattaaatcatttgattggtaaaaaatttattgttattattttgattttatattaacgcccaaggtttctaagaatgcatattgccaaacattcatatactaaacaaagtttatatatgacctaaaattcgatttaaatttatccttttctaccatgactaaaggcttacagctcgaaattttacatccgattgatgaaacttcaagtaattaaatttatcacactatgaagggattttttagctattgcttacagtatgtagcaactaataattacaagatattttaaagaaatatgacaagctaatattgttatctgtaattcatattcattaagaacagataaatccatcaaatactttttgacacttttgtcaaagtcaaatttgcacttttttgtgcccaatgtgttttcttcaaaaattggttgattaaatttatgtattatcaaatgtaatatccatttaacaaataaaacttttatgaaagtgaagaagttggtattggatttcacatttagaatttataaatggtatgatcaattttttcatattaaatatgctacaacaaatgtaaaatcattagacaattgtcattaatattgtaagtcattaatattttgcacgttcatgtcatgtggcattcccgttttgaaaaaagcgctttatatgaaagcgaaaatctttcaaaaaattgtgttcaattttagccgatagcttggcatgccattcaactctaattgaaaatttatcgaaaattataatttgaatgaaaatacgataaatattgtgttctggcacctgtccagcaaaacagatcacaatgattcgtcctctcgcagcatttgagaagtatcacattgacatcaaagcctatgtacaaatggcgctcaaagtaaagaattctgatcaagttctaccaacaattcagaaacttaagaaatatgcattagggttaagaaccagagttattgacaatgaaaaactacttgttagtgaacaagaggttccaatatattctatcccatcagggttaggattaaaacaagcatgtgattacatgtcagaaaagcatacccgtccagtttcacaagctcttgcatccataggtacaactggtaacacgatagtgtttcattcatgtcatctttgcgcggatggtgcctttttacaacgcctatttaatgcgttaaaagacgaatctgctgatattgtcccaaatgcaataaccccaattggtaaaacctttgaaaagcatattaaggaggcaactttaccaccaaaatttgttacatctgatccaaggctttcacgagttaaaacaatagatccacttagcttaagtaatattgatcttacacaaagttattacttacaaacgcctttacgagcacttaaatgttcaaattctaagggtgaaattcatcgacttacagatagtttatgggctcagcttatccttactgctgctgcacttaatggtacatttaatgagaaagcatgctctacatgtattaatcttcgaccatatcttgatcaaattcattttggtattggaaatgcattttcatggcttactgttggagctgaagcagatagaaacaccactgtaagtgaatttatgaatcgacttcgatatgattttaagaatcaagtcgatacaggccttcattttggttatcttaaaattgttgaagaaggcttagctaaagaaaataatgttaaacatattgggcctgcagttgaactttctcatgttggaagattcaaattgaatgacacattttccgacgtatttattaatgcaacgcttgcagcgcctaaagttttaggtttaacttcttgtttaacatttacagtcgaagatgattatggtagaaatgatttgatttctaactttagatataatgcgcaggaattgacattgaaagatgctcaaataattaacaaaacaataatttacggattacaaaatgtcgattttaagatgacttgtggcgatgctattgatatgcttgcacaatatgctgaaaaattaaagaaagaaaataaagaatttcctcattggaaggtattataaataaaaatataaatttaaagttattgcaaaaaataatttctttttccaattaattgttggaatctttttctgaaaatacaatgttctttaataccgttcataatggaaaaacgattaatgtcagtttcaagtgttaatgaagaaatcaaacaagaaatattggtgtttctatcggctaatgattttgaaagacattaaaaattgtatatttttaattttggcataaaattaaacatgattttttttttgttgcaatttgtctataataaagacacaattgatgatatttccaacaagctacagaacaaaatttctaatatcgacgaactttttaaaaaactcgaagtaatcaaaacaagacttaaattcataatccctactgtttccaaaaaatccatgcaatctttagaagaaaaacctgtttcactttcttcaataaattcatcaagaactgatgaatataatagtttgatgaaaccctttcggcttttttcatcaaataatacaattcctgaatcttttcctccatgtataattgggaaggggtttgcgccaatttttacatttaaaactcctacagattctgttgccagtcaaattctcatttctccgacaccaagctcaaaatgtgttccaaggcaaatccgttttgacttttactatcataacaaattcatgaaaaagtcaagtgtgattgattttccaaatgggtgttcagctcagcttctatttgatctcgaaactgttgtagtatttgataaagtagaagcaaatataattcagaactggggcgagccagagaaaacctgtttacctatgttcaaaattcttggaccgcgtcaatgaaaattatctgtgattaaaaaacattttttgtttttttttaacaagggcaaacattattagacttacaatttataattcttttgggaaattattaaattttaagattaatacttttatttaaatgaaaaaaaaatcttagcccttttatttttgtagtgttatgaatttattatgttactctttgtttaaaatattcaaccattcttcgtttttagcttaatgaaggaaaaaatgctgaaccattcaaaatccagtttttcagagtttatttgttcgagtaattaaatcacgacatgaaatacacaagttataaatatgcagaattcgaaaagatgcttgacgattggatgggcgctgaccgtaatggtgattctgcagttgatgttatcactgattataatgatgaaagaatatgcaaattagatcttgcaggttgctgtccttatacattactcctccacaccagaatggctcgtcaaccatgtcgttataaaatatgtcctgcacccaaacatctcaaagaaaaataccagaaagatagaaacggaatgaaaactacatatgaccaacaactttatgatatcttagaaggtattcttcgtttagccgacaagcacattgccttttccaagaatcttcgggataataaagcatctgaacatcaagaaaatcctcaattacgcgaaatggagaagcgggctaaggccctacttgaacagtgtcgagagtgtggtgttaatggagatgttgcacgagctcgagcattatatgataatgcagatactgtcaaacaacaatatttgaacaaagaagacgaacttcgtaaaatcaatgccgaaaaggaatccaaaattacgatttgcgaagtctgtacagcggttatcaaacaaagcgatatggaagggcgaatggcagaacacgtcgaaggaaggcagcacaaggcgtatctcaagatgagggaagtgtttgagacactgaagagcgcaggcgtcgttagtaagagaagaagatcgagtccgggctatcgaagtagaagagcatcttctgaaagaattttgcagccattggatgactgagaataaatgttttcataaagattcatttctttatgatgtttggattgaattaaacaaagtaaaattttttaacaatttataaatcgcaaaagaaatgtgaaatattgtccaaaaatacttctggttatttataaatatatcaaatcttaaaggaattgattctttatacatttgctcacttcttatttaaaagtactttcaattaatgaccatttttgatatgattgctaaaattggaaattgttacactcggagaaaaattggggaaattgcatttgacatttgttattccttgaataacataaaaattcacgcttcagtacagcattaccatcacatacttatttcatgtggaatttttcaaattattaacatttcttcagaaaatcaaatatattatttgaacaatgctatatagcatttaaagatcatgtatttagtgattccaataatttgaataatacaacaatttcatcatcagtttcatcaatatcacagaaagctttttctttatgtataaatcttcatcatattaaagtatctaattatgaaaatgatgaattttttatgataataatatcaatgattatgatatatcctaaatgaattacaaatggaatttatcggatcttaaaatatatatatatatatatatatatcccaaatttagttttaatgtttgtttaagtaaagtaatgacatttgatacatatagattatagttggacaatttggtgattttaccatcagtataggattaaagattactatactttagaacaaaaatatttttacaatcgaatacttttacaagtaaatatcaatataatgtaacgatttatcattcattttaaaatgttaacatatacaatatcacaaacagttgcacttattaaatcatttatattgaatacattagttatttctttactattttttatcaaaatgattatgaacaaacaaatgataataataatacttttattggggtttgtgttccaattgttatttgtgcaatagtagcagtgacattaattctttttcgtaaaaagaaactaaaattgaagaaagtgttgttttatcagccagtatatttactacgggaacgatcacagaaaatattaaaaaaaatcaatttgcatatgtcattaaatctaaatttaagccaagcaaatttgcttaaagagggaaaagtgacgtgaaatagaacgtttaaatttttctatcgttaaatctcgattttggtcagatggaaagttgtagaaatgtgttgatcaagcattcagtcacatcattaatacaatgggtttattcttcagtgatatatataacaaatggtttaagaacaaagaaacaagaattcttatgttaggacttgatgcagcaggaaaaaccacagttttatataaacttaaacttggagaacaagtaacaacaattccaacaattggttttaatgttgaaacatttgaatacaaaggacttaacatgaatgtatgggatgttggaggtcaagatcgaattcgaccactttggagacattatttccacaatacacaaggacttatttttgttgttgattctaatgatatcggaagaattgatgaagcacgtgatgttttacatagacttcttgaagaagatgaattacgtaattcagttttacttgtttatgctaacaaacaagatcttccaaatgcagttaagccaatggaattaggaaatagattaaaacttaacacaatcacaaatcgtccatggcaagttcaaggaacatgtgcaacaacaggagatggtttgtatgaaggattagattggcttggtgaacaaattcataaaatgaaataattcaggaaacaaaggtaaataaataattcaaaaataattttattattaataagatataagttttcgtttctctttggatacaaaaaatacatcactaaattggtcaacttaaataagatctgtacaaagacatttaaagaaatgaatataccacaaatataaaacatatgattttaaatcattatttgatgggcaaaaaaattattttccttaaaaacaaaattagtagtaataaaatatccttaaataaaaatttttcaaaaaatgaattttatgtaaaattttgatatccttggggttcatcattaaaatagataaattttcgaatttgatcactttaggatacacttttttattttgaaatgatctccatattattatgtacatcttctttatgtgaagaaatagaaaatatggtaaaagaagaaaccctaaagatagggcaggttttctgggagttgacaaatttaacattagctcgtgaaaaattaaatgaattaataaatcaatcaagttcaaacactttaaaaacaagagaagagagcattataccattatctcttgttgatattaattcatcaagaacgaaacaatattttaattttctcatgccatttaaaatatttcgaaaaaaaagaaaagcttccatcaaacattgctccatcttttacaggcaagcagaattctccaattttcaagtttaaagccattactttatgcttagcccgacatataattttttctccaatttctgttacacatgtgtcatcaacaattcgacaatttcggttacttttttacttacaaaatgatttagttttcaagacgcatacttttgatcttccaaatgaatattcagaattggcgaattgcatttgatttggaaacagacattctcttcaattccatgcatcttgatgtagtacagaactggggagataacgaaaagacatatatgaatcattttcaattatatgggccttgatcattattaatgaatgtttatctttcgcattgataataattcctttttgttcaagaagtaattggaatcattatgtatgactaatttcagataaataattaatcgtcttgacaagatatctctgttgatatcacttatatagagaagatatatttagttttgtatatttaaatatttcttattttttttttaaaagattctaaataaattatgtattttttcacgattaaattgaacaaaaaccaaagtgctttttctaaaaaattctttttccaataacttaagttttaacaaaaaatgaaaacaattcaaaatttaggtatatagaaaccaatgtttttaaatcattaaaatatgtacacgattgccaccagttgaaagtattcattattcattttaacctactaaaatattatgatagccatgggtcactaagagcatcttcaatagtgtatcgttcgataggatttacggtcatcaattttttgatgatgttttgcgcctcgggactgagtttagagggaatcgtaaaccttccattacggatttgtgtgaaaagctccgcttgttttcttttagtccatgggaaacttccggttaacatgacgaataatatgacaccacaactccatacatcactagtgaacccattgtaaggctgcccactaatacattcgggagatgcatagcatggacttccacatggagtcttaactaagttattcctatcaacaaaattagcgagaataaaattcgtgattttaaattgccatgactcatcaattaaaatactttctactttgaggttacgatgtgcaactctattagaatggatgtattggacagcttcgagaatctgtcggaaaattggttttgcttcactttcatcaagatggcctttattcattaaataatcaaataaatctccatttgggcaatattcaaaaataaaataataataatttttatcagaaagaaaatcaatcatttccacaattcctggatggtgaagttgttgattgatttctttttgtagttcaatgtgtttctcttactctttatcatcaagtttttttggcataattttgcagatatatttctgattactttcttgatgaacacattcttttattatcgaatcttcatcatcgtcgctaacggtgttttgcatgtgataaggtccgacttgatttgggagattttgcacttcgaatttgtcagttatccctttatttaaaatttaatattggccccaatattatatgccatattgactgacattttacaccaataaaaattgaatatcaattttgtcattttctattaattctttctccgaaaaggcgggaaaatttatctgttcatttttctcatggctcgtacaaaacaaacagctcgtaaatctactggtggtaagactccacgtaaatcactcggtgctaaggcagctcgtaagtcaacaccagttgttgattcacaaggtgctaagaagcaacatcgtttcaggccaggtacagttgctcttcgtgaaattcgtaaataccaaaagagcacagatcttcttatccgtaagcttccattccaacgtcttgttcgtgaaatcgcatctggtttccgtggtgatcttcgtttccaatcatcagcaattgcagctctccaagaagcatccgaagcttaccttgttggtcttttcgaagatacgaatctttgtgcaattcatgcaaatcgtgttacaattatggaacgtgatgttcaacttgctcaaagaattcgtggcgaacgtaattaaattcttatatatattttatttattcatttttacatatattgacattatttaataaatttcaaaatgtatatgcgccatataaaacctgatatttgaataaaaacatattcataccgcaaaaaatatactctaaacagtacgtaccaatattaattgataaccccactgaattttctttatttccatctggatgatcatcaaacattccaacaattatcgtaacgctaaacaccaaaaaattttgatcaattcgcaaaataaaattaatcattttttactgtcctttttccgctctttccttgagtctcatttgctcgaattcttccgccgtcaccttaccgggctctacgctcaagctctttgcgtacagttcgctttcgtcgtgcattacaatttccgacaacttttcttgtatttgctctatcaccacgaagttgaattgtttgatttggaagctttgtatcttatcgatcagcttgaatatgcctatgcacttattgtagttgaccaaatcgtcgatgtaatccttattaccatcatagaagaaagtcaattgtgtcaagtaaacgccaatgtatggaagacacggaccactcttttgtccttcgtcatgaatgttacgaatctttgcgaagttatcatcgctctttatcgcgtcgaggatttcgtgaattggctccatcacattttctggcaatgactctaagtgatgctttaacctaaagatcgcgttcgagttcattgccgtcgctatagctatgccgtccaagtaatcgtgtagttgccataactctttagctaattgcgaaaagaacttaaacgcttctaaacgcgaatcaattgtttccgaatataatatgttatattggacccaatctgcaatgacattaaagttattagttaacgcaacaacattcggtgagcgatgtcgaatgctcggcttgctccatgcgcaatccaataattcttttggtgtgatcgaatagtaatacttcgcactggacattacgatttgtcgcgctagaacactgacatctaatgacattaaagtgaattgcgacaaaaataatttctccggaattttaacattacttaagtcgaatttggaatgcgataagaagtcatcgctcgattttccttcgatttgcttttgaagaacattcaacatacgcttttgtgatgtctgtcgacgagtattaatggtggaaagccattgcgttaagttttggagtaaagcggcatcgaaatcgaagaacgatgtttcgatccatttttccactaacacaacaaattgtagctcatctttgtctttgtcagtgtctttcttagggcggctcgattgagctatgagtggccatgcttcttgaagtttttgtaacatttgaaatgatgacatatatccatgatatgtcatcgtgaaaatttcaacatacgatgggctaagtttgggataaaatcgactcgcagcaacccatacaagctgattgatggtgcctttggagggcatttgtgtatcttcatcaaactcaattgactctaaatcttcgagcttttcttgatttaatggttgggattcggtcgtttgcccaccaacaacacctaaaacggcactggtttgttgacgtaactgtttttgaacagcttcaatttcagtgggataagatggcgatggcaaaagtaaattccagaaacgatcggcattaagaacaccacgctcaagatgatgaagaagttgggaatattcatgatgatcaggtgtatatattgggaattcaaatgagtcagtaagggctgaagctgtttgagttagacctaaaagttcgaggtgttgaaggataagtgataatataccttcttgaggataaagacgacgatctggtaaataaagcgatgaaaaggttgcagcccgagtaattggatcaaccctgttaaccatatctctaatttcaggatgacgtcgaaacaattcaatttcccaatatgatctatcatactctgattcagcacgcttggaattaagactatcaaactcagtagatactggaaatggttcagaacttatggatattacttcgcgtggttgagttaatacttttgatttaaaaacaaatggtggtatctttgaagcatctgctgaaatttcttcactgttttctacttcagatttcttggatttatgtgaatgacttttatgatggcttttctgagtgctcatttttatgaatctatatgagacatgttatatgaaatatagataaaaaaaaagaagaaacttgaaaacgcgttttttatagactatttaaataatattttccccatatttggtttcataataagatgcaaatgattataaaatttcaaattttaatttttaataaatcaataaagttatatttttgttccaagtagatttgacaatttttgagttgtatcgcactataacgttttcaaatggatgaaattattctatgatttatcaaaaagttattaagttcctccaattcgttggcggttatttttagccaaatgaaactttgcttaagaattaactcagcatccaatcttccaaggaaaaatccacttgacacaatagattcttatgttgctgttgatttaaattcaaagcaaaatattacacaatcaagagtaattgataacgaaattaatcccttttggaatcaaattttagttattcgtcttgatcctaatgaggaaataaaagtgttacgtttccgggtacgtaactgtaatgtttttggtgaagattctgatatcggcaactgtgaattaacagatttaaatttaaaaatgtatgaaattgttgaaaatagcttaacattaaatcttacagaggaaggtagcacagaaagtaagattaattttgatttacaatatgcacctattaaacatgatccttttaaaccagaaggctcaccggaacaaccgcctcaaaacgtagaaatcagtcttatccatgaaaattccatagacccagcgaattttggtttctttccacatcggaacttatttgattttaatgggaacaacaattcttttgtaccaccacctcctttccacggtaatcgtggttttgttggaggtgggcttaatggttttagttcttcttcatttaataataatcgatttcaatttaataactttcctcctaaccctcctaatagattgggcactggttttggaacaacatttacaggtacatcaagaaattctacattgaatccaaataattttaattttaatttcaatcctgtcagaaatacaaattctccaaactgggctcctttccctccacctccagggccagctcggtcgtcttcgagtgaagatgaatcagatgatgatagcgatcaaatacaaagttggagacctccaacaagcacaagaagattccaaacaggggagcctaagtttaaaacgacagagtcatccgaattagaagatgatgatgaagacggtgattcttctgatgatgattataattatgtagatgacgacaattctgatgatgacgatggttacgactagatattctactcattttatgttatataataaaaatacttaaaaattataaattttggatagagtacatgccgatcaaaaccgtttctaatgtttttttttgtgatttaaattttcttttttgtatttggtgttgtattttaattgcatttagccttaagctacctgccaaaatcgtaattcccaaaaaaaaaattcaaaatttcaaaatatttttaaatttatacggaaattgttcatttttccccatttcttttttactaaattttcaaatttattaatcaatttcttcgactagaggctctccagccaaaactggatgaaaattcgagatatgttctttgattatttgaatcaaaacatctgggttggctaagtgtggatggtgtccgcccttttctatcttaatatattttgcacctttgatcattttctgaggtattgctgtagcctcaaatttgaatgcccaatctgtcggttgaacgataagaattctatcggccgatagcttgggaaggggtgccctgggcgctttggcacgcatgtggattcgagcactgacgacagagcttggcaaactcttgatttcatttataatgaatttggtggattcttcaaggtcttttggtaaattccctctggatacttcatcaattaaatcgccttttcctgttaaagcagtaaagaaactaactgaatgattgaataacttggtctccatatagctagctattaatgtaagtgaaataatttctgctgaaagagaatgaaaagatgtaagatgtaaggctaaaaatccaccaaagccaaacccaacgagatggactttggaaatcatttttgatgcagtaagaagatcaaaacctgtaagaaattgagaaactgattcgtatggaggtatgctgataattagaacacgatacccagacttgattaaaccatcgccaataatgtacattgaatttgttgtgtcatatattcctgatattattataactgcttcatctctttcaactggtcctccttgtcgaaactcccatgaaacattattgatagtatcaacaaattgttgcactggggcattgcaagaaaagtttatgaattccgaactacttaagtttagttcgtgagacattttgtgcaagcaacattagggcaccctaattacaaacggtcaatttcaatcttttcttcttcttacagatgatttaatattccattatcatattgactttaagaattggcatgttatattctaagtgaaaaaaataataatgtttcaatagccacaagttggaaaagcaacttaaaatcttcatttttaatttcaattaaaagttcacaaaaagtgcgctcgaccaaatgggaaaaggaaatcggtatagaggaagaggaaaaaagaggtttgatcatgaaggttcaggaaactataaagcggactttccggtgcgtcttgccatgtgggactttggtcaatgtgatccaaaaagatgctctggaatcaagctaaaacgtcttggttatattcgtgttcttaacattagagatacattccacggtcttgttctttcaccaattggaacccaagttatttctcctgaagataaagaacttatgctcacttcaggtcttgcagttgttgactgttcctggaagcaaattgaccacacagatgtagctcaaatcaaagccagacatcacagaattttaccatatttggttgcagcaaatacagttaactatggaaaaccatggagacttaactgcgcagaagctttagctgcttgtttgactatttttggcatgagagatgctgctgctgagttgcttaaccaattcaaatggggacattccttcttcgaaatgaatgatttccttttagaaagatatgcgcaatgtcaaagcgctgaagaaatgatagcaattcaagaggaaacattaaagcaactcaaacagcaggacgaggaagaggatgaccacgaatgggatccactggttgatgggaatccaaaccgcccaagagttgttgaagaagaggagaacgaagaagaggaaaatgaagagcataagccagaagaagaggcaaatgaagagcataagcctgaagaagaggcaaatgaagaacaaaaacccgaagaagaggcaaatgaatgaagtttggaatgtaagctaaataaaattttggaatttactagaaaaaagtcatgaaaattgttttttatttattttaatttttttaaaggatactaaaagtaatattattaaaatttggtctattttagtctttaaatatctttcttatgagttttaggttttttaattagaaaattccattatagtaatggataaattacagtatatataaatttaatattattaattaattcttatatgaaactgtgataataacatgttatagtttgaggttttagtttatattaaatattttgatattcaatattataaaatattattttataaaagatatcttgtcacaaaataaatcttattcaatacgaattgaaattttttcgataaatttttctaattgcttaatggaggattaagaaaaataatatgaataaataaaggtctaaaatttcaaataaaaattatgaatgatattatttattttaaagatgtcatcatatttcgattacatcaatatcaaaatatctaattaaatacatgattgaaaaaaatcatcatttattacgactttcaaacaaaaatttatattatttaaagatcagtatctactttgatgaattttaaacctcttattttattcgataaaatggtgatatttaagaatcaattcaaccatatgtctaaaaaacaaattgagatcaaataagatagttaacttaacacattttgtcagatattatcttcatgtcaatcctattaaaacattaaaaaataagtaataaaacacatatttattataatatattttctatttaagcatgaaagaaatccaaaaactttgctatttcattatctattttttgaggagtatcaaaattactaaacatacttttaattacgtttgtaatatcttctcttcttttctggtttaaatttgtgaacagcactataatgtccatatcaataattttacttacggggaattgctgacttctaaacgcgatatgatcacattttgtaagttcgaagaacaaatttgaaatttccatttccaacacctttaataatttcattattccattattattgttattatattgggtcatatctaagaattgtccgattccaccgccgattgttatataactataacttgggaaagcacttaaaacttgtgtaattccagtaacaatatcaccggtattaaaattccatattaaatttaacttttgttgtgaattaaaaatccttgaatcgaggttaacatcttttagataataattatcaggtaaaacaaatatatttccgaggttatcacttgcgattaattttatttgattcttcggagcgattattgttttcattgtaataatatttcgaacacaaccttcttcagctaaagaaataacattattatcactacaattataaaaaaaatgtgataccgaacgttgtttatcaccaacaaatatattaatcatattatgttgtgagatagtgactaatgatgatatatatgaaccgatattttcgattttactaataagttgtaatgtattattagtccggatatatactaagataaaattactacatgctacaaagataattacttcgattgcttctttctttttggttgtacaacatgaaatagctgagatatgataatgatatgaaactgatactgatgaaaatggttgaatcaaatctttatgatcacgtggacaaaagtttgtcgcttttaatacataacttcgagatttcgtatttggatttcgtaatactattaatgcacaactaaattcatcatgactaacacaaaaattggtgatttgttcagattcaaatgcattatctggagtacaagcacattcataaggaggatttttagagaaatcaactaatgataaactgtgcgttttaactattaatattcgttgacttgaatttaatccatcgtgtttaaaaaaatgaaatccaacaataggtgaaataggttttttatgtggtctaaagatatcatctatatctggataagaagaaatattaatttcatttatgaaatcaaattcataaatactaagtgtgttaccttgaatagctaaaaatctcgaataaatgttattatgagggttattatcgatagaaaaaggatataatataaaagctgctgaatcaatattaatttgtgataaggatactcgatcaggttttttataattaacaaaccaagttttattacatgttattattgctgcatgtaaatatttttgggttaatgtttgttcatcaattcttgtagggattttaaataatattgggcctttccctaatatataatattgtaaaatttcaaatgatttcgtagttgtatttatatttgcaattaataaagtatcaattaaaccaattaataatcttgaaggtaaattttcagtatcatcattcgagttacgtggtctacattgtataaagcctaatgaataaacaggtgatttcatttccctttcgattaacatttcacgacgtgcatcatcattagttaatgttatcactcgtacataatatgctgaacttaattgattattagttaattgttggcgatttacagtacctaaaactaaacaatctaaatcataatatttattttgtggcattgttatacatactgcagtaattttatgattcaaagaaaagttataactttgagcttgactttgcattacaaaaaatttcgaaatttcatcagattcaacacaaattaaataattaacggaagatgctgttaaactagttttcgtttcccatgtacgtttttgtgataactcacacatataattacttgttatatgtattgtattaactttccctttatgaattagttgttctaatccgattgttggtcctgttgcattactaacatttggaggtaattcttctaatcgtccatggttaaatgtgaaaaatacattccctgaaggaaatgatagtacaaaatatgaaaaatcaggcgttgcaaacattccttttggacattctcgaaattctttttgatccagaactcgtgcacaatgtcctaaatttacaaatattaaagatgaatatgtatgtgagattaatctattcgtaaataattcttggtcattcttttgtatttgatatgattctaatgaacgtgttcctatagtacgctttaatccaggcataggtttcttcgtttgaatattataaattattggatatgtagacttattaactaataagaaaaatggttctttaatacaaaaaaatcgaatgataccaatgtgcgcaagaggaattggaatttggtcaactcgaaaattcccaaaataattgtcctgattttgatatatccgtaaaaatattctatcaaacattaatatgatggaattatcttgcaatgtataatataacgttgatgtaaacgcaaaacctttcgaaataatttcaggtggtaatgtaatatcatatgtttcattggtccttagagaaacaaaatgaatttgcaatgaatctttggaaaaaaaaattaaaacttctggatttaatgggactgcaaaatcacatttatataaaacctcttgtattttttgaaatggtgataacgaatataaacataacttttcattgctttccatcctgccgattaaattgcctgaaatgggaattgtttgaatagacatatatgaaggtttttcacaaaaaattagattaatagggtaatgggaaacatcaaacccacaaaagcctccatggcaacatgaaagaataagaatatttgtgcttgatgaataataaataaaatctggcgaatgacataaatcaggtagttttatttgatcaacagcaacaaaaatattttcctctggtttgtgtacaaatctaataacatctttaggtcgcgctgcataaaaagtatcaatatcataattttgttctttatataatggtcctttgcaaatataagaaactttggacataaagggttggctgtatatatgtattatccttagaatatcattttgaatgtatggttgatagacttcaaatgttgtatttaagttaaaaatatatgtttcgcgcaaattatttgctttgcaataaaacttgcctgaaagtacattggtgaggttaaatggccattggattgttgtgtgaatatatgtttcccttccagacatttggtttgcttgctatgtatacaatttagtaatgaatcatctcatagaatattttaaatgaaaaattgtatattttatttgcggttcgacattaccaaaagcagttgtgtttcaggttgttgatttgatttaatttagaattttaatacacattaaagaattttaaaagtaaaaaacacaagcctcttattaaaaagtgaaacaatgaaaaatttagtataaaacaaatcatttatttccatcaaaagtagtttggaagaaagtaagaacattgattttccttctcattgatactaactccttttgagacacatctgcttcattgattaaagatgaaagtttatctttttcttctttaatgaatgaaacacctttctccaaacaatttttcatcacaaataaatagtattgagcattagaaatttccttcatcttttttaaatataattgattttgcccatttttaaagaattcttcaacgattagatttgcctgttcaatcaaaccttcgcttagttctgtattaataatttctttagaagtcccacaattttcatttataaatttaatgagtaaatttatttttctcttaccagaatatattagaggttttttcttatctttaataaataatctaatatctgggaaaaaattgatatcataatcacgaataaatgttctgtatctatcggcatctattgatgcaaacttaacggtctctatgtcactgaaaagtcgagcgaggcgagaaaaccgaggagcaaaccttttacaagggttacaccatggagtatgaaagaaagttagaacacacttattttgatggatcatttcattaaatgttcgaccatttggtgtggatgcttgttgatcaattttttttggtgtaattcctgttaaatttgccacccaactattgatgctttcaaaagaaaaaccaccatcatattgatataccgtactattacaataaagtcgaatgcacggaatatcaaatacatttcttttcaaacactctcgcctatatttgccacaatcgagaccagcaatacgaatagaacttatgttcctaaaagatttggcaacaaggttataatcttcatatgaacgaacactttgctcttgatggtgcgtaaaaaagcgaactagtgtgcatctctgttttttaatctcttcatcaaaatttttttctgttaatgacataaaattatttagttgacaagatagtggaaaaagaaaagaaagcattgccttaacgttctctaaaatttatgtaaacatgaaaataataaacggtttccataatcgtgaaactgagatagaatttcccatgaaacattaagtgtttactcaaaacctcctttgagggaaataataatggtcgtgctcgttgtgtttggttccagggtgataatgtggtccatgaccatgatcctcgggacctcttggttcctttccacctcctgctctctttgccttttcgtatgcttctttcctggtattagagtaatcgcgctttgcaattggtttttcagatctcttcttttgattagctaataaaaaaacacctcctaataccgctgctccacctaaaacaacccacccaaggggcccagaacctgctgctactgctggcaatgctggtattgctgctgctgccatttttaaaaaaaaatgaaacaagaattttggaaaattttacctttgtttcaattaaaagtctgttcaaaaatggcaaaatatggattgtaaaatttgccaaatggctgaattaactgaacgatattaatatcgtttgtgtacttttatttttgtcatcataataagcaaaggagataaaatagaccaccccaaaatgagtgacgtgttgtaaatttcaatgaaaaaacgtttttgaatagaacgcatatacaaaagcccatcgttttgctatgagttcacttgttaaatggcaaacagcaatttcaagcccaaactcatatctgatgtgaggagcacaaaagaatacgagttcctaaaagaaacggatgagtttattcgattacttttttcatctcaagaaaaagacgaagatgatgtcatacaaaaaactatagactatctgaaagcacaccctactcaaacatgttttctggttaagcttctttcctattttacgagtgttcgaccaaagcaatggaagtttattacaaaggtttatcgaacactattagcccaatttcccgatcaagcatcagagattattcacctttcgactgggagtgtacttttttatcaacttctttcatctcaaggaattgttgaaagtagagaaggtgtttcaaacatgcccaaagtaaatccaataataatcaccgtatattcaccagattccctatgttattacattaaagaagatgaacttgaaaacttccaaaattatctcagtaaaaatccaacatttaacataaatcaaaagattccatcaccacaatacacggcacctttttatgtttgttttgaactttccatagatttactctcattatcagcattctatggttctcttcaaatctttaaatatttaatcgaacaaaatgttcaaattactaaacgttgttcattatatgctgttgcaggcggtcattctgatatcattaatatacttaaagaaaaaggagtttcattttccgattgtttttacacaagtgttcaatatcatcgttatgaactcagtgatttaatcattactaaatatggccaacaaaaaatgccattatgtgatactatatatttttatcattatgaagcatttctttattcattattaaatggaagtgatccaaatgaagaaaataaaaatcatttaacgcctatacaaatatcatgtgaaagtggtaatttaccattagtgaaacttttgttcaattatgtaacacttcaacaagatgaaaaagaatttcttttacatatgacagctaaagaaggcgacttacaaataatgaaatatcttatcgaagaattaaaaattaacaaagaagcaaaagatgttgaagattggactacattacatattgcatgtcattatggtaatttacaagttattaaatatttagttgaagaacaaaaagttaatatcaatgctaaaaacaaatatcatgaaataccattccatttttcatgtggttatggcgatttagaagtagttaaatatttatatgataaaggagcagatattaatgctgttgaagatagaggttatccatctgcattttttgctgtacaaaatggcaaattaaatattcttcaatatttgattgaaaaaggattcgatatatattattcaagtaatgataaagttactattttacatgtttcagctcgaaaatcttttccttgtttgaaatatttaatcgaaagttgtaatggtgatttaaatttaaaggatatcgatggaaaaggtttattacatttcgcttgtttaggtggaaatcttgagaacgtaaaatatttaatcgaagttcataagtttaataaagaagaaaaaacaaatgaacaattaacgccattacactttgcatgcattggtggtaatttcgacgtagtaaaatatttaatggaattgccagtagacaaagaagcaaaggacaaatggggttggactcccttctttttcgcttgtcaaaatggaaatttggatgttgttaagtatatgatagacaaccaaaacgttatgtacaatataactgatgctgatggaattaaaccgataatggttgcagtacaatttaagaagtttgaagtggcagaatacatttcaaggaaagctaacccaaataggaatgggcttggtttacttgcaagtttgggcattttttagataaaaagacgataccgaaatttgaatggaatctgatcgttttatgttacactaaaaattttttaccagaaaaaaataattttattttactaaaactattggatatttaacaactattttcgagatctcgaagctcttgatcttgtgactactcgggttgttgcggcacttccgaatttcttatcaaattcagatttgacctctggagaaaacatgtggtagtaacttaacctcaggtgatttaagtctgcctgtgaaaagttgtatccgatcttcaatagatattcgatagatttaattgtcatattgtttggatatgttcttattataggagctacattgtatgggttgaagctttgtggccatgttgtgttaactaactctaaaaacttttgattaccagtttgaagagaacatcttacaatcatttcgatttttcctctggtgaagttgaaaccttttgatatcaaatacttgattacgttgacttgtgcgtcagaaattttattgtaatattcattatacaccacataatcaataatacctctttgctgtgaatccaacatgtaaacgtcagcaccttgtgaaattaaatagtcgactatatcaacaaatccattctttgctgcctcaagaaatggaggagattttgcatttttccgtttaaaaaccgctttgtttttgacaagaagtttaacggtctccagagaaccgttacgacacgcgtacaaaagtgccgtttcaccatcatgcgtagttctatcaactgaaactccttcttcaataaggaattcaactacatctgggtgaccacccaaacttgcaaaatgaagagctgtggcaccatgagagtttgattcaagaaaattaattccaatttctttcatatatttaagaacttctaaatgaccataatatgatgctataagaattggaagtgaacctgcagcatttcgaatattgaatatttcagtatttgttttcataaaaatatatttgacgcagtccaaaaaaccatattgacaagctacatggataggagtgttcccacttttatcgccttcttttaaagaattttcgtttcgttctatgagacggaccatatccattgatcgacttgcaatagcaaaatgcattagtggacgctctataagatcctttttttctaggtctgctccattatcaatgaggaattttacacaatttattgcgttaaaatatgcagcaaaggagataacaggaggagcacttgaaagaaatgttggaagatattgctcattaaacccaatttcctggtttatcgcattatcttctgataaaacaacatttgcaagtgcttcaacatcgtcatttaggatggcatcacatattgcagcattattttctttaaatttgaattgttcctgaaaacttagaccggcaaacatcatcttatgaagaaatcacaaaagggtttttcctgcttgttttagtgtataacactttttgactccacccgtaacgatggtaacaatgaaaccaaattctatattataacgatcgcattcctgccaaaacaatatccgttcaattttagtatagtttacacggtcgtcaaggtgctccttccaagaaaacaaagttaacacgttaacactagcagttttaaataaactattcaatttttaaattggtcagttcatatgtttaattccgatgtaccctccaatcacacaatgcatttcacttattaaatatatacaacatcaatgttaagtgtttgggataatttttgatatatttacgaatttttattttgggctttatacatattaataatttaagtgttaccaaaatgtttatactttccacattttgttttgttgggaattactttgcaaaaccaaaaaatatacagtattgaaactaaataaaataatcaatttgatttactgcatttctgatggatgtttattaactttctggcgcgccgaagaaatctgccgggtcatcgaagtaaaatgtcttttcttcttcagatgaaatttgtacgaccaaatcagcagcgtaaacttcaccatcaccaacgccgaactgcggcaacacgccgagtctaattactgacttcgggtccactgtataaatcgttggcgagtcgattgggtaaggaggcattggctgatatgtaacaggctgctcgggcaccggctcaaacactgtctccaagtggttgctcagaacagtgtggtactcgtggttgaactgttcctgcagctgctcgagttgctgcgatatgtaatccacgttatcattcttagatgtgatctcgtcgactaatgtccggcccgctttctcgacctctttgctgaacgatctgaagaagttcgtgatcactgactggtactcggtcaattggttcttcgggttgctcttcagctgcttggaagcagactcagcttgcgtgtgcgcttcttgctgaagtgcggagagtggttcaaagatattacgcatggaaccattgatggtgctgaggtcggccttgcgaatctttgtggaggaggatgacgatgtcgtggtgctcttaactttggagacatcggacttgcgcttggatttgttggtgggcgtggcggacttcttcttgccgcccttcttcttgccgcccttggcagacttggatggagtttcggagctttgagaatgctcttcagaagttgactcgtcgtgtgatgaagagacgcgacgatgcggtggaggtgttggctgtgttggtggtggtggaggctgcgtggcaactggaacaggcttcttggtgggctgaatgcgttgggcagatggaagattttggtttggttctggggctgggggtttggcaggtggagctgctggacgtgtgggtggtggcgcaggcttggctgggggtgctgcgggtttggcgggcggtggagcgggtttggtggctggtgctggtggtgctggtttggctgcgggtgctggtttggctgcgggtgctggtggagctgcgggtttaggagctggcggtgctggtttggctgcgggtgctggtggagctgcgggtttaggagcaggaccaggtggacgagttgctggtggtgctggtgccggacgagaggctggtggtgctggtgctggacgagaggctggtggtgctggtgccggacgagaggctggtggtgctggtgctggacgagaggctggtggtgctggtgccggacgagaggctggtggtgctggtgctggttttgcgccaaatgcaggagcgggtttgggaacaccaggtggggtagatgcaggtggtgctgcggctggtggagcagctgcaggtggtgggttcctcttacctagaattgcacggaaaccaccaggtacaggagcagcaccaccaccaagagtcatatttaatctggctttgaaatccattggtttagccggttctgcggctgctggtggaattgctggtctttctggtggtggatctactttccgaagtttaggcatgccatttgccaatgttgcacccgtatttgcttttggaaggaatttgttagttgatgctgctggctttgatggtggtggtggaggtggaggaggcggtggtggaggaggtggaggaggaggtgctggcatttgattaaactgggaaactttttcataagaaactcaaaattgataaaatcacaaaagttgaacttgaacgttaagaaattttttctacaccggtgacaatatatctcaagatgtacttatttttttaagataaaactaaataagatatttattaaagatgttttcaaagatgttagtatcgataaaaaactttttagtaaataggttatgttgttttttaattcgccatgattaatgttcaggaaaccgttaataggacaatgttctcaacgataaataaattcggtagatttgcagcggcaaggactgacaaagcaattgtatattctattggcggaaatgaatggtttggtattagcaaagataatagatcaatgttatttacaactggaaaaggttcaagcccatcacctgtagatcatatcttaatggcactaggagcttgttctgcagatgatgtaaaatatgtgcttgaaaagaatgaaagaattgttaataagttaagtgttgatatcgagggtgaattcgctccagatccaccaaaccgattatcagaaatacgcgtacgattcaatttggactcaccaaatgcacttgaagaagatatcaaaattgttggtgatactgttttagaaaaattgtgtcctgttgctatgacattaacctcaaagccaaatataaaagcaaaagccacgttagtgaacaagaaataaaaagaatgtcaatttggatatttatacaattttttatgtgtaattatttactctttaaaatttaatgaaagggatataattggattctctttgagtgatggaacagctacagcgaagtcgacacttgtttttgtagcaattggaaatccaatttgagcttttaattttttctctgaatcaacaattaatttatatgattttgagttttgtgtgtatgataattgagcatagccatacttttcctgcttcttttcaaaagctaagtctaggttaataggtcctttttggaaattaagaaatgttttgaaattgttgtttttatattttgctgctaattctaatggatgatatgataatcttgcagaagctttgtatgattctttatttgtgattttgtttggcaaaaatgaaaatccaatattaaatattggatatcctaaaacaagacctgtgcgaattaagctgctttttccagctcctttcttgatgcacaatgaaagagtgctattaatgaattgcgtttgcatgtaaagggatgtatcgaaattgacttcttgaattttggaatcaaatgataggttaaggtcagtgttaactttcattttttcttgttgaagtactttgaaaaatcttgaataatcaattttaaaatgacaatcattaattggataaatttttacgtttatcggtaaattaataagttttggtttaaactctaatgtatagtcattctcatatttgcatattttaatattataatgattatcattgaagccaaagatagcattttcgattggagatttctgattatatccaggagaaatcaatgttaaaaacacttcatcgttagtataatttatctgcataacatttctattatttgtaatttcttttgatactttttgaggacacaaatcattaaatctgatcattgcaaaggaataaaattacccatttgaagggtaatttgaattgagaagctttgttccaatgagacaaaacaaacattttttattaacacatttctatgttgttttagggagtattgcaccaaatattatccaacttgcataaagatcttcagcataagggaatgtagcaattgatacaacaaacatttcagcatttggtgatgtcattaaatcatcagatttagcttgtaatgccataaaaatagattttgcatctttagcatgcacacagattggtattgctttaattgatgtatttttaggcaataatcgtctaattgcatcatttgcatgaggtgcccacatatcacaagattcattaagttttgatgattcataagaatacaaaagaggtctcatagcaaaagcaatttgattattaaaaatagtcttttttgtatgtcttaatgcagatatcattcttttgacttcattttcaatttcttcttcgtcaatttgttcacaaggacaaagtgatggaatagaaattggtgaaggaacatcatatcttttccaaattcttgggtcattaacatcggcagatggacattcaacaagtgcctcaagtttacatttatatccataaagtatagtcgtatgtaatatttctgcaattgttctttcacatgtgaatggatcccataaccaattttgtttctcatgaattgttaatactttattcgcacaaacataagactcaaatccaaatccacaaaataacgaacataataatgcacaaatgtcacctctactaccacatcgagaacttaataacgagtggatggtgaacccacgagtgaaaaccgtttcatcgttatcgtcttcttcttctgcgataacgtttccagttgcagaaaatgttctcttgctaacagaaaataaacctgcaaatcgatttgcgtgaaatggagtcggaattaattttgatgaaagtctacaaatatgtgatcctcttctcccttcgtttttaagaatattttgaagatcattaggtgatatagatattggatcaaattcaagcttaatatgtacaattccattatcatcacctgtttgagatccgcttagtgttactggtaatcctacatatccactaagtgccattctccattcaaaagttcctgtgccataagaacaacagtttttaccagaaatgagaatagctgtgattgaacctggcccataagaaattaattcatcaattgattgagataaatctattgaaaatgtttcagaaaataatggatctacttctgcattgactttactgcttctaaatcgatgacctgcaatgttaatatcaagctgtaataatgaagaatcagcatccattaattcaataaatgaactagctcttacaattgttatagttaatgtatgtaatgaagatgatgtttgtcgctttttagtgtgttgtttaggaacatctgtaactggaagaggtttgcttacatttgaatttggtgaagtaacaggcactcttttagcaagaaagtcatggacatattttttcatatcaacattgtttgcaaattttcgtatcctagatctatctgtatccgaaatatttacattagggattgacatttggaataaacgtacttcacttatgaacgtttaataatgtgtaaacaatttaatttaagcaacttcacctccaaatgacaacaatcaagttaggtatcttctctgatacacatcttggtaacaatgaaacagatgttattcgtgcaaatgattcttttgaagcatttgaacaatctttaagaatattccatgaaaataatgttgacgcaattcttcatgctggagatttatttgatattccaacaccttcaaagtcatctcttaacaaggcaattgaaatccttcaaaaatatattttcatggatccaattgaagaaagagaaccaatcgaagttgaagaatatcccgaacctggaaaagcattagttcatgaaccaaacacacatgatccaaatatattaattaaaacaccaatttttatgattcatggaaatcatgatcctcctgttggccttggatcattaagtgcctgtgacctattctcatcaattcattacattaattattttagtaagctcataaatccaaatgagattgttcttaatcctgtaatcattcataaagacaatattcgtgtatgtgtctatggatttcataacatttctgaggcatcttttgctgtagcacttaaacaacgccaagtcttttttgttcaaccagatccaattgaaggtgtttatcaatataacattttactccttcatcaaaacttccgaatttatgaacgtaactcatctaaccccttaacaacctcggaatatttgtctaatatatttcgtgcaaatcaaatcaatattaatttagtagtttggggtcacgaacatcaaggcaagatggaaattgaaattaccaatggagtacatatctttcaaccaggttctacagttgcaacagacattggcggtgattttcaatttgaaaaccgcggagttggggtgctccaaatatcgttcgaacaagaaaatttcacttattatcatttagactcccgaccatgtaaatataaagtcctagaactcaaggggaacaaataccgtactgcaaaagatgttgtttccaaaatcaaggaaacaattgaagagatgatagaaatgtcaaaaccaaaaccttatccaattatttatttaaaggtagttagtgaaacctttgatctcagtgatatttcagataagaagattatgggcgaatattcaagtttagtcgcaaatccaatgaaattcctaaaactttctcatcgaaaacgacaaagcaagcgtagccaaaagagggatgatcaagaaaatactgaatcagggccagttcaaattgagacgttaattgaaaatcgatttttagaagatagtttatcatttcttaatgttgccacatttaatgcgtcattaaagtcatttatctacagcaatgaaaagaactcgcaaaagatctttgaagagaatcttaacaagctgaaaaacatccgcgtcgattacctcatcgaaaacgccgctgaatggggcacccaacatgagattgaagcgatcgatgcggtaacagccaaagagtacatcagctcgcaaaagcaaaatttgccggacttaagcatcgacttgtcgagcgcagtggtcactgttagcaatgaagcagaaaatagtggcgaaaaaagcgtcaagaaaagagggagaaggaaaagaaaagatcaagaaaaagaagataacgaaagcgaaaataatgtcctcgaagtggaagagcctgtacatccttcaaggccaagaagaagagcaaataggaatgagaaaccagcttcggaattcataacatcaaaataaatgtgaattttcttttattgtgtaatccctttcaacgtacttgttgcccgttctgttttatttttttaaggaagtatttaatagcgaataatgaccagctggttagctaactacatgtttttgttcgattattttcatgattttaattcgtagcactctttttctcagaaaaaaaatttattctttaatattaaagtgtgtattaattgtaaaaacataccaaattctttatgatagtatgtttcttcaaaagtaataactgaactattttctatataatactatatcgaacacacagggaaatagaaatatccgttatgtttaaaacattatatatagaaaaaacacaagaatttaaatatatatatatatatatatattagtttacacgatttattttatttaaattattaaaaattaaatattaaataaatcttttctaagtatattacattttgatgaatagaaagaaagacaattgtatttttatgagattatttgaactaaatcaaaacctttggttgtattgtagacaaaacctttggataaaatggttcttgattctgaattataattagtgtttgattcagcaattttcacgttcaagaagtaatttaactgtatcaaaattaccttcccatgttgcatatattaaaggtgtttcaaaaaaataaataactttgtgattccataaatatgttttactcttagatgtcaaatggctcttagacaccaaaggcgacgaatcgtatcttcgccgagtcgttaagccattagaatggatgttaataaaatataatgaaggactcatcggtcgatgcagtgtgtcacggcgctaaagttatgattcctggtatacttcgatttgagaacggaatcgaagttgacgaagttgttgtgatcataacgacgaaaggagaagcaatcgcattggggattgcgttaatgacgacagagcaaatgtacaatagtgaccatgggttcgctgcaaagattaagcgagtcatcatggacggaagcatatatccgaagtgttgtggcaagggaaccgttgcgcaggagaagaagaggaggataaaggcatgtcttattactcaacgagaagttgaagccaaacgagaaaattcatgcaaattgggtaatgaattacctcaaagggaaactgaatcaatgattttaataaagaaaatattcaaattgaaaattcgttttagtaattttaaatttaaattttgttgaagttctgattttgataaataaatagaatacaaaataagaattatatccatatcgaacatgtgttcagtgttatgcaattgcatcaaaaatttcttgaaaatttatattttgttgaagttctaattttgatatattagtgcccatattaaacaggttagcagtgatattatgcagctatataaaaaaaacaacatatctcatgataaaaatattattcaaattataaatttaagtttcaccgatttttttttacttaattaagcaaatgtttttatgttaaatatgattaatgaatttttcttctttgaaatcatcagcaaatggatcttcatcaatattattcgttgatgttcccattgcaaatgtattttctttttcattttcattttcttcgaaactttttgcttcttgttcattacttatttgcttcttattatgaattcgcaccaaaactatgataagtattgcaattattacaattacgacaactgcaacgcaaacacttataattattattgtgtttttattatcatctttaatattttcattttgatatataattgtaaagaaattactataatatatgtaataagtcgaatatataacaacagtatattcgtaataaataaatacactcaaaacataagttaatgccgaattaaaaatagaaacagaaaatgaattcgaataagttgatttataaatacttattgtttgcgtaatagataatgattgtgttaatgttattgtattcgttaatgttataccatttgaatatgaaaaagtaaatgaattcgaaacaacaaatgaaatttcatatgaattagtaaatgcattagatttcgttaatgtattcgatttagtatatgtatttgtcataggaaatgtatttgttaataaggcgcattcatttattattgttcctttggccacatttaatccgccaaatgttgatccattatatgaatttgttgtcatgacaatttctgctgctacatttataaatatatttgatgaatttgtaggatctgtttcgccaaagtaatagatgcatttgagtttatcgcatgatgaaaatgcatttacttcaattgaagtaacattttcgccaatataaatcgtttctaaattaatacatgaagcaaatgaataacttccaatttcttttactgaaaatggaacttcaaacttaacatttaaatttcctgatggataaatattgattctattgatttctttatcatataaaattccatcactttgataattagcaaaatataaattttcattcgaaacattaatgaatttaagttttgtacatgaactaaatgcattaatttcaattacacttacattttctccaatagaaatcgtttctatactcgtacagaatgcaaaaacataattccctattgttgctactttattaggaattgtaatatttattaatgatatgcaatatgaaaatgcagaaattccaattctttcaacattttctccaataaaaaatattttcaaattggaacatgaataaaatgcagaatttccaatttctgttactttgtttggaattgtaatatttactaatgatctgcaatatgaaaatgcagaaactccaattctttcaacattttctccaataaaaactattctcaaattagaacatgatgaaaatgcagaatttccaatttctgttactttgtttggaattgtaatatttactaatgatatgcaatatgaaaatgcagaatttccaattgttgttacattttctccaataaaaactatttttaaattagaacatgatgaaaatgcagaatttccaattaaaatgattgattcattcattttgatactttccaaattattccactcagaaaaacaattatctccaattccagtgatggaacctccaataataagatgaattatttcatttttatacagcattctatcttcataatctgttgaattggaaatagtaagtgttttagttgaattatcaaaagttgagaaacattttgtgaaaaatgtaaaaagaaaaatcaaacaaaaattttcaattcgatatattttatggtatttatttagtaaaaaaaatttaattgaacaaaaattatataaaagcaaaaagataaaagataaaatcaaataaatgacattgattttaaagatacaaaaattgttttctttgaaaataatattaaaaataaaatcaaatatttgagatttgaaaattttatgatttgataaatgagaatgaaaaggtaatgaatgggcatatgcttggttgaaataaaaagaacaatttgttaaaaaaattaaagggaaatataatttgttatgaaaatttaaagattgatgataatcataaatcaaactgttgagttttttagaagtattaatatgattaaatgacaaaagcatgttcctaagaggcggcaagatctgcctttttttgatttggtgtagttgatattgaaaatttaaatgataattacaaataatattgaaaatagttttacttaaagtgataacaaagaagaaaatatggggaagcgatatctttgtagcaagatatgatgttttattcgtgtgtttcaaaatgttcgttctggtttgaaatgacataaagagttgcggtcgacagtttcaggtttcttggttacagtaactgaaattgacaatttgcaggttctaaatatgtaaattttttttagatatcgaaatataataatgaataaaaaattttgcctttgtttgctgctttgctattcagaacgtgcatttgtttagaagatatttttgttttaggtgcggaatatttgaatacaaaacaacgactgaacccatcctaaaaaactaaggaattgatagaattcttttagtttacatatataaacattttaatattcactttttgataaatttgtcacttttgtttaataaaacggttatgatccactttgtgcacgaccgtttagcaaagattgaatttccgccattcgtttcatcgattcatattttttttgatgtctacgggaaatttaacagacccaacattaagtgcaaaagataaaattcatctattacataaatacaattcgaatttgagtttaacttcacgattttgaacatagtttataattcaaagcaagattggaaaaggaatggatgaaactgttttctcagttattaacaattcttctgggaaaagttatgctatggtataaaacgcattaaaaatatttcttttgataatatttttaatgaaatcttgattttatcacaaatttcgcatctcaatgttatcgaatgttttgacatatgatttgagcataatccacaaaaagacaacattcaaatgtaattatgatcaaacttaaatatcactgaatcgtgtgaaaaagatttattttatggcaaacttcaaaaatgtatttatatttctaagtgccttaaatatctccacgataacaacatcactcattgtgacttaaagccctccaatattgttactggaaatggtggtcttccaaagatcattgattttggcatttcaacatttaatatgttcataaatgacgatgtcataaaaagttcgactccactttaagcttctccggaacatgaaaaaaggaaaagctgagtcccaaatttgatattaatagccttggaatcattttctcgaagtttttgggtcatttaacactcaaaagtcgaaaatgaaaactataaaacaacttaaggacaacgacgtagcaaacataaatactgacgaaaaattaaaatcacttatcagcaaaatgactgataaggattcaagcaaaagaccaaatgctgatgaagttatcagtgcacttgagtctttgctttaaaataaataaattaatatgaaaaaaacataaaaaccaattaattaatgtattggtaaaaaatgactattaggaaaatattcctaaagatataaaaaccaatttttatattggatatgtttttttaatacaaaacttttttttttaaattattttttatttcgaaatgaaattgtgtaaatgtgttagaaattcttttgattttctggatgaagaattgataaagagagcggatatatgataaacttcttaacatattattcatttctcagattgtcatgcatcaccagcttttacatgtattgaatcaataaatgttatgtcattatactattataacgatataacatttggtccttttaatgttacaaaagaaacaactgttgaagtatgtattacttggtcaactcaaactttcacataatcaaatttattttaattcaaatattttttcagatcaaatgcattcacacaagaatacatttacgaaatataattcatttactctgtccaacatattcataaaatcaaatacatttacaacatcattgcaagtaggtcaatatattttaataacatacacattaatatatttaattaatatattaacattacatgcccaatcactaagtttttataattttacttatttatatttactttcatttgcaaatgaatatatatatatatatttatattttgttcattagaattatacaatgcccaacgattttcagctattacaataatttaaattgttttgatattcccctgagttataagcaataaaaatagtaatgcaactagtttaagagtgagaaataattcggtgacatcaagttcaaaacatatgaaagaaatcaacgaaaatattcaagaaatgactaaagaagttaaatgttaattataaacatacaaattacataaaaacgaaaattatttcatgaattcatttattaatgtttaacatttatcaaagtactttctatttaaagaaattacacattattattatttttatatccattggtcctgatcttccaacacgagttcattatattcctgatttacttcatctgatctcatatcgcttccagttgaatttttagtttcgaattttattgctgttacttttctttgatttcttcacaaggaatatgataattcccacaatcagcaaaactgcaattattgtgccgcagataatacaacaatactacagtcagtgattattttcgattattgttgagatgatcactgacttcttccaaacgctttgatcacttaatacgaatctacgaaatgatacgtgatcagtcatcaaaaaaaataatattcgatatattaatgaacattgttgtgggaatagtttataaggctctaatacattcgatgcgatttcttttaagtccaaaaatgattgcttaaggatttcagtgtttgataagaagttaatacttttcgacattacgattttgaagcaatagtttaagtcattacgtattaaatatcgtgcaacattcgataacatataaccttgtacattctcacgcattttcttcacagtagataatgatgatgtaatacgttgataatgtattcgtaatgctgattaatgatttcatatatcttcggaaataatgatgagattgatttagtgttattaatcgtataataaaataatgcatccgattgtgttaaaaatttctcggagacaaaataccgagcaacaattcgcattttctcaaagaactctttcgcattcttcggcttaaatgatgatatacttactgcaaatgatgggaaattagcaatgatgtcacagaagtaattctcgaatggaaagttaagtaaattcgttgtgctaacttcttcatcaaatgagaaaagtgatttagttcggactgatttagctgcaattgttacttctttttgtcgtaacaatacaattttaaaatgttcattaatatattcgttcttgatgaaattataaggtgttttttctgacagactttacgaaaagtgcctttggttctctcaaaaaagtggcatataaacatttgattgttaattatttatatggagaaattgcttcaacttgagcaattaatacttaatctaagtgaggataatttaagttcaacagtacaacaaacaacgcaattattcgaatcaaacatcccatattcatttaatttgcttgtaagcaatttgctttattttgtgtttttctcaagaaagaaagagatagacatatatttagagttatttaaaaaaattcaaatgcaagaaaaagaaataaacaaaagcagtcctgaaattactgaaatttttattgaaaatatttctggtattcgaagttgtgaagcttattacttaatagaacaaatgattaaaaggaattatgttgataaaagtattactgaaagcattcaatcaaaatattttgctcattataaaacagaaaaagaaaacaaaaaaagctataatgatttattcgaagattatttcttcgataattatgataaactttcacaaaatgattttaagcttcataagaaattcattgaagaaggacataatccaaatgaaattgcaaaaataatacgagatgatgaaatcgaaaaacttcaagaaatatcatcacaaagtaattttgattttaatcaaacaattgcaccatcactttatgaaagatgttcatttattaatcaaaacaatgttacattaatttattatgcagcattttttggatcagttaaatgtttcaaatatttacttttgaatggtgctaaagtaaataacacaggtaaatatgcaattgcaggtggaaatgaagaaatcattcatttatgtgaacaaaatcattcatcttttaaagatgcatatgaagcagcaattgaatttcatcgaaatgatatctttaaatatatttatgaaaacaaacttgaaaaaacttataatttagaagaattaggggagaaatgtattatatattataattttgatgttttttcatttttaatagatgaaggaatgaaaattaatgatgatattattaatgcttcagtaagaacaggcaacatattcattgtgaagtatttgcaccaaaataatcgattttcaaaagatattttaaaatattctgtagattcaaaaaataatgaacttattaaatatattttagaacaaggaattgatattaatatcaaaaatgttcaaatgtattgtttaatatttatttaaataattttctattttaaaataatatttggaaattattcatattatataaaacagcacttatttatgcatctgaaaaaaattatactaaaacagttaaatttcttcttgaacaagaaggaattgatgttaatatcaaagatgttcaaatgtattgtttaatatttatttaaataattttctattttaaaataatatttgaaaattattcaaattatataaaacagcacttatgaaagcaactgatgaaagtaaagcagaaatagttaaattacttcttgaacatgaagaaattgatatcaatgttaaaaatattaaattgttttatgtaaaatttaattaaatcattttgggatccaaaataatatttgaaaattatcttcatcatttaaaacaccacttgctattgcatcttggaataataatccaataatagttaaactacttcttgaacataaaggaattgatcttaatgctaaaaatgtttatatactttgtttattatttattcaaatcgttatgggattcataataaaattcggaaattcttcaaaatatttaatacagcacttatgaatgcatcacaatgcaattacatagatatagctcaattacttattgaaaaagaaggaatcgatattaatgctaagaatatttatatgtttaatttaatatttatatttaaagttttatatttcataataatattcggaaattatttaaattatatcagacagcacttatgtatgcatctgaaaatggttatgtagaaatagttaaattacttcttgaacaaaaaggaattgatattaatgctaaaaatatttatatgttttatttaatatttattttgataacttaatatttcaaaataatatttggaaattatttaaaatatttgatacagctcttattattgcatccagttttggtaaaattgaaatagttaaattacttcttgaacaagaaggaattgatattaatgttaatgatgatatttatttagatattttaatattttaaaatcatgtttggaaattatttatattatttaatacaggacttaaatatgcatcttccaatggatacaaagaaatagttaaattacttcgtaaacatgaaaaaattgataataatgacaaatgtgtttctttttttatgtataatatttatatttttaatttaatatttcaaaatcatatttagaatttattaatattaatttaaaatatataaaatgactaaaataataaataaaaaaagacccaagcgtttatcatcatgaaagataaaagattactacaataagattactttaaattcatgaattccaattttttctattcgttaccgcgttacgtacaaaattcttatgcacataattaaaaaaaaaattaatagatagtgactagggttggccattgatattctaactgtcgatactgatgaatatcgatataatatcattgtggtaaattaaattcagtagcatataaaatatattttagtagcttaaataaaatatgatataaaatatgttatgcataatcacaatagtcttaacacttttttctatcctaagatcagtaatatcatcaaagaaatttatccatggaacaaattttatgttttcaaaatcacgtatttttttaatgtccatttaagaatctgttgtttctatttgttataacaatgacttataattaggtcagtacagtatttttatactcatagtattaatatcagaaattgggaaaacataatctaattcatcatcattctaaatataatgactcattaattttccccaagaacaatccttctagatattaagcgctggcgaatgcaaaccaattttcagcaagatgaacccaattacatccatgtcgacttgtagatactccaaccacagaaaaaccttcaacacatgcggaattgaagaaaagagttgatataacagaataaacttggcaaacagtttaatgttcaaatattgaagtatttactgaatttccgttttgaggcatactcactgttattattaatcctccgccaaataacctgcgcgtagatcattatcagcacgacaccctataaaattataagttgcatatcaacttcttgcagagaaagacattcttgttcttgctattcaagaaagtagttcaagcttaattgtgatgcaatatttatattgattgataggataaccatcaacactgaccatcaacactgagccatcattagatatgtttaaatggttagaataaagtcattttgctttaaatgttcgagtgaatcttgatatgcttgttctaaatatagccagaattctccggctacactaaaatttacatcttgaagatttgtcattttaaattgttcttcaggagtcagagtgatcttttttactctcaatgaagccatgtttcttatgagaaatcctagaatctatcatgcgtatagtttagaatgagaaggttatgaattttttcgcggcctaagatgtctattgaccataaatcttcagatatacatctgcgaaataacatttataacagcttgagcgtgtgtggtaaaattatagatgagaatgttatcattagaatctttgtaaccatggtcgtatagcaaaaaccaaaatgatataaaatttgaacacttggttgaatatgtaaagacatttttttcaggttatgagatatggtttggaatggggttggttggtgtttttgcaaaaattcttacaaacaaattttgttgaaatgataaaaatttgtcgatcaagtaggatggctggagcacgttaaaatatcactttttgtgagtttttggattggtcccaacactcaatctcccacatcaccaccactcatgagataaaaacaaaacaaacgtcttcatctttatacgaaagaaaaaaatccaaaactattaattcaataaaaaatttcatttataattttgatatcatagccataatgattatgttgttctggagggacaaaacaaattgtccggccatttataaaaaagtgataaaccaaaaataaattccttgctttcaataccttatccaagagtaaaacttataaccttcaacactataatggatttaatatatttatttaaaaaaaattaaaaataattttcatttttcatctttcttttttttcattttttaagggacaattttgtctagatataaaattaattcaaaatttgaacaacaaaaccgttttgacaatttaacctcacttcattatcatgacaatccttgataaaggttgggaaagaacacaaatcaaagttttctccagatggtgtgctaagcaccttcgtacacgtggtatcaagttcgaagatgtcacaacagaattcgaagatggcgttaagctcatccaacttctcgaaatcattggtaaggaaccagtaaaaggaaagtggcacagagaatgcaagaacaagtaccacaagatcgaaaacgtcaacatggctattcaatacatcaaagataagggcatcaagctcacaaacatccaagccgatgatattgtcgacaagaaccttaagcttacattaggtcttacatggtcctgcatcaacaagttccaaatcgaagatatctctgttgaagaagcaacagcacgtgatgcccttcttatctggtgtaagaagaacacccaaggctatgatggtgttaacatcactaacttcaccacatcatggtcctcaggtcttgctttctgcgcattaatcaaccacttccgtccagaacttcttgactacaactcactcgacaaagaaaaccatgctgataactgcaagaaagcattcgaagcctgcgagaaactcggtatcacagtcttccttgatgttgaagatcttgttgacacaacaccagatgacaaatctgttgttacacaagtttccgaattcttccacttctttgcttccgaaactaaggttcttgccttagctgagaaggccaagaagattgttggaatccaaaagcaaatcgacgaacttaagaacaactatgctgaacaagcaaaggctttcatggatgctcttaacgaagctaagaacaacttattagctgatgattatgaacaaacagttccaagcgttaaagacaagctcgtcaaagttgttaagttcggtcgcgatgaacgtccaaagcttgttgaacttcgtggtacagccatcagaacatggacacaattagtatcaaactgcaattcacacaaccgtcaaatcccaacaccaccagaaggcctcgaaccagaaacactcaccaaggccctcgaagaaaccgaacaaatccaaggcaacagaagcaccgaacttaaggaaattcttcataaccttcaaaagtcaaagattgatgacttcaatgagaagtgcgatgcaattgccaacaagtgcaatgaaatccgtgagaagtccgaacaagaagatatccttaatgatcttcttgaagaagctaaaggactttcagcatcagaacttcaagcaccatatgatgaacttgttcaactccaattaaacacacgtgccaagtacacagtttactccatccaaagcgaaatcgatcaactcgtttcactcttaacacgtctcattgaccaaaagagagcacgtgatatcgaaaaggagaacaaggcaaagatcgatgcatacaatgaaaaggcacaagtatatgtccaagagtcacaagaccttaaggcatcactcgaaatcgaaggcgaacttgaacaacgccgtgaacacttcatcaacaagatcaaggaaatcaccgaaaagagagaaggtgttaacagccttaacgaagattaccataagcttgaacaagaaagtcttcaccttgaaatcgaaaacacaccacaagttatctcatcaatgtacgcaggtgttcttgcacaagctacaaactcattgaatgagatctacaacacaatggttcaaaactatgatgctaaagcagcagaattcatcgaacgcatcaagccaatcgaaacatctgctaaagaactcgaaggttcacttgaagataagaagcaaaagcttgaagaacttcttggccaagcacaagcaatcccaccagaactcgaacaacttgatgcaccattcgaagaacttacacaatacaaactcaactacaaggctaaggcatcaccaactgatgtccgcgcttcagcagatgcacttgttgctacaatcaatcacttgatccaacacaacgaaggtgaaatcattgaaacaagaaacagctcaaagatctcagaatacaacgagaaggctaatgccattctcgaatcagctaaagcacttgaagcatcactcgatggacttccagaatctaacgaagagaagttaacagcactcttcgagaagcaaaaggaagttgaagccgaaaaggacaaaatcgaagaaatccttccattatacgaagaacttgaaaaggattcactcgaaattgaagtcgagaactcaccatcagccatctcacaattcttcggcaacacattatcacacattaagacattaatccaagaagcagacaaggcaattgcagctgctaaaggtctcgaaatctctgaagaacaacttaacgaattccgtgaaacattcgaccacttcgacaaggacaagagcaagacgctcgagccatacgaacttaacgcgtgccttacatcactcggtgagacttctactgaagatgaatgcaaggaaatcatcaagaagtacaccggcggacaagagaaactcgacttcgataactacgtcaagtacatgctcgacagattctctaaggcagaatcagcagacgccactaaggaggcattcagagctatcgcacagaatagcccaataatcaacgacgaacaattagcaagatacttcagcccagaagacgctgaataccttaaatctgttatgacaccagtagaaggaggttatgacttccaacaatgggttgactcaatctaccaataaactgatcacattcattcaatcgtttgatttgttttttttctcttcaaagtacttaaatcgtcgtattcagaatttgctgaactttctcagagtactctaagaagagtataaatttgatctttagtgtaagtgaaggatatcattttcgatatgagtactgttttaataaatttattctgttactttatgcatatgtaatataaaataaatttcgttatcaaaatgcaatttttgtgccatttccagtttaaacatgatttgatatttaatatattaagatatatcaaaatattattttcaattctttgaattttttggaacagcattaatgtttgtaatagaaaatagtaagaatgaattagttaaattactacttaaacaaaaaggaattgatattaatgctaaagatattattttgttatattttatatttcaaaataatatttggaaattatttaaattatttgatacagcacttatgatagcatctcaatgtggtcatatagaaatagttaaattacttcttgaacaagaaggaattgatattaatgttaaggatatttatttgttttatttgaaatttattttaataattttaaatttttaaataatatttgggaattatttaaattatttaatactacacttatgtatgcatctgaaagaggttatacagaaatagttaaattacttcttgaacaagaaggaattgatgttaatgctaaaaatatttatttgttttatttaatatttattttgataattttatatttttacataatatttggaaattatttaaattatttgaaacagcacttatatatgcatctgaatatggttacataaaaagagtaaaattaattctttcattgcgacctgaaatcaaaaaaacggcaacacattttttaaaaagtgactacacaaaaactctatcggagcggttattatcatattcacaaaaagttgttatcatataaagtcacttttttcattcttcgtttaaaacatactataattaatgtttcgttttatttttgaaagctctttccaccgcatgagtagaaatattatttctatttttaaaaatttgtagtaaaaatgaaaataaatgaagataagttcttcatttgaaggaccacggtatttcactaagtttgttgtcatatttgagagatatcgttgcacatttgaatgatatacaatttaattgactaagttggttgccatatttcagtaaatgatgatctgcttcattcaaatataatgacagacttagtcaaataccgaacgatcagatatcttggaaattgtttggtttattttttaaaaattagcacttttgtatttgtgatttaacattttgcaaaaaaaaaataaaagtatagttaaattaattagaaaaacttttgttaaagttattatttaatggctattaatatcaaatcatcgaaggaaatttatggcttcttcttcattgttactacttatcattaaaacttgctatctcaaaaaaatttaatcttccactaaattctttcagaatttttgaactaatttttatcttttctttttgttttatagttaaattattttaattagttttatctttttcttatagaaaaagacctgcttcatgaatattagattttgagaattttcatacacttaaacatttttcattcgtgaaatttaaaatgtttatctttatttcttgaatttgttttttctgtctctcaattttctgaggccatctcaagttgacgatatacgatatgactttttgagcaatggcctagcttgtaactttttaataattttacataattgtaaaattaatataaacggttatatctaatacttaatttcacaacactgccaaaaatcacattttttccattaaatgtccatcgtattctatcgtaaataacgtattttttcagggatattgttcagtctacttataaatgaatatacttttattaaaataacaacacaaataaaaccaacaggtaaacaataacacaaaaatgaatatattcaatgattatctattatactaatgacaaaatcaaaaaaaaattgcaactaaagatttttttgagagttgttatcattgactctaaatcaatttacttgattattaataaagtttgaaactactttattcaatttttttaaatctatttaaacggagtgtttaatttacattatggtttatgcttcttaacactcatttcaaaaatagttttacagtaaataaacattttaaatttattttcatttttatttatagcattaattttttgtttatattgaactcattaattttcttcatcatttataaattgatttattactttcgctttactttttaaatttgaatatgttattttaccattggcacttattatttttttttattgattgttaattagttccatgttaattaagtgtaagtgtgaaagttatagtctgtgatgtaaataagccatatgttctttgatatttatacctcattctaaatcgcattgaatgtattaaagatatttgatcatatccatttaatatcattacaaaaattttaaagttatttttaagacaatgtaatgcattaatggtatgtatcatcgttatattttatttcataagattcatataatatttataattatcagtacaaaatttacaaatatctaatatttataattatatttgttcaataaatttttcttcttgaaaatcttcagcaaatggatcttcttcaatatttatgttacttattccagtagtaaatgtattcgtcgtttcgttttcattttgttctgatttatcattttcataaatttcttcttttttatttcgaatatgtgtcaataatataattaataatatgataatgactattactataactattacacaaacagaaatgatgataatcgttgttttattatcgttattttgattatcattattatctatgtgaaacattgtaaagaaattggaataataattataataagtcgaataaataacaatcgtataattgtaataaataaattctgtttcaatatatgaaaatgtcgaattatttatatataatgaaaatgttttcatttgtgtttcataaatagttaatgaatgtgtaatcgataatgtaactgttaatgtatatgaaaatgataatgaaatatcactttgaagtgatgcagtaaatgtatttgaatgagaaaatgtattcgattgaataaatgagtataattctgataatgttattgaatctgaatgtgcatatgtatttgtttgaataaatgtattcgactgactaaatgaatgcgttggaagtggttcgcatgttccttctgtgttgtctttgtcaacatttaaatttccaaatttacttccaacgtatgttggatatgtgataatacttgtaaaaacattagaaaatgcaccttcaccaatttctggttctgaatatccataataataaatacattcaagtgcataacaattaccaaatgccgaaccttcaatattttttattccatagccaagtgttaatatccttaaattagaacataatgcaaatgcataactgccaattgttgtaactgaatttggaattgtaatgtttttgatcgatgaacacattgaaaatgatgaatcaccaattgttgtaacattttctccaattataatcgtaactaaattagaacatgaagaaaatgcagaacttccaatagatgatactgaattaccaaaattaactgaaacaactgaagaccattctgaaaatgaaccacttggaattttatatatattttcactgatgattatatatttcgtaatatttttatattgagaaatttcattaaattcatttgaatttatgattgtaagtgttaaattatcttcattatatatttgataagtactcatgaaaaacataacaaaaattaaaatattttcagtttttttcttttcgtttgctttcaatgtatatttggtcgttaatattttctgaactgaaattgtgtttttctgataaaatttgatatgaataaccgaaaatgtaattgaaaaaatgatggttaaatgaagtaaaatattcaaaatgtttggtccttcttcgttgtcgtttcgcatcatcaaaaaatgtgaaatttcacgttttataggatatacatcttcataagatttgttatatgttttatcaaatataccatttttgacaaatatatcaatttcaaaggatttttccaaaatgtatgaaaaatatgctcttggaatttttcgtttgttattaaaattctgatgtacaactattgtagattcattatatggtatcaaatttaaaaataatttgtttatcaaaactttataattattgttaaatcttttaaattttttgttcataatttcattaactgatacatccccatcacatttgtaagtcatacttttcatgttttcgtggttttgtatttgtaatatttctttttgaatgatataaggtgtaataagctttgtatcggttataaatcgtttcaccatgatggaaatgctgaataaaagaaaggttctcatgtttcagcttggaatatatctatagaccttcaccaattatacatcggctatctcaaaagtttaaaatctcacggttaaacttttaaaaacctgttgttttattgtcgttttttaaaccgattttgaaatatttgtatcgatttttaaaaacgacaatcaaagaaacagccttaaaacattatattttcacttttaaataactcaatgaatatatgttatagaactaaatttatgctttaatttggtgtgccgttcatttatcaaagatgttttcatcattataaaatttattttttttaaacgttggcaattctgttatttcttgcttttaaagtttattataatatatataataaacaaaatatatagagctctttatgtacaaaatcaattacattgtatctttaatttaaaagatattttttgattttgagaataatgaattcaagtaaagtttatcccatttcattcaaaaactaacatttaatgtatttacaatcagaattcgaaattattgatcgttgtgcaacaatatttacattattatatttaaagtcagtgatactatttaaacatcataaaattcaaaatttcatatttaaaaaaactaattcaaaacattttaaagtaaaaatgatatttcgttaatatgatttcattttattttatatgacaacacataatttttatataaaaattaaatcaaaaaattttcattattacacattttattcatagccaattgtcttcatcttctttcacaatatcttcaaccaaactatttacttcttcgatttgctttgtacttgatgtcgtcgtgtccttaaattgtaactttgatttcgatttttctttcttattattacttttcactaaaaatataacaattccaacaatgatcaaaacaaatgcaaatgatccgcaaataataccaatcaaagcatttgtcgtaattccttttggcgaattttcattggaagtgtaaaacattgtaaagaaattggaataataattataataagtcgaataaataacaattgtgtaattgtaataaataaattctgtttcaatatatgaaaatgtcgaattatttatatataatgaaaatgttttcgtttgtgtttcataaatagttaatgaatgtgtaatcgataatgtaattgttaatgtatatgaaaatgataatgaaatatcactttgaagtgatgaagtaaatgtattcgactgactaaatgaatgcgttggaagtggttcgcatgttccttctgtgttgtctttgtcaacatttaaatttccaaatttacttcctacgtatgttggatatgtgataatacttgtaaaaacattagaaaatgcaccttcaccaatttctggttctgaatatccataataataaatacattcaagtgcataacaattaccaaatgccgaaccttcaatatttcttattccatagccaagtgttaatatccttaaattagaacataatgcaaatgcataactgccaattgttgtaactgaatttggaattgtaatgtttttgatcgatgaacacattgaaaatgatgaaccaccaattgttgtaacattttctccaattataatcgtaactaaattagaacatgaagaaaatgcagaacttccaatagatgatactgaattaccaaaattaactgaaacaactgaagaccattctgaaaatgaaccacttggaattttatatatattttcactgatgattatatatttcgtaatatttttatattgagaaatttcattaaattcatttgaatttatgattgtaagtgttaaattatcttcattatatatttgataagaattcatgaaaaacataacgaaaattaaaatattttcagtttttttcttttcgtttgctttcaatttattcattaaaaatttgatttcataaaataaaaaaaatcccaaaacaaaaaagttatacattagaacttgagcattttcattgaatttgtacattttcttcaagaaatttttattcattgaaattagtaaatgagcttttaatgaaaaatgattaaatgtaaaagaaaagaatttgaaataatgtttaacatatgacatcggtaactttaataaagagaaatgatacttgtattcttctgtgataacattaaatgtattcgattcattcgcttttagcataataaaatttgtgactttaatggatatgcactccttgttatgggatgagaatggtaaatatgtatgccctttggattctaaagtgaaataagtggaatgtttgagagtttgagaaatagataattgatcactaaaaatctttgaacctgaattttttggagagatttgtaatgagcaaaagaaacacatgggtaaaaacagaaagaaagaacacatttgcgagaaaacttgagaaacttgctaataaatcagtcaaaaacgatacagagagtttcaaccgcgccgcgttttcgtcggttcattggtttaacttttgttgatggatgttttgttgtttttgcgatcggaagctgtttacaaagctgaaaacgtaatgtttttattgaaaagtgacagaaagttccctcatttcaattgccaaaacaacaacaaaaatgaatgaaagaaagtgatatcgttcgacatcaacgaatacatgaaagaaaaaagctcaaaaagtttgcttcacgacacaattaacaatgttaatgttcaattgaaaattttggggagcactcctctaaacggccgcgtttttgtttgccaactggattaatcttgcatgaactaataatttgctatcatttttgtactgaatcaaccaagaaatacatataatcataaattcattaccgctaacaatttcacaattacaattgaatatttagaatcggaattatacaagaataagcttcgcgttgttcgatgagcaaagcaaacaaaaagaaattttaaaaaagaactcattgagaataaataaaattattaaaacgttaaaagaatacaaaaatattgtgtgctagtaaataagtttattcgggaattataaataagcatatggtttgatagaatgcgatgtgtttttaatattcaataataaaagaaagattctcatgtttcatgagttttctctttgttaagtagttttagcctacgttaagtaaaacatatggttttccatttaatccgaattacgtcaaatgtgtaataaatttttcttttttaagatttggtgatttgttataaatatttagatgaaaatgtttcgtttccatcaaaaataataataacaaatgtataatcgattagcacaattaaagctgtgctcttcgaatataacaattccgaaaactattggaatgataacaaaatgtgtaaacgttcacaaaaacgaacgttttttcgaaacggtttttgattctccggccactttaggttcgaaatgccaacaaagcagacattccaaggattctttaaagacggaactcgttacttcaacggtacagacgaagttcttcttcgtaacattgatgccgttgtcgatctcagtgaattaacacgaacatcacttggtccaaatggtatgaaaaagatcattaagaaccactttggcaagttatacgtcactggtgatgcagctacaattcttaaagaagccgaaattcaacatccagctgcaaaaatgttagtttcagcatcacaaatgcaagccgaacaaatcggtgacggaacaaatcttgttcttgtgttcgcaggtgaatgtctttcacgtgcagccgaacttgttcgtgctggaattaataccaaagatattgtagctggttatcaagcagctttagctaaagcgcttgagattttaccaacacttacactcaataagacagtcgatctaatgaatcaagacaatgtagcagaggcattaaagacatctctttcatcacaccaatttctcgacgcagatcatctttccaaactcgtcgcagcagcatgtatcaatgctaatcaacgcgcaggtgttaaattctcagttgataatgtccgtgttgcaaaggcactcggtggatcagtcaatgactcatattttgttaaaggatttgtcgtccaaagagaagtaatgggaacaattcgtcgtatggagaattgtaacattgcagtatattcgacatcatttgatttaccagaatcagacactaagatgcaaaccatctttacaaatggtgaagaaatgaccaaatttaacttatcaaaggaacaacgaatgaatgaaatagtttcatcaatcgcagaaaaaggtattaacgttgttgtttgtcaatcaaagattaccgaattagcaatgcattatttggaacaacataaaataatggcattacaattaccatcgaattgggatatccgaagattatgtagagctgttagagctatcccattattacgtattgcaccaccaacagaagatgaaattggtcattgtccacttgtggaagttactgaagtcggatcaacgccattagtttcattcattgctgatggaggtgtttctactatagtaattagaggtgcgacaccgaatgttatggaagatgtcgaaagatctattgaagacgctgttaatagttatttggtaatgacagaatacccacaattagttgcaggcgctggtgcgtgtgaaatggaattatcgacacaaatcgcgaaatgggctgaaaatagacctggaatggatcaatatggcgcaaggaaattcgcagaagctttggaaattgtaccgaaaacgatcgcagaaaattcgggattaaagatatcagagtttatggctaagctgagagctgcacataataagggcgagaagaacgctggcgtggatgttgttgaattaaaggttgaagatgcagagaaaatgggtgtatatgatatcgctcatgtgaaagaatgggcaatgaaattcgctatagaagtggtggttacaatattacgcgttgaccaaatttgtatggctaagcctgcaagtggacctgcaccaagatcaccagaagcaagagacattgactaaacaatttgaaaatcatttattttattaatttggacatcaaatttgatgctaaaatctttgatgttttaaatgttttacattttgttgaacaagaacttcaacaattgctcaaatgatgtattcattatttggagaacagtgctttggtttaattttgatatcgtttgtacacggatttacaatgaattgtttttatttttttgttggaattattgtttgtgttttcattatgggtaggtcaatgagattaacatatgtaattttaatgcaaagtgattattttaagataattttactgatcagtaaaacaaacactaatatttttaatggaatcatttgtaaatacattgtatgattttttaaattattatatatcgtatacatagttttaatcaaattttgaaaattcttctgtaaaatatgtattgatacatattaacacatatatcaacattattgatatatcctcaatatgtgaaaaaaaaaacttcgcacttcgtataataaaaaactatggtgatctgatgttatttaaaagtattaagtgttcagcaaagataactcaatattttagaattaagatcaattttttgtttaaataatttaacaattttgtcataaccatttcttgatgcatacattcgtgctgcaaaaaatattttaatttttatatattgttttgaaatgttaaactattgatttaaatataaataaatttgcttaaattaaaataatggaaaaaatcattattattaggattcattgttggtttgatagattcaacaatattatctttatttaagttaaaaattattttttcaagtggttctaatacatttgaccattcgggtaaattcgaatctttttagaataaactatgcaaaaaaagaaattgaatatccacataagcgttttacgactttttaataatgcttgctgaataatttgaatatgaaaagctttggtcgaacaaatgggaaaaataacaaggaaaggcacaaaaggaagaaaggcaaatctcgtccgccaagataaaattgaagaaagagtttcacttccaaatagaatcgaatttaggagacttgctattcttcatggcgtatatccaaaagaaataccaaaagaaacaaattcacctttcgctgctttccataaaaaagatctcacaatgattaataatagtccaatggcttggtacattcgtgaacatacagcttgggtaaataaattccaaaagaaactcaaccgcaaagaattatttaaagctccagagccaaaagcgccatatgcagaaatcatcagatcaagatacccaacatttgcagatgcactacatgatcttgatgatgcattgaccacagttgctttatttgctcaattaacaggaactcaattaatcccatccgaaaaaattaatgactgcatcaagttaataacagaattccattattatgttgctcgaaccaattctttaaattatggatttatatctgttcgtggatttcatttcgaagcaacaattgaaggtgagaaaattttatggcttattcctcatgagttccctattccaccagatgccgaagttgattataaggtattattagatttccttgaattgtatgaacaattacttcgttttgttaacataagattatttattcaaattggtatgaaatatccacctatctttgaccaagaaaaatggaatgaaggtctttatttcgatgccatcaaagatacacgtcaacaagaagagccagttattgacgctgctcctgcgccagtcgaagacaatggaacaacagacaaactgaaggaagctcttgcatctgcatctaatcaggttgttgaagaaatccctgaagaaggccaacttttgttttctaagtttgtgttcaccatttcgcatgaggtccctcgtaatgccatctcgtttgtcatagagtcgctcggaggaaggatcatctgggatgaggaaagtgacgacccatcgatcacccacacaattatggaccgccccgaaattgagacccgttatcttaaccgcaaatatgtccaaccgcaatgggtctttgattgcttaaataagaaacagattttggacgttggcttataccaaccaggcgctgaacttccaccacatctttcaccattcgatagagaaaatattgtagttgaaggattagcaaatgatgaaaaagaaatggaagctgatggtgatgaatcaggagatgaaatagatgaagaaatccgtcgtattgcaatggaagctgattacgctgaaggtattgcatcagaattaggaactgaaacaggaatggaaaagccagagttaatgcaactaaaggaagaaatgaagcgtaagaagaaggaagaacaagagagaatggctgctggccaacttcaaggaaggaaaatgtatatttacaaaaaattaaaacatcaagaaagacaaaagttaagagctaaacaaaacgcagataaggaaataaatgaagaagttgcaccagaagcgcttgaagaagaagaaatattcgaagaagaggaagaagaaaaacaagagtaataaatagatattctgaagtttgtgtttatatattcattgaacctttcaagtcctttagtttataatacgtttcgtttaaagatttcattggatatgtctccaatttgtggctgtagtaatcatcggcaatcgttttgaattccactttttgagagttgtcgtctttatcgtccttctcaaaaagttcatttaactttaacacgagtttttctattttggaaagaagctcttgtttctcccccttttgcaaaactgacttcacggctcccatactattgtacatgaagtcaaagtatttggcttcatcaggatatctaactttgaaatcaattggataacaatctccttcattcttgcaccatgtaacagattcaatacaaggagcatcactttgcattttgaagacaccgtatggcttgtctccttccgaaaatgtgatattggagatgttcaccaaatcaatatcttggttgaaagaaacgccaaaaagaacatgtctaggatcagatgtaatacgaactgtattacatccttttgaattttcgacaatttcttctttacaacttaaagtttgaacacataattgatgtgtcttttcacatcttaatgtcatattcttattgaccattttcatcaacatcccacttggaaatggtgaatatcctgatagttgaagtgctgaataaacaccaccataagcaaatgctgtatttgttccgaattcttttttgattggaaccgttaaattctgaacaaccgactttatcgttgccataaccgccggatttgaggaggagccgccggttatttggatttcgtcaattccgccatttttttcaatgatttcaacactagttgagacaaggctagcgagaacgcctaattggtctttaagaagttcgtttttgcttccttttttcaggagtttttgcgctttgtgctcactaatgttgagctgttgcgaaagagcttgacgaaaatgatatccaccaactttagtggtggcgagagaaaacatttcatagcattttgtttgatttccatcccattcaaaaccaattccaaatgctttggatgttgtggaaccaatatctaaaaataagacattgtaaggtttggaagaattcctattgatgatgcgttgggttttagaagctgagtaaccaatactaattgctgttacttcatcaattattgtataaactgggattgaatgaaaattgcatgcatgatgtataagatcacgctgtgtttccgtccagaaatttggaactacaaaagttataggatttgtgatttttgacatttgttttattaataaaaataccaaataagtagaaaatgctggaagtggttccatgatatctgtggttaggaattcagtattattgtttccgattgtcattggaagatatttgtatccaattgatggatttttctttagtgttgagagagctgactttccaattttaacatcaaataaatcagctgtttgattagttaacttggtaattgttgaattctttgctttgaatgaaattgctgatggaattcctttctcaaaaccgggaagaaaagaaggaaccccattaaaatctgatttcgctatttttatgtattcacttcccaggtctatggcaatatattccagattgatcccaagaaggaacaacaaatacatttagtcagggtgaggagcccgccggcaaagtaaaaagtgacaaaatgaggctttttgtggatgcttttggtcagcacgatagaaattgaaaaactgtcatacttggccagacggttatggcggaaatcagaataatattatctaaaagtgtatcattctatggctatagaataattgaagacagaagcatatgaaagagtttataatttatttttagcgatgcctctaatcatgtgtaccttataaaggcacagctataattgtagtgtaacttattatgattaattttgacttgaatagctcacaaaagttttggaaatcctctcaaaatgatagatacaacatttagtttttagacatcatggatatttcggttaaatatgtcatgaagacttggccaaattcatttttttcgagtcgctatttccaaagtttttatatcgtcactttttcgatatttcattgtaaccgctgggccagcgatcacagtaatcctcttttttatgtaaaccaatcaaaacgcacgaagaagcgatatttctgaacaaaaatcaattcaaatttgaattttaagatctaaaaaaagcttccaaaattgatatggatttttgataacgcaattgaaaaccaaaaaattgagcgaataacaaaattcagggaaggaacacagatatttatgtcgagcatcttgatcaatctccaccttacctatgacaaaactacaacagcggtcagtgtagatcctttgagtacgatatctgaccttgattgctaccaaaatgatttgttatttgtccataatggaaatgttttgtctcctgcttttacctttcagttttatcaaataacaagcggtgacaatatatacgttgcgaaaaaagcaacgaacccaactaaaacgattccaattgctcgttttacaaaatatttaacaccgtccgaattgttagacccaatcaaaagaaaaaagcatttcaaggcagtcttagggtacgttccagatccagagtatatgcaattcattgttgataatctaacagatccttctttagcaatagaagcatcaaagattaaagacagatttttccaacgtgttgaaggaagctacaaccttaaccaaaaagtaatgagtcgtttctcatctgttcaacaaaaattaatcataccagaaacaaaaatagatcttaaaatcgggaaagcacaaagcgctccttctacaaatcaacttcctcagttatggagtctctaacagatttagcgaaaatttttgtatattcaataaaaataaattttttgaaacgatatttgaatgcaaaatcaataccattgaaaaagttcgttcgttaatccataaaaaattccaattttaggccaaagaatgcataacaccagtgttaaagcaaatcttcggtgccacttctttgatttatggaggaggttaagaaaaacaaaaaatattttttcatgaaaatatttgcatcaatttcctcgactcgacttttctcaatgtgcacttaaacaactttccaaaagaataactttagcaaacaaatgtcattttctttcttgttgctttattaatacctttcaagtgagtttttgatggatccattcgcttatctcagttggattggatgccatacggtatgcatcgttaacacacaatttttgggcttcatctaagagcatttgtttcttatcgattggagcttcttcggcgattctcttcctgatagtctctcttggcctgaagttctgtggttgtggttgtgactggatcattgttggtaagtagaatgcctgttgtggaggtaagctgcggtcgccaaatggtcgatattcagatatggtaaatgatgagtcgaattgagtttgtaatttgtatttgttcttaagggcctcttctgcacccttttgctctttgaagattattaaggctgttccttctgactcactgttgtattcatcatataatacatttgctaattcaattggtccaatttcggaagcttcgaacttatcacgaaggtccctgttgtttgtagtttcgccaatggctttgcagaataatgttctcttacgaacttcggccatttccttaactttaagatattgcttcaaatgcattcttgcgagaatgtgataactaagaagatcgcatttgattccttggctcttgaagtatttcatggttaatacaactgtttcatatgtcattagtgtaatgaaagcaactttggaattttcatagctcttgatgaaaatagcaatagctgcattaatgtcattagcacggagtttctgattgagtgaatcctgtgtttcgttctttggcaagtcatagcagataacggtttttcccttcaaattatcacagaaaccgccgatgacgtcgtttggatttaacggtggaaatacaaaagtgtttttgacgccgctttcgatttgcgcgttcttggcttcctcatatttactgaagaggatatagccaattgataacatgtgcgacgttggaacaatgctaagtgttatgattgttccataagcagaaaattgattgcgaagatcttcatatgttgttcgaggttcaacttcattgacttgaagaagaccaacaggctcatgaacaatgcgtttctcatagtatggaagaacacaaattggtgtaacttgttctccaaatgttgtatgattcaattcagcgattgctttgtttcgggcttctttggtttcatactgagcaaaaccagcagcttcaccgccaggcctctcgttgatttcaagtaagacaatctttccagccttttcaagatattgctgaatagcggctttatcagagattgaaaagtcagataagtatacacgagtttcttcaatgatgcctaagactaacaataagagatctctacgtacacttgttaatacagataatttatcatgatgaaattctgcattagctcttgttgcgcaggcttggttctcgaataatataacaccatgtccgtcgacaacaaaagtgttaagaatgtttccatattctttgaataattccttgagattcttttcattgataagatctgatggaccttcaacgcaaattgtgttcgaaggaagctttaagaggaaatcttgacgtttgtcggcaggcttgtaaaattctacggttaatttagcatcttgaattgtggcaccttgaagactctgatatgctttttgtgcatcttctgccctttcaaagctaacgtatccaataccattggattcacccctacgatttctttggatgcggcatgatttgactcttccgaattcctgcattgttgaatgcaattcttgctcatggacattaacagggaggtttgaaataacgaggttagccattgggtcatgatctcgtgaagatgggtcataccatgaaatgcgaattggaacattgttaagctgtgtatagttgcattcttttatggcattttcggcttcctcatgggtgctgaatgtaataaatgcgttagcattcttttggaagtttctctttgtgatttgtaaaatttttccatatggagagaaaaaatcctttaaccagtcttcagaaatattaactggaagatctccaacatagattcttgtagagattgattggttgcttggattagcagtcattttgataaagtgtagggccaaacctattcaattgcccccggaaaagtccaaaaagggtaatccaagcattcaattttctgataaaccgggcgatgactatcgttgtggccagatcttttggtatctttttttcgcatgatctaccgaatttaaagtcaaaattctcgttcatttttagaatttaaatatattattgtgggataaattaatgactctgtcttttttcctgaaaaatttttcaaatttgataatccgcttgatattgaatcataaatttggaatatttatgattttggatttgatagcagaaagaaggttaagacaatgttataatttatttacattataatttttgtttcgattatctccaaaattttctcgttgaagaaacgataggtgtcacttttttaaaatgtcttttccagctgaccagttcgaaagtgatgaatttgaaattttaatggatgacacatttcatgctgtcggaaaggctggcctccaaattcaacttacgccaacttcattataccttacaaataaacatattttcttaaaacctcgagttgagattgaaatgatacgccaaatatcaataaaagacatatcaaagtttaataacacaatcattaatgattgccctactctcgatataatttgtgaaaaatcagatcaaagaatctacatttttatacctgatgaaaaacgcaaagaagtgtttactaatattcttaaaacccttcattctaaggtcatcgaaagccaagaagcctgcaataagtatgctattcttcttcgccataaaatccaagaattccaatcactacaagacttttgttccaacggcgactatgatgagctatcccaaattgaacaacgtaacaaagccactgttaatattgtcaaatatcatcttcgttttctgaatctttttgatttcctagccgaccttacagaagcctcaccatttctactattttcatttttatttttttccattgttgtcctatctctcatctttgaacattactcatttggaggttttgtttgctgtgcgtttttactacttttaatacgtaatgccctctttaagctaacagataatagcccaaagcctaaggaagaggagcattttgaaggaattgatgaggaaattcgtccattaattgaatcaactaaaaaattccaacaatcaatcgataaaagacttcgatggaaaaacccaacagcttcatttgaagtcgcattgtttgcatttatattgttgttgatgtttatatttttggatcctgtgtttttgttgatagtttcgatatttttgttagcattcttcgaaagatgggacccactgaatattggatcacttccgaatattttatctcgtttaattttttggtaatgaataaaaatgttatgttgagtaattgttataaagttcacatttttctgattttcttcagaataataagtttttttaaaaaattctttctttgagaaggataatgaatctcgattatcatgatatataaagcattttggagaaaggaatcttgaattataaaaatatttttatatacttataaattttgcaatcaattagtttggtgttatttaaattaatttatttaaacaggaaatacttcttcttcaggcgaccgtttatttcacagcgttcaaagattattttcataattggccttacccaatttgacaagaaaaaaaataatattcacttaaaaagtgtatgtcaaaagttaacttttgtttacggctccaacgtttgggggaattatgaatactttacaatgtaaactgatcatgcagaaaaaatcatccctcaacaggccacaaccacctgctccaattacgcgttacattgcaccagcaagaaagtcatcgttatgtggcacaaaagaaaagacaacaactaaaaaaactcaaattcgaagttctgcaaattctcttattccactttcatcaaccaaaaattccattgcattatcacaaaatactttccctattcttcgtgatcacgtcatacccaaaattacaaatcctccaattacgccacaagaagccatttcacaatttcccgaatttcttacaaactacgagaaagaggagatccttaactatccagatatctattttataggtgatccacttaaaaaaattaaacctaaaaaatcaagtaccaatccaaattatgggtttgattatgcaacacatcattaccgagtcacagttagtgaccacatttgttatcgttatgaaattaaatcaattcttggtaaaggagcatttggtcaagtccttaaatgtttcgaccataaaacgcaggaaactgttgccctcaaaatcctaatcaataccgaacaaatgaaaacgcaaggtaattcagaaataaatatactcaaaatacttaatgaaaaggatgtaaatggaaatagtcacatcctcaaaatattcgattcgttcgagttcagaagtcacatttgtttttcgttcgaacttcttggacaaaatctatatgactattgtaagacgaactcgtttaagccatggtcaattcggcagatcagaactgttatgaggcaagtgtttattgctttggcttatacccatgcaagtggatttgtacattgtgatatcaaaccagaaaatatccttttcttacccaattctacaacaaagattcgactgatagattatggtactgcgtgtaaaattggtgaacctcattttaattatattcaaagccgatattatcgagcaccagaagttatattggggttacaattcggccccccaattgatatatggagcgtagggtgtatgatagcagagcttgtaaaaggtacaccaatgttccaaggtgaaaatgaggttcatcaattacaattacatatgacagtacttggtatgccacctttacatatgataactaagtcccccaggaagcaaatgttttttgatgaaaataataagcctttaagaggaactggacattcttttaaagttggcggatcaacaatttcaaagtcaacgacaataaccgacaaaaaactgctcgatttgttaaaggggtgcctcgagtgggacccgaataaacggttgaccgctgaacaagctttacatcatccattctttcaagaatgcgaaaatgtcgtaaaggcggaagaaataaaaaggtcacagacaccaacaaatactggaagaaaaacaacttcttcaaaaccggtttcgaaaaaataaaaatgttttgtcaaacaaagatagtcaatttgttgtacgtttattggaaaagatggaagaagaagacttattacagtcaacttcttcgtattcaggtgatgaaaaaagtacttttgctgaagatgctttaaaacaaatcgggaagtcattacaacaagatgatcaaaaatctgaacttgattcttctttaatttcgaattcaaatatgactggaatcaatatatacccaacagaaattagatttccgacgacgtttccaaatatggtatcattacaaaatatattaataacaaataaatctttatcagacgaaaaattttctatttttataaaaggagatgagaattttgatgcaaatggaataagcgaaataagagttgagtcaggtacagctaattctattttaattaaatttcatccaatagatcctattttgtatcaagcatcagttcaaattgaaggtagaatctcttttagtgttcctcttattggtcattgtattccttcacctttaaattttccatctattgattctaatttttggcattttcctaaatcttccacatgtaaaaaaattccctttgaaaacaattcatattcattacccattgacattaaagtttcatcaaattcaccagcaattacaataactccactttttcttcatcttgatccaaatacaaaaggcacaattcagcttaatttcaatccccaaactcataatttccaaactgatcccagtattcgaatcacatgcgaaatcactggtgatgatatcacaattccatttacaataattggctctaaatccacaaaagttgttgactttggatcaataacatcaggatcaatcatatccaagcgaattattttagaatctccacaaccgattccagatgcattgtggcccttttcaattgtcaactcagacccaagtaaatttgaatcgaaagaatttgtattcacgatttcaccaaaagcgccaccagcaacatatcgttcaactttacattttcttggatttgacattgaacttattgcaaatgtttgtaaatctccttatgatgttatctttccatttgatttccctaaatctcctttagcaatacgaaacaacgcaaacactaaaataagtttaagtttttcatttccattaaaatatataattaaaaaacgcgaaattgaaattgaaccaaataaaacatttctattgaatgtaaaagaaaatgaaacttatttaaataataatccaaataaaacggaatttttatctgtgttatggaaaaatggaaatggaaaacttgttgttgatcatattaaaattccgataaaagaaaaaatcgagaaaaatattactgaattccaaatcgacgaaaatttactattaaattccgaatcaagttcatcagaagaattaaaaactcaaagtaatatatcattaattcaaacgacaaacgaaaatatattattctctccaataagtaagaaaaaaagttataatgaagaaacagaaaatttatcactttccgatttaaatttaacaaaaaatataaatatttcatttataccatttttcgcagttaattcatttccaacaactttttgtcttccatttgaatcaacaaaaaattttgaaattatttcacctgattatattaaaattaataaaaacataaaaaattttgtaatcgaatatcaaaatataaatgaaatggaatcttctgattgtttaaaagtcgtttctaataatgaaatactttttgaaattccaattttttgttataattatgaatctaaacttgagttttctaaattaattcattgtgataataataataattctgctgaaatgattgtaactaataaaggaaaacgaattggttttgtgacttttatattaaataataatgaaaatgttataattaatcctttttcgaagttaattaaacctaaagaatcacaaaaatttatttttcatttcgataaaaatttaattcctgatgagactaatgtatctatagttactggggatgaaataattagagaaattagagctgaaatcgataaaaatgaaatttgttataaaaactttttacagtttaataaagaaaatgaaataatttcctttaagcaattttttaataaaatttctactgttgaacttttaaatgaaactcaaaaacatatttttattaataaattaagtttcatttctaattctcaaattacttttcatccgtcaacattagaatttgataaattgaattcttttcgaacattagaaattgaaaattgtggtttaacgaatatagaattaaaatttaattatcaaaaagaaattatttccatttcgtctaaaaatttaataattccatcaaaatcaacaaaacaaatatcaatttatttacttaaagaagcacaaacaaatttaataatcaaatataaaaatgaaaaatttatatttccaataaaatatacgaaatattctctaaataaggaaaataatattgatatcgattctaaaaaaattattttcggtaatatcgaaataggtaaacaatctaaaaaaatattaaaactaaaaaataattcatcttttgttcaaaatgtttattttaaatttgttggatcgaatgttttcttttgtttaaagcatatacagataaatccgaatgagacaattgaacatgaaattgtttttataccaaaagaaattcaaaagtttaaaggtaatctatttgtttatggaaaaaaattaaattacgttattgatctcgtcggaataggtactaaaaaacttaataaaatcttctttccaacatctaaagttggaagaattaaaagaattcaagtaaaagtagcaaattatagcgatgatcaaattaatatggaagctaatacaaatgctccttttttcacaccgatttctcattttactgttgatccaaagtgttatgtgttacttcccgttcattttgttcctttaaaaaaaggaaagtttatggataatttggtgatatcttcgaaaaatggtcaagaaagcgtaattgaattgattggttcttgtgaataaattgtttatactttcagattctttatataatttttgttcttatttgacacaaaataaaaagtgggaaattgaggatttgtttatttaatttattattttggtcctttcaacaaaaatttattaaatatacaaatctatatatttcttattaatgatcgaattttattataaatgtatttccatgaatctattggagtcccccatcgaagtttattttctatggattttttaacttttgatttatttgatacttgttcagtaagaattggaatgttttttaatgattcattattcaatgatatatttagatatttaaattttaataaaattttattttcattattattgaatatcatgaaatatggataaagattatcttgatcaagtttgaatatatatgtattgttttgattgaatattttctctcctatgtcatattcactaaatgttctatcattatttttcgatttccaaatacttgaaaaattatctaatctattggaagtaatttgaatacctccataagtattattgtctggttttgcataaaaataagcaatttcaaattccttaaataagtatttattttttttacgctttttaattttatagattggtgtttgacatagatttccattatgtagttcgtcacattctaatataccatttttacattctcctttcttattgaatatgcatatgtcatcttctgaaaagattaaaaattctggattcgttgttgtgtcttcatgggagaatggtcctgttgcaacaatagaaacttttgcatgatcacaattcttattgctaaaaatatgtattgtatattccccaatttctaattctttttcataaattattattttttcattggttgataaatgctcctcttgtttttttcttttgtgattccctaaaaaagctttaccagattttgaaactacaactaaatctaagtcattatgtattggtattaatgaatcaattgaggtggctatatcaagataagatattgtaattcttaaaggtgaaattttactattgattttgattttggttgaataatgttttcgaccagttatctcaaatgttttacttactcttaatccaaattcacatttactatcaagaggtaataatgtagaaagatctactaatccatgaccaaaataattatttggaattctgctattatatacattaactgctgaattaattaaacatgctcgaagtaatgttgaatctggattaatttttgttttcaagtatcttccttctgtaaaatattctcttacaagggcagcagctccagaaactaatggtgttgaaactgatgttccttcaacataaaactttttatttttgttgcttttttcaaatgaatcaattactacatttcctgaagctataacatccggtttttgaactcctttagtagttggtccgattgctgaataatctgcatgatgaaatctaattctattttgatcaaatttatatttgatattcaaaattgttatgttttttctaacatgttgtgcaatattagagttattgcaataaataacacaataacctgattgattaatatggttattaataatatttctttttttagaattaacattatagataattataattattttattgtttcttaaatttttgatcatttttatatatttgctatttttgccatctattaaaattgcaatgctttttcgaggaggaatattatctgatatattatataaagtgaaagtttcattatataaaatattttcgtgatcaagatttcttaaatatttatgagcatagaaaacagttccatcttctgtttccatttttaaaattatataataaaataatttaatattatcaactgaaccgactgtaagaacattactacaagtggctggtgattcaattgaaaaattattaccaaaatttcctgcacaaaatataaacaaaacagaagaaatattatatgcaattttttgatagtgataatccagaattttatctaaaccattagcagtccaactatttgaaacaatatatgcgccaatttttcttaatttttgcatcatttcttctagtttatatggaaacttattacatgtggataaatcacccataaaagcaattttggcatttggtacaatacttttgaattggttagtagaattattatttaatttaccagcaagaatacttgcaatttgtgttccatgtattttatttataatttttttctttagtgtgtttaaatcagttgatttaacaccattaatacaatgttcagggttataatatacaaatttcctgtgatttgtgataattttattaaacataagattgaaagacgtaatttgggggtcattgaataatgggtgatcccaatcaattgggttatcaacaatagctatgatttggttcataccagtaaggttaaacagttctaaattattttcaatcattgtgtcagctgaagtcttatgattaaaaaatgttgaatttccatttttttggaagctactaatgaaataagctttgggtttcatattaatctgaaaagaaatattttcttccttgattttactattcccctgtttattattatgtggaataaagttagttgaaggatcaaatattgaaattagaggattgttttttgaccaaagtgataattcaagtgaaagaaatataaagaagaacatttatattttttaaatgatttctttatgacataaatttatagaattattccaaactttccgagattctttcaaaaattataaaataaatgcaatttattagcttcaaaaactttttaatctatgtaaaaataaaatttttttttttttgaaataaaaatgttaaatacttcatttatgaaattattaagtttcgctataaaaatatatacaaataataaaatactttaatgaattgaataaaacatataaaatatgattttataataatgaaaattcatgaaacttaaatcctttatatgactcaccatatgaaagttgtaacattcaaaaattatgtttttcttgaaattattctgacttatagaaaaatacattattgcaaatgaaactctggaaatttttcattgtaaaacattacaagttggcgaggaccccaaaattaatttcccaaagatatcatctcacttttgatttgtaaacttgacaatattgaaatatcggcattttttgatttgagaggatgacttcacaaaagtaaatggaaaaattgcaaaaacaatttattcgaacacgatcaaaaaaacagaataaaatttagtggttacacatatttattacattttcttataattggtttgcttcttttataaagcgcaacaagaaccgtgttggggaatcagcatatttgaacaattcctttggggaatactcaaatcctttccacgagtgaacaaactggaaaactatttcgatgccgggaatgcttgactcaattaggagcaacttccataagaactcagctcccatgaatacgattcgatgattaatgtttaggttcaacttttccgccataaagcccgcaaacctcaggtagatgttgtggaattcttctgcaatatcacatggatttgtaaagaagatacaatgaaataacatacttggcgttggaattagtaaatttgatgattggaaaaactcggatatggatgagtattcggatagaatatgagctatttctcgaggtggatgaagttgttcccaagttttggttttatacgaatcaagaagaattgtcagcttatcgtcgactttttgaaagcttttatcaaatgtcatttctttgtcaagccaatacctcagacaaagtgagccaaggatagatatgtggatgggatcagtaacgccaaccttctctttaatcaattcaacacttttgattattctatccttgagtttataatcaaatatattttttacccttaaaggtgagtaacgacaacgaatgaaatctaaaaacaaagagtactcttcgctttcttttaagtagtttgtgttgggataaatacatttagtaagtaattgaagacacgttttacatgattcatttgctgtcgcttcatctgaaagataatgaggtaaaagcttcattgctacgcatgtgtcatttatataaaatttaattgctctaactctgtattgatatttgtaatacgatatttttgataaaccattgatattttttgtacaaaaatcaatgtacctggggtgctgaagtaattcctccgatattgattttagtttatttagtatttcaagggaatgtgaaaatttttcaataaagtatttttggagtttaatactatacttgactttttttggtttaagaagtacttgtaacctccaaaaattttggtttatgtgattctttgttaattttgttacttttaagttttgactttgatagtatttaagagcttcctcagactcgttttttaagttttccatattttttatagcctttataagcttttttctcatttttttgaaatgtggtacaagttgagttaatgcaaataatttgttttcatatccaatatttggaataggaacaagaaagcattcatatccatcaaaaagcagttcttctgggagaggttcgtttgtgtattcaggttcgaatttgtgttcctttgacatttaaatgctcattgaccgttaaaccacaatttatcgttatgtccaattgaaagcaaaataatcgtcataatattttcaggaaaagttttgctaaatgagttggagttcttttgtccagcaaactttggacgaattacacacaggagctcccccacctgattattttggatgtattggtagagtcatattaaaaaatcaacaatcatccgaaaatgttaactcattttttgaagatatatcatcacctaccttaaaaataaagacagaggaaactttagataaaaagaaaattataacaaatacatcaaatattactaataatggagaactaacaccaaacaaagagaatccaccgcttcatcctcctccaatgcttcttgaatctcctgtttcaaaacaagattccgatgattcaagtgaaagccaacccgaaattacagaatattcacctatccgtaaatcacaaaatcagagctctgaaaaaggtcgtgatagcattgcgtcggagatcgattacagtgatatctctgaccattggaaagaatcttcaaaaaaatcacgcacattgcactcttctgaagattctgatcatacgcaagacattgaagttcaatcagttgatagtcaagagtcaacgcatagccaaagcgatcagcttatctcaaaaatggaaatcattcaatcaggaacagtacaaattactaaagactccgtcgaaagtaaaccagaaccaatggctagagataagcctgactctgataagccagaaccagtggattttgccagccaatttaaggagcttggaaatgtatatcaaagctattggccgccaaaggaaacgaacgttccgcgactgcagccgaactccaaaattcttgtttcatttaaagcgtcaaactatgataggctgatgaaagctatgagaaagtactcgcaacttaacggcaaaagaattgcatatcttcgaaggaagggcacagaatagcgataaatgtttcatcgaatagaaaaagtagtaattaccaattaataaaaatatatgtatctttaaacaagagcaaaattaagtttccataaatactgtttttgatatttgagaatctgtatcagatcgctaacatttactttgtacaatcacatccaacgcttcaaattaattatatataacttttatataaacagctcaaattttcaatagtttatctttttcaactcatgtcactttcacgataaattttgaatgacaataaaaacgcctttttttatttcacattttattaatggagcaaagaacacttggaaaaacaggaattaaagtatccccaattggtcttgggtgcatgggtatgagccatgcatatggtgatccaaaagataaagatgaaatgattaaacttattcgtcatgccttcgaaatcggctgtactttctttgacactgctcctgtctatggctttgataacgaaaagatcttaggcgaagctgttaaaccattccgctcacaagtaattattggaacaaaatttggaattacaggacaaaaagttgttgatggaacacctgttaacattctcgacagccgtccagagacgattcttaaggatgttgatgcatctcttgaacgacttcaaactgattacatagatttatattaccagcatcgaattgatccgaatgttgaacctgaagttgttgcaaatgtcatgaagcagcttattgaaagcggtaagattcgtgcttggggagtatcaaacgctcctattgattacataaggagagctcataaagtttgtccaattgctgcaatgcaaaatcaatactctcttatctttcgcagtccagaaaaagaatacattccactctgtgaggaattaggaatcacatttgtcgcatatggacctgttggaagtggttttcttagtggaaggttcacaaaggacagtacttacgagaaatctgattttagatcaacaatgaaaagatttagagatcaagcaatggatacaaatggaaaggttctcgatgtaatcaaagaactagcaaaggccaaaaactgcacaactgcacaaattgcgcttgcttgggcattagcacaaaaaccattcatcgttccaattccaggaactacaaatatcaatcgcttggaagaaaacatgggaagcttgaagatagcgttcaccaaggaggaaatggacaatctcaatgaggcgctttcacatctcgaaattgacgaatcatacttctgaatattaaacacgatacaacgtaaactattgaattcatatttcgtaaaacactgattttttaaaagtgccggtagagagcgaaattggagatttaagataaaaaaattgtattcagtgttagttatggccatatgtataaaaatatgtatattagataaaaattggtaaatattttttaaaattagttgatattggtttagattttttgctggattagtttaactatttctgtgtaacctttcgaagatgcatatttaagtgcattataaaataatttaaataaattccaaatattattttgaaatattaaaatattaacatgaacccataattaaataagtaaatatttttagcattaatatcaattcccttttgttcaagaagtaatttaacaatatttgtgtaaccattttctgatgcatacatgagtgctgttttatataatttaaataaattgtaaatattattttgaaataaaaagttgttagaataaatttcatattaaacaaataaacatctctagcattaatattaattcccttttgttcgagaagtatctgaactatcttatcataaccgaattgagctgccaaaataagcgctgtattaaatgatattaataaattcctaatattattttgaaatttcatataatttaagtgaataaaaaataaaacaaataaaaacttttagcattataaacaattcctttttgctcaagaagtaatttaacaatctcaaatttacctcttcgcgatgcaaatataagtgctgtgttaaaaattttaaacaatttccaaatattattatcaaatccaaaattgtttgatgaaatttgaaattaaacaatcaaaaatttcgtgcattaatatcaatttttttttgtttaataagtaattcaacaatttctatgtatcctttttcagctgcaatcattagagctgtttgaaataaattaaatatttttgaaatattatttcaaaatgtcaaattattcaaatcaactttaaattaaacaaataaaaattttgagcattaatatcaataccgttttgttcaagaagcaatttaactatttcaatatggtttttataagaagcgtcaataagtgctgtaaaacatgttttaaataatttccaaacattgctatgaaatgctaaattatttaaaccaattttaaatcaaacaaataaaaattttgagcattaacatcaataccgttttgttcaagaagcaatttaactatttcaatatggtttttataagaagcgtcaataagtgctgtgcaaaatagtttgaataatttccaaatattatttgaatatatcaaattaatcaaataaagcccatacaaaacaaatatatatttttagcattgatattaattccttcttgtttaagaaggatttcaacaattttagtgttaccatcactagatgcccaaacaagtgctgcgtcaaatatttaaaataatttccaaatattattttgaagtattaagttaaaaaaataaaatgcaaaaacaaaaaataattatcttttgcatttatgtcaattcctttttgctgtaaaacatattctataagttcagtatttcttgattttacagaaaaaattaaaatgtcaattggaagttgatttgtttttagaaaatactttgttagaaaaatattaccaattctcgctgattcattaatgattgaatcattaattttcattccttcttcttttaaaaatgagaaaatttcatagttatgatataaaatacatttccctcctaattcttctaaactattgattgcaacaattttattttcatataaataatgaaaaataacatttcgatgatattcaattgcagtttcatatgcatcttcaaatgatgaatgattttgttcacataaatgaatgatttcttcatttccacctgcaactgcatatttgcctgtgttttttatattagaaccattcataagtaaatatttaaaacatttaacagaagaaaaaaatgctgcataatcaattaatgaaacatttctttgattaataaatgaacatctttcataaagtgatggtttaattgtttgattaaaatcaaaatctgtttgcgatgatatttcttgaagtttttctatttcatcatttcgaatgatttttgctatttcattcggattatgtccttctttaacatatttcttatgaagctcaaaattattattcggaaatttgtaattttctataaattcatcgatgttgctaaaactttctcgcatatttttaattatatcatcaatttcttcttttgacatatattgagcaaaatacagactatatttcttatgaacaatgtttgattcaatcaatttttgttcaaccatattataaagaatgtgatttgattcttgcgtttttttattgagaagaaaatttgcgaattcatcaaaaatattaattttgattttgtttttatcttcaaataactgaatttcttttaaaaatttcaaatatgtattaatatcatttcgtttcaaaacaaataatgtgtatacaatttcaatgataattaaattaaaagaaattggataaatttcatcaaattttttaattattgaatttgctgtttttacaatactttcttcatttaaacaaaaaattatttgagtgattgatgaaaccatttccatttcactttgagattttttgttttcttcagccgacatactgcaaaagtgacaattgaaaaagtggaattgtatgttttttaaacggtacaatttccatgcattcaaaaaattgcattctttttaatcgtttaatttatgacaacagccgttcaaacaaaatggttgaagctctaaaaacacgccgttcaattcgtaactttgatccaaactatgagctaacaaaagaagaacttgacacaattgtggaatgcgcattgaactcaccaagtgcattgaaccttcaagaaaacgatttgattatcataagaaataaagagttgatccaaaaaatagacaataccgttttcagtaagttggataattttttccaagaacgctttttaacaaggcaaaagcgttatggtgttactaatcctgttacatatgactgcagtgccctcattatgattgttaagaatgagcgctctaaagaaggatacgttcaactcgattctggcattcttgccatgtccattttaactgctgcgcaagccgtcgggctcggatctgttccaataggagttcttgttcgtccagatgtcgaagaaatcattggagtagagaaaggctccttatgccttgctattgctattggcaagccaaagaaaatcgaagttgatccaaaggaggtgctcaggaaggttaagtacattgactaaaaatcgaatcaagttaacgtattctttccaccgtttaacgaacatttttttggttgtgttttttgatgcccgtttgagttattgcagggctgagtaatgaagtcaatgttcattatgaattgttattataacagagcttatgtaagtttccttagtattttttttgtgacatggaaaaaataatcatatatttctctccattttgaacaaacaacataatgtctaacccagcgcctttctcataagcatcttaagatttgggttgaatattgccattcttgtatgtttggcaagatttttgagatttttttcagcttattcaaaatttcattcaataattaataggaaaattttgtttttgaatcacacgtgtgatcgttcacatacatttgtaattttagatgtagttcttatatcaaaacattctacccaacatgctaaaatgtgaacagatcccctaaatgaaagtttcgattgtgatgcccatgaatctaatctgattgattttgaatttctgcatttacttgagcagcatctatttgcagcaccatcagggtaacttggtgaaaaatattatcagcaagttttgtaaagaatatttaatatcttatgatatcattattatattctgaatgatatatatatatcttctgattgatagtaataattttgatatatatttgagattattacaagaaattgaaaaatatgaagaaaataataaaatcaacacaaataaatttattttctcaattactacttaaagaaaacacacaagaatcaatttatttacttaattacatgattaagcataatttacctgaatcaaaattcatcaaaaatacatttaatccattttttgttcatattaatcaagataaatcaaataaatataaaatatttatttgatcaagaaaatattgctatgaagaactttcacaaaatgactttgcacttcataagcaattaattgaagaaggagttaatccaaataaaattgcaaaaataattcgaaatgatgaaatcgaaaaacttcaagatatatcatcacaaacaaattttgattttgatcaaacaattgaaccatcactttatgaaagatgttcatttattaatcataaaaatgttagattaattgattatgcagcattctttggatcaattaaatgttttaaatatttacttatgcatggtgcaaatgtaaaaaatacaggtaaatatgcaattgcaggtggaaatgaagaaatcattcatttatgtgaacaaaatcattcattatttgaaggtgcatatgaaacagcaattatgtttcatcgaaatgatatctttaaatatctttatgaaaataaaattgaagaagatattaacaaattaaaagaattaggagaaaaatgtgtttcatattttaattatgaaatttttacatatttagaaaaagaaggaatgaaaattaataaaaatatcattaataaagcagcaaaaattggaaatatttttcttgtaaaatatttccataaaaataatcaacttccaggaaatattttagtttttgcttcattttcaggaaatattgaacttgttacatacattttaaagcaaaaaggaattgatattaatgctaaagatatttattttaataattttttatttcaaaataatatttggaaattatttaaattatttgaaacagcacttctgattgcatcttcagaaggtcatacagaaatagtcaaattgcttcttgaacaagaaggaattgatattaaagctaaagatatttatttgttttatttgatatttattttaataattttatatttcaaaataatatttggaaattatttaaattatttgaaacagcacttatgtgggcatctaaagaaggtcatacagaaatagttcaattacttcttgaacaagaaggaattggtattaatactaaaagtatttaatgtttgatttgaatcataaactataactcgaattcgaatgtccttttgattaaatatcgataatgtgcttacttgattaataggaattggattagtaacaaaagcattttgtaaaacgtcatctatttttaatgaatgataaacaattcgaccattatcaatagtgataataccaaaacctttatgtttaagaagatctgatgcaacaacttcaagcattccattcgtatggatgaatgttgtttcacttggatgtgtatgacctgtgataagcatcgaacaattattattcgttataatttgttcaagtgttttacctgttgaagatgtacatgtgtatttatcccataagtctaatggataatgacaatgaattattcgcgttttcgtttggggattttgaatgaaaaattcttcaattcatctactttcattaaatagttttactaaaaatagttacatttataatctgaagtctttaaacactttaagactcattaacaaaaaacattttttcgatcgtaatttttttactggaaatccattgctccaagtaaattaattgttgcatatctttcaagtttggtattctttgtatcattgcttgcttgccacgacaaaggatgtggtgactttaagtttgtagcatgctgttccatatttttctcattccaataaggtaacatcattgctataattgcctggttaccattttcctttgctatttgatatgggtgtacaatatgtgaagcatttggattacaaccgcattgtaacaacacttcgactgcatcattattattataataagttgcataagccaaagctgaccattcttcatctaaagcatttaagttatctgtattcaaagccaacaacaaagtaatcaactggttaccggctgaggctgcttcgtgtaatggggtataaccgttggtcggattgatttgacgcttttttcatgtcgcaaatgcacgagtaaactttgagaacgttaccatctcttatcgcttcgtgcatgtcatagctttcgccgttgttggcaaaatatgacatctgcaagtacttcttccggatatactcttctcgtttctctttcgtaacgccagggttgattttctcgctccccaacgttcttctctaatatggaattagcattagaattaccaatcgctaaaaataacttattggtggtgggatctaatcgatctaaggttaatgatcgaactttagaaactgatgtggtcaatgatcgatgaactccactacaattgatgcagatgcaaactccccaattgatgcaacaccaaactggatttggtgcaccgcaatctgcacaaacacaattacactcgaccgataatggtgagtcattgctagaatctttcgtaaatgtagtagtttctttgatatcttccccactatgatctaacagatattgaatattgttttggatgactgcgatccattcgttcatgtcccattcagttaacgcctgtagtacatagactttttcttgcgatatgatcgtgaaacaaaatcggcgttctggatccttaataggtttaactgtggtcaataacatgggtaagataccttgtggcttatcactgtcttctgttccatggaaatatgataatgtatgattttgacatatgaaatatcgcttttgccaagatttggtaaaaccactgcctttcttccataaatagccttcgtggttgatggcaggggtgtgtgtaaataagacttttaatcgcttccaatataacgtataatatccttcgagtgattttccaagaatatctgtgttcttttcaaagatgttgacttcatcagaggaaactggaagtgcaagttgaagatttgaaaaagaatctttggcatcatcaaaactaaattttgtcgcccttccttttaatccctagaaacaagcaaaaactttatccatcttcaaatagtatatataattatcattacagggcgtgctaatcaaatattcataaaaattgtatatttattgataattatatttgttcaataaatttttcttcttgaaaatcttcagcaaatggatcttcttcaatatttatgttacttattcccgtagtaaatgtatttatcgtttcgttttcattttcttctgatttatcattttcataaatttcttcttttttgtttcgaatatgtttcaacaatataattaataatatgataataactattactataacaattacacaagctgaaatgataataattattgttttatcattattttgattattattaacattagtgtaaaatattataaagaaattggaataataattataataagtcgaataaataacaattgtgtaattgtaataaataaattctgtttcaatatatgaaaatgtcgaattatttatatataatgaaaatgttttcgtttttgtttcataaatagttaatgaatgtgtaattgataatgtaaatgttaatgtatatgaaaatgataatgaaatatcactttgaagtgattcagtaaatgtatttgattgaataaatgaatgtgttggaattggttcgcatatcccttctgtggattcactaacaacacccaaactttcaaaataatcgcctacatatgttggatatgtgataacacttgttgaaaaattataaaatgcactttcactaatttctggttctttgtctccataataataaatgcatcgaagttgatagcaaaacgcaaatgctgaacctccaatatatcttattccatagccaagtgttaatatcgttaaattagaacataatgcaaatgcataactgccaattgttgtaactgaatttggaattgtaatgtttttgattgatgaacacaatgaaaatgatgaatcaccaatctctgtaacattttctccaaaaataattgtttctaaattaaaacatgacgaaaacactgaacgtccaatctctattgaaatctggatgattatttttcatataaatcaattgaaagtttggagccctccaaatttaacagaacgtttcaatgtgttatttcactatttatcttgagaagaaaattcggaaacgtaaaactgacctaaaaaatatttattctatgaatctgctatttttttctgaagttcttttccagcttcaaaatcaaaatcatattccgatatgtttgtcgttgcagattcgttcaaaaatttaattattgactcaatggtccgatcttcatcaaaagaaataacatcttcttttcgttttttcccggcgggccacataaacattgttggatatccatcgaagtttggaaaactttctggtaactcatttaacgtgccatcaatccaataaaacttaattttatctgtcttgttcacaaccatttgcgctgtcgcattaagaactggtttgaaatgtttacaatgcccacaccaaggagcggttatgacaactaacacatctgtatcgttctggttaacggcttcctcaaaagtgacggcagttaattgacggaaaacaacttctggtggctcatctggaaattgggctgagaccttcgaaaagttgatcttgccatcaattgcatcacgaacaaatgattcaataaaggtgtaattactttgtttctggatgttttgaattaaccatcgattaggtccaagatctgtcgaattcaataaaaagaaatatggtgcttgggcgttttcaagtgaggctttcttgataatgcttctgccttcgtaatcatcagcaataacaaaatttgctttatcaataaattcaacagcaagcttgtcaagaatggaaatttcttcctctgctcgtgtagtgttatcatcatttgttatgaaccctccaaagaatggtttttccatggatttgaaaagattcaaatttacgagatgtgaatctttaagatcatcaaaattaccattgtacggtataagctgacgatctgaaaaacgataaacatatactcctttgtcaactttcatatcgaaaaatttaaaaagagatgatgatgtgttataaaatgtttcatcttctggaatattttgtggtacttcttctgtgtcaacaccaatgatgtgagcacctttgagtgataaaaatcttcgtaactgttctgggtattctaaattattaattttaggattcataatttctcgaagccagccggcaaattctgttggagtcggatattcggcaaaattggatatatgttttccttgagaaaatgcagcaatacaaggagaaaatacacaatttgctaggttagatttctcataactagcaagagcaatgttgatctgatcacggtacctgtagataccatagtccatatagtctaagacatagttatctttctgaaaaataataacgcttctattatgagattgaataaattcttcaatttttgaatcatcaatttcatcaaggtaagttgcttctcctataggatttggaaaacgaattgcaagtaaaaatgcaaagagcattttaactcaaaggatattgaattgacgttgctctgtttggacaaatatcaattcaaaaatattttgtaaaatatctatttcacttgaacaaataatatttaatctaacataaggaaatcttgattttcagttcagggaaagatgaaattataagatcggaatgatctatattcttcaaattttctcataagtagtttaatttattcagcagtcataacaaaaaacaatgaagttattaaattatatggaggcaattcaaatgaaagaagaagaaatgatccaaaaatcgtcggtatttttactcattagatttatgatattaattcacaagaaacatattatttagttgagaaaatgatagaaaggaaattaattgatatatatataaccaacaaattattaacaacaacaacaacaacatcaaaaatcaaaacagtaaacaaaaatataatatatgccatttgataatttttcttaaacaaatactaagaactttcaaagaatgattgggaatttcataagaaatatattaaagaaggatgtaatccaaataaaattgcgaaaataattcaaaatggtgaaatagagaaatgtcatcacaaccaaattttaattttaatcaaacaattaaaccatcactatatgaacaatgtgattttattaatgacaatgtttcattaatagtgtatgctttgatcaataaacgatgtattatatcttctagataactcttgaaattgaaccttttgaaaattagaaaaaaggcatcttgcacatgtaattgcctctgattaatttttttgatactgaattagggaatgatttcaatatttctagtaacagcagtgttgcatatgattttaaattattatcttctctttgagttgtgtttgaagctgtgttcttttttttttggttttgttaagaaatatatagaaaatccaaatttaaaatgtttatttaaaaatcaaaattgtcatttcggttccaacatgtctgtaatggagactcaaaaacaacaaaacgaatgggaaaccatacaaactatcaatcaaataattaatgatttaaatcaggataatatttccagttcagtgcaatcaataggtgaaatatttgatatttattatccatactcttttaatttaattattagccaaattgtatatacgtcattcattactaaatataataattcagatatatatttagattttttaaaagaaattgatgcttttgaggaaacccataaatgcaaatacaaaatttttgatgttttttcacaattaattataaaaaagaagtcacaagaaacattttatcttattgagaatatgattcggcaaaatttagttagtgaagataaaattataaaaaatattacttcaaaatattttgcacatcgcaaaacattcgaagagagcaaacgaaaatatatggaaccattttgcaatacttttctgagacattatgaagaactttcagagaatgattgggaacttcataagaaattgattaaagaaggagttaatccaaatgaaattgcaaaaatcattcgaaatgatgaaatagaaaaacttcaagaaatatcatcacaaacaaattttaatattaatcaaacaattgagccatcactttaagaaaggtgttcatttattaatcattgggtttcattaattgattatgcagcattttttggatcagttcaatgttttaaatatttacttatgaatggttctaatataaaaaacacaggcaaatatgcagttgcaggtggtaatgaagaaatcattcatttgtgtgagcagaatcattcaacatttaaaaatgcatatgaaacagcaattatatttcatcgaaatgatatctttaaatatcttatcgaaaagcaattccaaatattaaatgaaaacaaacaacaaaatattgaaacgaaactcaaagatcttgagaatttggaaaagttatgtatcaacaacggaaattatgaacttttatcatttttggttgaagaaggaatggatgtaaattgtaatattattaatgaatctgcaaatattggaaatttatatcttgttaaacattttcttcaaaacaagcaaattccaaaagatattttagttttttcattggaatcaggaaacaatgaacttttaaattatcttcttaaattggaaggtattaatataaatggtgccaatatttaaatattttattttctgtttattttaataatatgatattttacaataatatttggaaattattaaaaagattttatacagcacttatgaaagcatctttaaaaaatgaaatagaaatagttaaattacttcttaaacaaagtggaattgatgtaaatgctcaagatatttatattacttattgaaaattaattttgtaaatattttatctcaaaataatatttggagattattcaaattatttaattcagctcttagtttagcatcttcagaaggttatacagaaatagttagtttacttctcaaacaaaaaggaattgaaatcaattctaaagatatttacatgttttattaaacgtttgtttcaataattttttcatattttaaaataatatttgaaaattattcaaaatattttatacacctctaataaaagcatctggaaatggttatattgaaatagttaaattacttcttaaacaaaaagaaattgatgttaatgttaaagatatttattcatctaaaacatgatttgtttaagaaattttatgctctattataaaacttggaatttattccaaaaatttaaaacagcactattttatgcatcttcgaatggtcatttagaaatcgtcaaattgcttcttgaacaaaaaggaattgctatcaattccattacaatttatttgttttatttaatatttaatttgataatttgatgtttgataataatatttcaaagttatttaaaatatttgagacagcactaataatagcatcagaaaaaaattatattgatatagttaaattacttgttgaacagaaaggaattgatatcaattttaaaaatattaatttgttttatttaaaatcgatataaataaatttgggttctaaaataacaattggaaattacttaaaattaaaacggcgcttatgattgcatctatatataataatattgaaatagttaaattacttcttgaacaaaacgaaattgatgttaattccaaagatatttatttgttttgtttgatattaattattataattttgggtttcaaaataatattaggaatttatttactgtatttgaaacagttttaataaaaacatctaaaaaaggttacttagatatagttaaattacttattgaacaaaaaggaattactataaatgcgaaaaatttttatttgattcgtataatattaaatttattcatttaaaatttcaaaataatattaggaatttatttactgtatttgaaactgcattaatagaagcatcttcaaatggttacttagatatagttaaattacttattgaacaaaaaggaattgatattaatgcaaaagatattcatttgttttatataatatttgttaattttgtctgatgtatcaaagtaatatttgggatttattcaaattatttgaaacagcatttatgaaagcatctaataaaggctatacagaaatagttaaattattcttaaacaagagcttttgatcctaatgcaaaaaacataagtgaaaaagtaccaaacccaccccactaattctttatcaagaattagacataaaatgatgcttattacatatgcatatgaacatttgaaaatatttaaaaaatatatattcaataaaaagttgtatacattttaagtttgcacgattaaaatatttcacataatgtctgttgagcattaatttatgttactctttagcataatgccaaaattacatcacaaatcgctaggttagcggccaacctttgcaagaaggtcccaacgattgcacaaggcgtttgcaaacaacttgttggaagtgcacttccaactcttatcaagattggaaacggactttcgaaccttaacgtctgcaagaaagttcatctttgctaagtggaataaattattttttttaaagttatttagaagattttgtgaaatttcaaattttgatcagtaagaaaacgttctaaaattgtctctgccgacgaattctttggctttggtaagagaatgaaacaaaaggaacatttcggcataagaaattgcaacagtttcagtttcgtacgttaacaaattgcaaatgaaggcgcttgtttacaaggcatggaaagcagttcaattcgagcgccttgaagaactagaagagctagttcctacaaaagtaagttcaaacgcatcaactggtgattcaaataatcatgtacatacattattaatgtgtgctgctgttcatggttcttatacttgtgcaaaatatctcatcactaatggcgcaaatgttgaagccaaaaacttcgcaggatatactgctcttcattgggctgcttattctggaagaatagaaactgtttcattactcataaaaaacggtgcacaaattaattctaaaactgaggatggaaaagagcccatacacattgccgcatatagaggtcacttaaattttattctcaaattattatcgctaaaagcagatcttaattcaattgcaagtaatggttggaactctttccattttgctcttgtttcaaatcaaaaacaagtttgtcggaaactcattgaacttggaattgatttacatgagaaaacatcagaagaaattgttaaacaatataaacgcgaatggtacaaaatgttattacaaaaataaaacaaaatacaaactaaagcttttgtttattaaattttcatcatttcattataagcttcttctacagtgttattcaaagaaatattccgaatgaagaaatcaattgatttcgcatacttattcatttcttcatgagttaaaacaccagaaccataccttaacctgatgtaaatatcgtctgcgactgagaaactcatcaaagaaacaattgaactgatattgatcgtcttggcatgatgcgaaacaaaagcatcaacaattggcttttggattggtaatgcacccatgttagtgatttcaagacctattcctggaataggctttgcatcggacgaaacaccaagacttttaatgaagccaaagtgatgtttttctttgatcttcttttccatgtcttcacgcattaagcggccaacttcagataacttcatgtcactactaatgtgtgatgatggcgaaactgctgagaagcaatttgttaatgaataatcgattgattgttttggaaggaaattcctaaggtccatacatgtacaaactcctccatattcatcaatgtgatgcttatgaacaaaggcagcaagcatatgagacaaccatagagtttctgtgaatttcttgattgatttggtcttcttatcataacacataaggtcactcattttagccttaattgtgaaataactgccatatggactatccgctttcgggtttccatttgtggaaattctagtgatgtatggatcgcaattccatggttgtacaattggcgctttgtcgatctcacttgaaaagatgtcttctgccttcaaaggtagaatatttttgctttttacttgatcattcaagtgggaaacaatatatttaaaatacccaccatcactacaaaggtgattaatattcaaaacaacaaaatctttgcctgcagctacagaggccaatgccttattgaaaggttttgtataatttattgcggtgaaatttgcggcttcttgaagcgttttgattttacttggcaaaaaatatacaggaacctcttcgcaatgtgtaatcattaggtctccatgtgttcgtgtgtggagaggaaccacaattcttgtgagcttatgagctatatcattaacatatttcggattttcaaccttaagcgccaattgaagcattgtagcagcattgatatcaaaataatcagaaggcctcaatttgcggtaagatggtgatgtacaagacataaattgaagatggttgtgatcgttttttaggctctgaaatttctgagtggaaaattccgtttttgtttaattgaattaaaacgactgttattttgataagtttatattattttgaaagagccagccgatggcctcgtgagggtttttcattggcaaatgaacgtcgctaaatcttccatggaatcaaatttgattttaatcaatttttagtaataattcaatatcatatttcatgtgtattatttattacaatcaaactcttaaatgtattatttttttttttattattgaacattttaatgaatcttttcgaaaatttattcttataaaaatgcatttccgttacaaattattacttcacttctcagaaaaaacaaatgttaaaaatttcttttaatcaaattattacatattttggagaaaaacaataataacaaaaccttaactcaataatacgacaatacttcattaaggtcaaacatttcttgtagttctttcggcattggcgactccccaaacaattccttcttcatgttttcgtcgagatcttcaattcccgacatgtattgcatgtcaacgaatccgaagcatggctcgaaatatgtgtggcttgtgattgcgtggcattcactatgtgttaattcctcattttctttattcatatcttcaaatttcttctgaacctcttccaatttcttggaaacatcattgttatttatgtcaatgaatgttatgattgaaccattacgtgttgtgccacaaatcatttcgaagttggtttcaatcggtaacggtcgccacgccgatagacttgtcacattttcgccgatagaatagcgaccgtttgttatgactttgtccttttcaaatgataaatgatatacatttcctcggcaatcacttacgatgaaagaagaccttatgctgcatccagttattaggaactttggaagataatcagtagccaaacaattcaaattgaagtcaaatagaatcactgatttaaaggcatcaacaacacataaacaatcacttcctagtaacaaatcagaagctatcattaatgcatctgcttctttcatgaaagaaagagatccatcttctttcatacaatatttttgaattgttgatccaacagtaacataaacgaatccttcttcatatacgatacttgttgggatacttttaacgacaaccttttgttcaagttcctttccattttgaaatattattatcattccatcttcacataaacgatcttttggttcctccaatcctcccacgcaaaccagtacgtatgattggccatgaaaatcgaatgaacaaaggtaatttacggtgaacttttcatccaccgttaaacatccaatcttctctaaacggtttgtgtcaaataattgaatggtgttgtcaaatgttgttgctatctcacgaccgttaacgatgtaaattccgtcaaacgttctctcgacatgtttttggcaaatttgtatcagatgcggattcgaaacttcgccgatggtaacattctcatcatgtaagatacaaatttgatcatttaagttgacacctttgattgatttaccacaatttattgggtaaacgtctattttcatgtttttatttaatttgatcaaatttgattcgtttgaagcaacgaatacaaatgaatcatttaacactttaacaggtaaaattgtgacgtttgtatgcgatgtattcactcgatcgatttcattgattcttccattttcatttatttcaaatgctatgatgtaaccatttgatgtaccaaagtataaaatggattccatttcacatatggaacgaacaacaagttgtaaattatatgtcttgcattcttctattttattatcttctttaagtttaaatatatgaattgataattcattccataatgagataattatgaagttattactagtgataaataatgatccaacttctccattaatttcaacttgatcttgttcttcaaatttatcatcattaaatattatagattttaatttattatcatttgttacaactataattttattattatttgcatacgcattttgaatgtcaatatcaaatttcaatggtttatcgttatcgtcgtctttaaacgcatttaaacggtctttgcatatttgtatgtaataaccgttgtaaccgtagaagaaaatcgttggttgatcagcaatgaaattggaattatttgtgacttcattatctttaaacaaaacagaactattttgtgttgaaacaactatgtaattattaaagacaaaaatgttttcacctataaaatcaataatcgaagttggaaaataagaaaatccataaccaatcgaataaagtttatcttgtccacatataattaatttatcaagtccttgaattgtatgtgggacaacaacatgtcgcgttggagacattatttcatttggaaagatttgtcgataatcattagtttggaaatcatataaataaacgatgttaaattgtgacatacaaataaattgtgtttgtgaaatagtaatgagatcatcaaatatgatttgtggtgcgttttggagttcagcaagactttcgccgttgtatcgtaaaaccgtaaaatcttctaaacaaattattatatcgtcattgaaaaagtgagatgaaaagaggttggttttaagtggaaactctttcagcttctctgcatctttgtaaacataaaacttatcctgtgaaaagagataataataattggaatcagctagaaaaacttcaatgatttctggaattgcaatttcggtcaataattggctacaattggatgattgcgattttatagcttctggaactttactgagttccaactttttgatggagttcgaaacatcaaaggttactaattcttcattgattccatacatggataatggaacataatgatcaaaatgaatggtatttatatcaattgtttcaccaaattgaagagctgttaatgtgtttggatataaggaaataaaaaggaaattttgaattaataaaaaacatggtggaattcgattaggttgaacatttggtattctagcaccttttaaaactattttgctaatcggtacttcgtcttcagggtttccagtatatgaaaaaattattaatgtcgtattagttgtaacaacaataatactttcactttggctatttggtaacttgaaactactagcatatttaactgtggcctctataggaatttcaagatctggttcagtatcttgttcgaataatagtgatgaataatattgaattgaatgtggtcttacaatgcaaagatgcttttctgtttcagatatgaaattgccataagagctataaattatggatccagagctcttatttacattgatgaaaagagatgacataaaattatcacttaatattaagtgaacagtgaaaaaattgactacaatgtgcgtatcgtaatttcctttgattctatcgtcctgtagtgtttgtctgttcctttgatataacaaataaaagaaaaataatctaatttgaattattatttaatctatactctggaatatgtggcttcatttcttaagtttaattaaacaattacaataaaaaaaaataattagtcttggctaatgaaataaaaaaacgtaagattacaataggttcgtatttatttagttctgctttctttttttggaagatttgtttgtatttgttgatgaagatgtgggaatttttgacatttttgtagctgcccattttatataaacaacaacaggaatgctgaataaaatacaagttgtgatgcaaacagggtgaacaataaatgatacaattaaagcaacaatttcacataatgcaagttcaatccatccgagcttattgtctccacgagcagctctggtgttaccaacaaaaataattaagaaaaagaaaagaattgctccgaaaaatccaccaagaaatgtagcttcagccttcattctgaaaactttacgaagcgcgatcatgagaacagcgagaactgctgcacatatcccagaaagtctctttgatgattcgactgttggcgcattcatttgtggccaattttaaacggttgacgatggaattccaaaatttaattttcgtggaaatatattatttcctacttattataaaaatctttaggaatttccaaaaaaatatttaaaaaaatttattatatcttgaaatcaaatattaatttaaattacaaaatcgctctgattgtattatatttccgcaacatcatactaaaccttaaaagttattttctttggaggagaatttgtagactgtgatggcataaaagtaatgttttgttcaaggaatttcaaaagatctttcggaaaatttgttttcgcaaatttagaagtcacaagctctggtttcgattcgtttttatattttactatgtacattgcttggtcattttcgaatgtgattcccaaaatttcagatggctttttaaaagcagctgctctcgccttattttttgccaaactttcttcgaattctgtgatgattttcaaatcttcttgatctttgatttgatctaagttaatccatttaccatttttcttgtctttaatggttacaagatattgaatgttatcttgagaattcttttttcttttaacagattcaatatttagagtgactggaagcgaagcttttgattcggcctccatttatttcacaaaaaattgaattcacatttcattttaaatagtttacataaataagagaagacgaatgtgaaaaaatgtttactctgttatgacagatacttcaacgtgaacttctggctcgagtccgatttgtgtaacttgcttgacagcagcgggtgttcctacaaaatcaataactctcttatatatacgaagttccaaatgatcatatgtttcggtaccattaccacatggtgcacgacgtgttgtaatcctaaggcggcggcgtggcattggaattggtccacgaactttgagatgttcagcctttaatttttgaaccaaattgttgcatactttttggagatttggaagttttgaagatgtgattgtaaggcgaatgcgttgtgtattttgaatttgtgtagtttctttcttttcgtctcctgttggaatgctcattcttaaaaggaaggccaaacaaacactgtgaatttccttaattaaggtattaaacgttctccttccaaaagtgtcatgcacttttttatttcaggaagttacaaatgtctgattggcttgataaccttattgctacgcatggatctggcctttctggtgaagaagaagatgaagaaaatataccaataactgttcctaatccaataaaattaaatacatcaaaagaaaatattcaattacttcatttaaatttcgaaaagtcaacgaacgaaaactcttttaaagatgatgaaaaatcagaagaatcaactttagatgaaataaagaaagaaaaaattaattcaagatttcaattttcaggaaaaggtacaaaagaaatgtcattgtttgcaaattctgcaaatgctatgttgcgtaaacaagaaagcgcatatagttcggttcttattcaaacatctaaatctttagaaaaaactattatcaatacttcacgacctatacagacagttggtgaacttggaaaaatttctcttgaagtaaagactaagtttattgggattcaacagaaaataatgtctcttgagccattatgccaaatgaaatcacaataaaaagtgttaacatttaaggccaaacgaagcgaattaaatgtattgcaaaatgtataatttaaaattgtaaaaaaaaaatcaaacttttaatttttcaaaaattgagaattcattaaatttcttgttttactcaataaggtttccaagcaacatgttacattatttagtgtaaataaatttattaattatttaaaaaaattaagaaataaagtgaaaggatttttgtttattaaaatcatctcgttacaaatataaaaaaaaaaactttttataattcagattccggaatatatttttcaaattcttgtagaactctaagtttctcctcaacatcctcaagcttctttccttttgcttgttctattatcttttttaggatggaaattcctcttttaatttccgattcccctttttcgattacacttttcataacagaaattacgaattcggaatttgcaaaatttttagtcttttccaacacttcttttttatttgaattattcatgaactcttttataagttcagataattcgaaactaatttgttggagtgccccagtttttgttcgttgctttgagcacttttcgtttacaaaattgagaagaaaaggaagttcacgagtgccaacgtaatcaaacacgttgttacctttgtagatacgtattattggggcttcttggataccaagttggaaacagaaagtaacattaaagctacaattaacaagaccaaaactcatatctgtttctttggaaaaaataaaagagagttcttcaatggtgggatataaaagctctgacatacggtcacgtgattgtataaatgtgacaactttgcaattgttagttccaagaaaagtggaataattattatatgaaaatctttgtaaatgtgaaggaggaagtgttacctttgctttgctgttctttaatagaaacattgcaacagcataaaagctgtgttcatttgtaaaatcaagaggatgtttagaatgtggtcgaaaaagacgaaatccaggaattggttcaaaaaactttttttgacatatgtcatacttggagcaatttatggtgagcagctctatatcaagagcgactgatgcaatgcgcttcattatttctaagccttcatgtgagctttctgaattataaaaatagacaagggttgagtaggtttttggatctaataagttctcatgattttcattatattcttgtagaattgataaggaacaagagaaaagaagaagaagcatgatttttcatatcacatttcattttgataaaagtggcataaccaagtttttgaccaccttgtctgatcaaaaatcaaagaaaatctagatgtttttatggtttaaaggaagtgtaatttcatttatatttttggatattaacatctaaattgaaattaaatatcttcagtaattttacttttttaagtttaaactttataattcgttgagaatagatgaccatttatctttcaaatgatcttttggtttttatattgatcattcaaattttttggctagctgaaagatacgttatttacaagtgagcacgatagacattttaaggtaaaaacgatcattcgaaaaaatttcaaagaaatgatttttggcaggcgttgtcaaatttagtattttatacaaccacgtaaaattatcaaaaagttatcactcgaattttgtcaactttacatttatgtaaagtattcatatatttccattgaagggtctacgcttccaaacatgatgttttttgcaataatagagaaaaataataattattatagggttgtcaacggaagaaaaaaaatgacatttgggaaaaaaaaaattcttgcttgggagaaacgatagaagcaattatggaatacgtttaaataaacggtttttttgaataactgcgccagtgaagatgattaaagcctaaaaaaaaacagcgattttagaaactagaagaaaaaagctttgcttcttctagggctttatctgttctaagatctgatcgaaccttttgaagcctcgaaaatgctcgttctactgcggcttcagtggattgtatcaataagatctgctgtccgattattgcgaatggtctccaatttacgattgtatacaatacactgaaatatccataagacgaagtcttatcgcttggataaaatggaagctgatcgccactcaatgtgaacgaatcaataaacttgcatgaaactttttcgatatcttcatctgaataattatgcatgtgacaaatcttcgtcattcgctccaacaaactttgtaatgaaacatctgcttcaacgtttgaattttcgaggttttcatttagtacagcaaaataatcaaattcttcttcgacctcttctttttcttgtacttcaataggttcaatttcacctccggttatcattccatcaaatactaaattctcgtcaatttcaatttgattatgatcttcttctaattgcgcattaaatcgtttaatgctatttagtagcatcttgtcgttttgttcaagtttaagtttttgatttaagttactagtatccacatttctttgggcaacttcgacttcttttgcatattctcttccttgtaacgtgagatagtatgaaattctaattaattgataatcttctgtcgtttgcaatcttctgataattttattatgaatatgatcataattaaatgtcgtatcattataattattgatttcagaataaaaatcaggcaaactaagaataagtggataaatgtttgacgcagggaaatgatcttattcaattgtttttattagtctcatggaagggaataataaaagagttgtatttgaaattacatttttcagcatgaacttgatgaagcttaaatcatcatcactattgaacagatttgtattatttaatatttgtttgattttaccaattctacgaattccccattcacaaatctcaaatgtattaaaccatcttgttgaacaaaatccgggacatacttctcgcattgttgaactgattggtttggatcgaaaaattttcgaaaatctcgaaatataatcttgaatcattgacaaattgtccgattgaaatgtgtctttgatacctaatgctattgtatgtgcaaggggtgacttaaaaaatacccaaaacatacacacttttggacggttatcgactcaatttttgactttttgaactgttgtataattacaacaagaaaaaaatcaaaaattttaaaattaaaaaattctcgaaaaaataaaattatttattttaaaataataatatcaaaaacataatatatataagtagaaaatatattatatattatacattatacattatccattatccattatccattatacattatccattatatattatacatcacattatatattatacattacattatatattatacatcacattatatattatacattacattatatattatacattacaatgtctataatacattacattatatgttatacattacattatatattatacgtttcattttataaagtgtgttaaataaacaaaagttattaatataaaattaaaattaaatcattatttgcttacaaaattcaagtattattttttgtcaatctgacattttatattttatcagaattatcctgacaaaaataggaagtatccaaaaaaaaattgaataggtgatattttctcacaattcctagttatttggatactcattcaaaaatggcatcatgaaaaagaaaatttttttaaataaaatcatatacatagaatattttaataaaaataatataccaccatatgttttaacatatggagaatttgattatgatatttattttttaaaatttttttatattttttaatctgcattaattacatcaaaaattattttttcttcattatatgccataaaatatattttctacttatatatattatgtttttgatattattattttaaaataaataattttattttttcgagaattttttaattttaaaatttttgatttttttcttgttgtaattatacaacagttcaaaaagtcaaaaattgagtcgataaccgtccaaaagtgtgtatgttttgggtataaaattagacttttctatgtgcaatacatgggaaaaaaataattggataattgttctcatgcattgatgtaaactgaaatgaattttgtgattctggatcaatggctgatttttgtactggtaggttgtccgcagtgatcgatccaattgcaacgttgtatgattttaattgatcaataatattaataacaacatctttatagttctgtaaattcccaataaaatttctatttgctgaaattattagtggttctaggtctaatgctatagggtttgaaactattgctattaaataaaaaacgccatgattcatcccagcatcaatcactaaagaattaaaaggaaacaaagaatacttctgaagtgtggcctttttgttgattttcgcatattggcagaagttttttctcagtgtgtttcttgagttgaatgtaaataatgattcgatttctgcgtttggattactttggcccagctgaatacacatcctgaaatcatacatttgaggacttgatgcagcattgattgaaagatctagatatgcgattaaagagtagaattgaacatctatatttttggaaatttttgttatgcattaataattttcaagaggggaatcataggcatgtttgtgttgtgttggcttggggcgatcagtcctcattttgtatgaacattgaataactttgccatagatatttttggtatgtctacattggtaataagtatgcttttaatcagaattgatttcggtttatctcaattattcccaggtttttgacagctcaaataaacggttatctcccgggggataagatgggggaaaagtgggaggcaaagtgggagatcctcaggaatagtgggagaacaaaatcttatttaaatgccagttttcaattttgaatgataggagcaaagaattctcccacttttctcccacttttctcccataattgaaattcaactccgatacggtgagctatcgtactcgcagaacgatcaatttcctatgaatatgaggcgaccgttagaatcgagggaaaaaatttggaaagaaaaaagacactttttactagagtacgttaatactaaacgattaatgtctatacataaattccttatcgtttctcccatttctcccaccttattaaagtggggcgggagaaaaaactacaaatgggagaaatttgacaaccctaattattatttttaattccataaataatataattcacattcttcgggtatgatgaatgatgcttttggatttgaatagaaaatttttgctgtatcgtatatgtcattttttatttccatagaatatctcagccgaaattatttttattgaaacacatttgaatgagcagatattttctcacaaacatgaaaataattgaataggcattgaaaagcatgctttgtttgcatggtttacaaaatcgaaaaacccgatactttcaaggaattccttttaaatccaaaagcaccattcatcataccccattcttcataattcatataaaatccaaaaaaatcacataaatatattatggagaaaaaatctctgatctcattgctatattttttgattcataattagcaaaaatgacttgttccattatgaaaattaattttgccataactcaacgcgtttatcaaaaaaaaaaaacgcatttgataagaaattcaatattgaagtaaaacatttaaagtcatgacttttgacgccgtgaatagaaaattgaaagatcggaattttctatggaaaggaagtttttcaattcactaattcatttcataatctcttctcgcacatgacctccatattattagcattgcttacaactttccacaagtttggttctttaaatttctcggtggaaagtttccaacatgaaataacacacaatcattttattacattgttatcaaaattttcagtcatttttatcatatttatattattttcacaaagttgcatcaaatcttcccacattgctcgaaaatcaaatcattataagattataaaacaaaataatattaacattttgttttcatttttctttgttatttttttatcgcataatttttgcaagataactaactttcctggttcaccaataatcattgatgaacaaggagattttagcaaacttattaatgaagttgaaatctccaggatggtaatgctgaatattgaaggcactattacacatattgaacctttttcagctaaatcttttacaaatttagttcaagttgttgtgtatgcgtcaattgaatcgatcgattcaaaagcatttgaaggttcatccattatgaatattgaatttaaagcgactgaaaaatttaaaactattgatagctctgcttttcaaggttgttcagaattaaacatgattgtccttgaatccgttgaaacaattggtcaatatgccttccagggttgctcaaaactcacaagttttgagtcttcaactgtcaaaacaattggtcaatatgcctttaagagttgcacagaattaacttcgatagactttcaatctgctgaaacaattggtcaatatacctttaataagtgttcaaaattaaataaagtaattcttccatctgtcaaaacaattggtcaatatgcatttcagggtttatcagaatttatttcgattaattttccatatgctgaaacaattggtcaaagtgcttttcagtcttgtaaaggattaaaagaagtaggattgaattcattaattgaaatcaatgaaagtgcttttcaagattgttcttctttgaactcaataatgtttggagatagtaatttggaaataattccttctttctgttttaaagggtgttattcattaaaaagcattaattttccagatactgttactgaaattaaacatgaaatattttataaatgcaatttagaatcagttacatttggaaaaaatttagttcgaattggtaaatttgcatttcattattgcccacttaaaagcattgaattacctgatacagttcaagaaattagaaatgatgcattttcaaactgccaacaattaacatctgcaacacttggaaccagtttaaaaagtttacatgaaagggtatttcaaaattgtaatatgttacaaaacatttcagttcttaataatattgtagatattaaagatgaagcattttctctttctggattgaatacagttacatttggaaataacttagtaactctaggtcaaaatgtatttttgggttctaaattagaacacattatattgcctgatagtcttactgtaattaaattgggaacatttcaaaactgtcaaaatttggtatcagttacacttggaaataacgtagaaacaattgaatattatgtattttatgcttgcgattatttaacaaccattaaaattcctggttctgttacttcaattcaaagaaaagcatttgcattttgctctaggctaaaatgtgtttattattatggaacaaatgaaccaaattgtggtagtgatatatttttaatgtgtaatcaattccaatatgttatgacaatgaatacatataaaagtcaaacatttggtcattcatctataaaagcagcatatgaaacaattggtggatgtgacccaatgccaactgcatattttacaagttcaaattaatttactaacacatttacacaaagtaataaatttacatcatcaaatacttattcacaaagtaatacattttctcaatcaaatacttattcacaaagtaatacattttctcaatcaaatacttattcacaaagtaataaatttacatcatcaaacgcatattcacaaagtaatacattttctcaatcaaatacttattcacaaagtaatacattcactaaatcaaataacatagaaataagtactgatgcagacacaggattaatatcttcatcatctgaaataagttattctcttatattctctgaggaaattataatgaaatcatcattgattcattcagtttcattatcaatgattggttcatcatttgtaaatgtgacttatataagtgtttcgtatgaatatacaaatatacttcatacaacattatcagtttattcttcatttgttcctgaatcaaatcccaatgaacaaaatgaaaatgataataattctgcgataattgcagtcgcaatttgtgttccaattgctgcaataattattattgctataattgtaattgttattattcgtagaaagagaaaagtgatggaatcatcagaatgtaatattgaagatgaaattattagtcatgatgattcttctgaatctggtgatatgttgaagaaagaaaacatttttatataaatttatgaaaattttattggtaaaccatgatattgaaaacaattttttattttccaatttttttttataaaataaattttgataaataactttttggaaaaatgtcaaaaggatattcctcttcatatccttttattaaaaaaattaatataaaggataaaaatcggttaccttagacagaaattggtatacatacaacgtaatgatcatttttaataaaatattataagttaaaaaatcagtctaaaacaaataaacgttcttgttgctttcaatttttgacaaggtctgtggccatttaatttcactttttgtaaacacaccaatgaagattttagggaaagggtggaacatatttagatatcttggagaccttagtcacctcctttctatcttagcacttctctatcaaatgatccacaaaaagtcatgccatgggatttctttaaaaacccatattctttatttgattgttttcctttgtcgctatgttaacccagggttttttgatccccctttgtataatatagtttttaaaatattttatattctttcttcaatcttcacaattctcctgatgaaaacagttctccgcaaaacatatgatcgtagacatgatacgtttaatatattcatcgtcctcattgtttgtattccgtttgggtattttacttccatgtataaagatatcgacgaaattttatggacgtattcattatggcttgaagctttagcaatagtccctcaactttttatgctacggagaaaccagagaatcgatgtcataaccaatcattacattttctttcttggcatttatcgattcttttacgtctgtaattggatacgtaaagctgttgttaagcataaaacccaatacgtcgtgtggactacaggtattatacaaacacttttgtacgcggactttatttattattatattgtggcgtttgtgaaaggatcgagatataaattacctctgtaaaaattatcatttaaataattaattgttttgtttttaaggaaaaattattttaagattaatcattttgtttttctaatttagaaaaaattttaatttttttaacatttaagtaataatttagagctttctgtacatgtcatgtgttgatgtttgatttggtgtaattaaaattaataataatttttaaaaacattatcaaattattttccagatcgattttatttgatattattcttaatccaagatattgttttccttcagaatgaatgatatatttaaaacgtgttttactctttctgtcgctaaaagaaaaccttgttgtattgaaagaataaaactttttgatttgtttacaacgtttatccaatagaatattaactcaatttaattttgttggccaaatgaaattcaaaaaaacgcattgaaaaatgccacttttattccaaacaatgaacacaataaaaattgttctcgttggggacacaagagttggaaaaagctgccttttaagcaagtttgttcaaggatcatttgataaggatatgccagcaacaattggagcagcattttttatcaaaattattcaaacaccaaatggtaatgtccgtcttcagctttgggatacagccggacaagagcaatttcgttctttagctcctatgtattataggtcagcttctgttgctgttcttgtttttgatttgacttcaaaatcaacccttgatggactagatgaatgggctgctgaaatcttagataaagctcctccaggggtgcgacttgtcgtcattggaaataaactagatttgaaagaagaaagagtaattccagaacattctggaagggcagtagcaaataaatttggagctgtgttatacggtgaaacttctgccaaaactggtgaaggtattcaagaaatattttccaaaattgcagaactcgatatcacgaatgaggttgttcaagaagtttcaaagacttttcctgaagaaaagaaaggatgttgcgaataattaacttttatttcatcaataaattatgtgtttcaatttatcttcatctaatcatacatgttatgcgaaatcaccaaaaagttctcaaaacaaaaactcgctctaacgaagtaaacaatgtcattatagcgttatcaaagaactcacaatcttttaataacaaatattcgattccaacaaaaaataatttgtattgatttcaacatcttatttttacttttagataaaacatgcgctaaacttttttacttttcgttgctcatgggtgtttccaacgaagaaaattttattgtagaatatctttgctattgatgaaaatggcaccttttgacttcatttcatcaattgctgcctgagaattgctttgatctactgcagcaattccatcttctatcacaaagaccttatatccaagtgacaaaccatcaataacagatgacttcacgcaaaaatctgttgcaacaccaagcacgtaaagcgttttcacgccaagcttttgtatttgttctgatgcatttgtttgactggatttaaccacatcaaagaaacaactataagaatcaatttcaggggaacatcctttgactacaaaaagatcatcttgatgaacatctaaatcgggatgaattttagctccttctgaattttggacgcaatgagctggaaataatacttgcttatataacgatgtttcaatgatatcaccagcgctatgtccagggtgactgcttacaaagctgacgtgattcgatggatgccaatcttgtgtccacatgacatgcttaaaatgtgaacgtagcctattaataacaggaattatgttcatagcacttgctactgaaaggctccctgtagggctaacgaaatcattttgcatatcaattacaagaagaagagaatcttccatcgagaaaaatattgcgtaaaagtgacatgcacaagaatttaacggtcgattttatggtaactttttggtggaattgccgataggttaaatttttgaataacgatcactaaatccacaatttaatacatacaaatatttaaggctcaaaatggcaaaaatatgtatgttgccatttaggaattcaaaaaatcgatgaaaaatttgtggggctaaaggaaaagctttgcatcaaaatatcgtaaaaaatatttaaaataaagtaattgagaaatgttaaaaaaattcgaaacaaaaattcaattgcaaatcgcatattatgaatttataaaatataaaatatatatatactaacattatttatttaatgcaagaaaattatattcgaatataataataataagtaataataagaaaaatatatttggaaacaggtttttcatgttccaacttctcatgtcttttttatgctttttgatcgtatttataataaacatttttatttccgaatcaattattaatttactaaaataatatggtaacatcaactgaaattattatattgttcattatatttcaaaatcaattttcatgattttttgattttaaaatgaatcaatattaactgaatattaatcaaaattaatgaaaaatttaaatatatcatcttattttaaaaaatgtaagagagagatttcaactttttaatttaaagtgaaattgattatctatcagaacaatattttttcggtggcgaccgtttggagtacaaccttaaaaatttttatcaatagcctaataacgcccatttaatggatgtgcttaacttattttttctttaacatttaatttttgaaccaaatttcttatgcatgaattttttccaaccatttaatagattatcctaaaagaaacttatctttagtagaaaaaaaaaagtaacaaaaacaactcagataaaaagtatggtgcttgtatcatattattttattcaaacggtctattgtgggtttttattcatttgaataattctgaagagtttaaataactttaaaaagtctaaaacatataactatcaattcctttttgttcaagaagtaactgaactatttctgtatgacccttttcatatgctttaataagagcggtataaaactatttaaataatttccaaataatattttgaaatattaaattattaaaataaatttttaataaaacaagaaaatatctttagcattaatatcaattccttcttgttcaagaagtaatttgactatttctgtatgaccatttaaagatgcattaataagtgctgtccaaaataatttaaataattttcaaataatattttgaaatattaaattattaaaataaattttaaataaaacaaataaatatctttagcattaacatcaattccatcttgttcaagaagtaatttaactatttctgtttgaccatatatagatgcaaacataagtgctgttttaaataatttaaataatttccaaatattcttttggaataagaaattattaaaataaatatcaaataaaataaataaacaccaaataaaagaaataaatatctttagcattaatatcaattcctttttgttcaagaagtaatttaactatttctatatgaccatatttaggtgcaaacataagtgctgttttaaataatttaaataatttccaaatattcttttggaataccaaattattaaaataaatcataaataaaacaaataaatatctttagtattaatatcaattccttcttgttcaagaagtaatttaactgtttctgtatttccattttcagatgcacgcataagtgctgttctaaataatttaaataatttccaaatattattttgaaataagaaattattaaaacaaatttcaagtaaaacaaataaatatctttagcattaatatcaattcctttatgttcaagaagtaatttaactatttctgtataacctttttcagatgcataaataagtgctgtccaaaataatttaaataatttccaaataatattttgaaatccaaaattattaaaataaatattaaataaaataaataaatattaaataaaacaaataaatatctttagcattaatatcaattcctttatgttcaagaagtaatttaactttttctatatcaccttttatagttgcccaaataagtggtgtattaaataatttaaataatttccaaatattattttataatatcaaattattataataaattttaaataaaagaaataaatatctttagcattaatatcaattcctttatgttcaagaagtaatttaactttttctatatcaccttttatagttgcccaaataagtggtgtattaaataatttaaataatttccaaatattattttataatatcaaattattataataaattttaaataaaagaaataaatatctttagcattaatatcaattcctttatgttcaagaagtaatttaactgtttctatgtgaccatttaaaaatgcacacataagtgctgttttaaataatttaaataatttccaaatattattttataatatcaaattattataataaactttaaataaaacaaataaatatttttagcattaatatcaatacctttatgttcaagaagtaatttaactgtttctgtattatcatttgaagatgcttcaataagtgctgtattaaataatttaaataatttccaaatattattttgaaataagaaattattaaaataaatatcaaataaaataaataaatatttttagcattaatatcaattcctttttgttcaagaagtaatttaactatttctgtataacctttttcagatgctctaataagtgctgtattaaataatttaaataatttccaaataatattttgaaataagaaattattaaaataaatttttaataaaacaaatgaatatttttagcattaatataaattcctttttgttcaagaagtaatttaactatttctatatgaccttttgaagctgctaacattagaggtgtattaaataatttaaataatttccaattattattttgaactatcaaattattaaaataaacatcaaataaaacaaatgaatatttttagcattaacataaattcttttttgttcaagaagtaatttaactatttctatatgaccatttaaagttgctaacattagaggtgtattaaataatttaaataattaccaattattattttgaaataaaaaattattaaaataaatattaaataaaagaaataaatatttttagtattaattttaattctttcttgttcaagaagtgatttaatgatttttgtatgacctttttcagaagctctcataagaaaagtttgaaataatttaaataatttaaataattttctctcttttgatttaatatattaatatatttactattaattaagtaattaaaaaattctttatttacagctgcaacacaataaatttgctcgatatttattgaaattggatttttttcatagagatattggaaaatgaaaagattgcctaaaacaattgatgtaatgatcaaagaatcatagatactcataccttcctttacaaaaaatgaaaggatttcaaagttattgaataatatacaattctttcctaattcttttaaattataaatttcaacaattttattatcataaagataatgaaagatttcatttctatgaaattcaattgctgcttcatatgcattttgaaatgatgaatgattttgttcacataaatgaataatttcttcatttcctcctgcaactgcatatttacctgtattttttacattagcttcattaataagtaaatatctaaaacatttaactgacccaaaaaacgctgcataatcaattaatgtaacactcgaattgttaataaatgaacatctttcataaagtgatggttcaattctttgattaaaatcaaattcttcttttgatgatatttcttgaaatttttctatttcatcatttcgaattatttttgcaatttcatttggattaactccttctttaatcaattgcttatgaagctcccaatcattctttgatagttcttcataattatcgtaaaaatatttggtataataattttgttcaatgattttatcatttgacgtatgatgtacaaaaaaatatgatgttgttatgcttttacataaatttggttcaattaattcgtttataatcattttttctaaaagaaaaaatgattcgtttgtactagttgaaattaaaaaacaagcaaaaacatctctaaatatgtcatatgatgtgttatatcgttctttttcttttaattcaagtttttttaaaaattcgaaacatattttatcagaatattttgttgtataatacacattatatacatttgaacatataattaaattaaatgaatatggaaattcttgattaaaatatgttaaagaagactcaacagattcatcaatattttcatcatttaaattgaaaatgatttgttcaacagattgtaatatttgtaaattttcatcgtattgatttgtcccactctgagaagaacccataaagaaatgtcccgaaaacgtgattttcaggggggttgataacaaaacgataataaccgtacaaaattaacggccaacctggtttttttgtatagtttatgcaattctttcaatagtctgttaggttacatcgtggttatgtaaaaccgtttttacactcataattgtgaggtttacatggttcccactcaattttgaaaggccaaatggaaaccaccatttttcagagcaaaaccgcacgaatgattgatcaaaatgagtaacgaagattgcccagttgtcgcaacattcttctcattccttggcgttgcaattgcgctcgctttcacagcaattggatccggatatggtacagctaaatcagctattggcgtttttgctgtttgttcaatgcatcctgaatttatctaccgtggtttgatgccaatcattatggctggtattgttggtatttatggtttagttactgctgttatcattgctccaagtgttaggcccccatatccacttttcagaggttatgcaaatcttgcaggtggcctttcagttgctttaaccggtcttgcttcaggtatgtgcattggtgttgccggtgatgctgctgctcgtgctatggctgaacaaccacgtttgatcatgggcgctatgcttattctcattttcggtgaagttcttggtctttatggcttcattgtctcaatcatcttgagcacaaaaactgctccatgcgaataagctctcatcatttgaaataaaaacaaaaacaaaagattattttcaaacattcgcattaaattaacggcctctcacggtcaaattttttgacgatacgttcaaccgtttatttgttttttgaggtacttcaactcccaaaaaacagatttttttcttcttttttcattacatatgtaagcattccatgaattatacaataatttatattttaaatcaaaaaattttataaactcatgaaatatattttttaatcattttttttaaaaaatttattttttccagtcattcattattaacttatgatggatttcatattgtattgatttgagaacttgaaactcaccaggaataaaaattaatacaaatttttttttcttccattttttaaaaaattgatgtgaaaaattatataaagtggcgacctggtttattttaaatatttatttttaggataacttagaatcgttgttttataaattatcaatataaattttattgaaatcgaataaataaaaatattttattatcggaaaagtgtagtattttccaaaatattcattttttgcaaaaaataatatattataaacattataaccaacacaataactattagaatacctagttatttttgttaaaaattaaatgagaagatgaaacaaactcattttcgatttttcattatttcggataaattttttgataaatattttgtaaatctaattatattaatatattcaagtatgaaataataaactttatgtcttattaaaatatattggcataatccaaagatattatcatttttaattttgttctaacaataagcggttatataacccacccctgttcctacttgctagccgaccaattaatgatagaaattaacagggaattgagatattcattttggggtttcatatgttcatcattttctgacattatcagttcaaaaaaattatcatgaatcaacaaaatgaatatagaaatcaaaatgaatttgaaacacttctattaattaaacaaataatatttaatttaaacaaagaaaatattacacaatcagcaagtttgatattgaaaaaatataatgaaaaccacatatattctttgaatattataataagtcaaataatatattcattttttgttgcaagaataaatcgttttgatatatatattggttttatgaaagaaattaaaaaccttgaagatgaaaatatcaaaatatttgaaatatttgcaaaatttcttataaataaaaatacacaagaagcaaattatattcttaataacttgattaaaaacaatttagttaaatcaacaattcttcaaaataaaatcaaaccatattttatacattatgtttccaacgaagaaattgatgaattcatcaaaaattcgaaatatcaaagatttattgatcaaattacagaaaattatgaagaactttcaaagaatgattgggaacttcataagaaatatgttgaagaaggagttaatccaaatgaaattgcgaaaataattcgaaatgatgaaatagaaaaacttcaagaaatatcatcactaaatgattttgattttaaccagaaaattaaaccatcaatttatgaaagatattcatttattaataaagaagatatttcattaattaactttgcagcattttttggatcaattaaatgttttaaatatttacttatgaataatgcaaatataaatgatacaggaaaatatgcaatagcaggtggaaatcttgaaataattcatttatgtgaacaaaatcattcaacatttgaaaaagtttataaaacagcaattaaatttcatcgaaatgacgtctttaaatatatttatgaaaataaaattaaaaacattaaaaaactcaagaagttagggaaggaatgcgttttatatcataattacgaaattttattatttttacaagaagaaggaatgaaaatcaaagatcctattattaatgaatcagcgagaactggtaatatttttctaataaaacattttctaaaaacaaaaaaactttcagatagcatcttaattttttctgcagaatcaggaaatgttgaacttgtagaacatatcatacagcaaaaaggaattaatgtgattataaaaaatatttatttcatgtttcattataacatttgaagttttttcatatcatttcaaaaagcatttattaaagcatctgaaaaaggaaacatagaaattgttaaactatttattgagcaagaaggaattgatatcaacataattgatatttattttcttcgtttagtattttttggaataatttggatttttttcataagaaattttacagcattgatatattcatctcaaaatggtcatactgaaatagttaaattacttcttgaacaaaaaggaattgatgttaatactaaaaatattcatttgtttgattgaaaatttattgtaatattttgatatacaaaaataatgtttggaaattcttttaaatatttgaaacagctcttatgattgcatctagtaaaggatatatagaaatagttaaattacttcttgaacaaaaaggaattgatatcaatgctcaaaatatttatttgttttatttaagttttgtttcaattttttgatgtatcataataatatttggaaattattcaaattatttagaacagcacttatttatgcatcttcgttcggaaatgttaaaatctttaaattacttcttgaacaaaaaggaattgacgttaatataaaagatatttatttattttatttcatatttatttttaatgttttggatcttaaaataacattcggaaattattcaaattatttgaaactgtactcacttttgcaacttcaaacaataatatagaaatagttaaattgcttctcgaaaaaaaagaaattaatgttaatgtaaaaaatatttatatattttattgaaaatttattttattaatatgatatttcaacaaaatatttggaaattctttaaaatatttgaaacagcatttatgattgcaacaagtaaaggatatggagaaataatgaaattgcttcttgaacaaaaaggaattgatactaaaagtatttatatattttattgataatttattttaataatatgatattttaacataatgtttggaaattgtttaaattatttgaaacagaacttataaaagcatctcaaaatggatatttagaagtagttaaattacttcttgcacaaaaaagaattgatattaatgctaaagatatttatttgttttatttaaaatttattataataatttgatattataaaataatatttggaaattatttaaattttttaaaacagcacttatgtgtgcatttttaaatggtcacatagaaacagttaaattacttcttgaacaaaaaggaattgatattaatgctaaagatatttatttgttttatttaaattttattttaatgatccaatatttcaaaataatatttggaaattatttaaattattttggacagcacttatgtgggcatctgaaaatggtcatacagaaatagttaaattacttcttgaacataaaggaattgatattaatgctaaagatatttaaatgttttatttgatatttattttaataattttatgtcacaaaataatatttggaaattatttaaaatatttcaaacagcacttatgattgcttctagaaatggtcatacagaaacagttaaattgcttcttgaacaaaaaggaattgatgttaatgctaaagatatttatttgttttatttaatatttattttactaattttggatatcaaaataatattcggaaatgatttcaattattttggacagcactttttgaagcatctgacatcggaagttcaaaaatagttaaattacttcttaaacagaaaggaattgatgttaatgctaaagatatttatttgttttatttaatatttatttttataatgtacaatttcaaaataatatttggtaattatttcgattttttttgacagcatttatggttgcatcaaaacagtgcaacatggatgtaattgaattacttcttgaacaaaaaggaattgatgttaacgtttttgatatttattgattttatttgatatttgttttaacaatttgttatttcattatatttgaaaattatataaattattttctacagcattttttgttgcatctcaaaattacactgcaagatctcaattactttttaaacaaaaatttaactacaaagatatttatttttttgatttgatatttattttaatgttttcgatcttcaagtagctattcagagtaaaaataattcatgccaaaatgaaatgataccaaatcccaaagtttagtaccatcaataaaaaatcatctattttaaaaatatttttttaagtaaatatatgcaaactttaatattgccatataatataaaatttgaatttataagaaaattttatctgatcattttctttctgattatcaaaaaaataaaaaagttctaaataaaaaataagtaatttgataacagcaagacacatcaagttaaaaaagttacaaaaaaataagcagagacataatgtaatttacttaaaatttgtaacttgaattctctacaatagaaaccgtttattaattttgcacactcagacatgttatgtaaaatgtaatgtccaacgaagaagaagaatttaacaatgaagaagaagaatttggcggtgatgaggtcgttattgatggtgatgacggagagattgtatttgatgaaccacaagaatctcaaatagacgatacacaaattgacgaagaaagacaaaaaagagaagaagatgaaagagttaaagaagaacttgtaaaaagatttaaccctactacaggagccgctcgtaggttaatcaatgatctcaagattatgatggatagtaatccaaaagaacttgggttctcctgtcaacctaaaaacgaggatattttcacatgggaagtaaggctttttggttttgaaaaaggaactccaatgatgaaagatattgaaaaatatcaaaaacaaacaggaagagattatgttgaacttagcgtaacttttcctccagactatccaatcaatcccccatttgtccgagttgtaagaccacgattcgttccaagaactggaagagtaactgcaggcggctctttgtgtacagatattttaacatcggaatcatggaatccaatgtacggaatagatagtttgatggttaatattctttctgaaattttgaatggaaatcctcgaattgatttcactcgaaatgatccatactctttggaggaagcaagagctgcataccaaagagttgctagcgatcatggatggagagttccaaaatggatgcccaataaataacatatttaataagaatgtcaacttttttaacaggcttattgaaagcagaaggtatgaagtatgtgcatttaattggtagatataaattattgttatattttaataaatattaaaatgggatcaaaaataaattaggctcgagaaagttgctatgttgaacttttactattttaaccaatcaaaaatagctttgcttgttcatctggatccagaaaaaacaaaaaaataatcagagaacgttaacaacagttaaatttttatgtacgtttagataaaaagaattttgatgtttcccaactatatacctggatttactttcattaaacaattagggaaaggatcttatggtgccgtctataaagttaagcgaattcaagataatcaaaattatgcattaaaaatagttgatcttagatctcttaatcaaatacaaagagaagaatctgtaaatgagattaggattctagcttctgtacattcaccttttattataggttttcatgaagcatcaatatataacaaaaaattatgcattgtaactgaatatggaaagttaggagatctttctcatgcaatttcaagaagaaaagccaaacgtagacctttcaaagaagacgaaatatggagatttctacttcaatctctccatggtctccaagttcttcacaacagaggcattattcatcgagacattaaaagcgctaacattttaatgtgtgctccagacctttttaaaattggtgatcttgggatatcaacagttctcaagcagcatcgacttgccaaaactcaaattggtactccgatttatttagctccagaaatctggaagaaaaagccatacaacgacaagtgtgatgtatggagtcttggtgtagtactttatgaaatggcaactttcacatttccatacaatggttccacaatgcgcgaactccaacaaaaggtatgtaattcaagaattccacgtttaccgaattattattctaaagatctctctgatattatacacttaatgctccgtcaaaatccagcgcttcgaccaaatgtctcagagctattagcaatgcctatcatcaattcacgcatgagtttaataacgccatttttaaatgctgtttcaaggagtgatgcaaatcttattgaaactattcgagttccacaaaatctacaatatatccattttcctgttccgagatatcaaaaggatgaatgtgtttcaatagacaaaagacttcatgcaaagggtaaaatggttaacttaaatttaaatagagcatcaacaagagaattacaaatgatcgcagacttggaccaatggagcccaacaaaaaataaggaaattgtaatgggtaatgaaaacatgggaaataatttaaatatggaaaatgatttttgtatcaaaaagaatgaggaacaaatggaaccaaaaaaggtacaaatgaagccaaggcctccaccaaggccgcctaatagagcaaacccaagaaaaaggagaattcttgctgcacagccaaaaaatgttaagcaaatgccagcgcgaatacgaccgcagagaccacctttgataatttggtgatttattttggaaatactaaaaatgttgtagttggttgatatgttgttctgtttaagtgcttggttcagtaagcaaatctttgttgtggatcgaaatttgctaaaaaaaaaaacaaaaaattaattccgatacggggagtcgaaccccgctcccgtggatgaaaaccacatatcctaaccgatgaacgatatcggaacctgaatattacttattaatataatagaatattataatgtatcaaaagtttaatcaaaatatcacacattgtgtattgacacataaataaatgaaattatatataataaatatttttgaaaatatcaactaaaatgatgaaatattgtatgcattagaccataaaaaaaatgaaagaaagaaattattgagtacttcctatacagaagtatctcacttcaagaaaaaccaatgaatatttcagaacggaaaataatcgtacacagaataagaaagatcttgtcacatcacatcatgtgaataattaccatattgagctattctatatgaatacaaaacgattaaaaacaattcaattatacaaaaatgaaacttaaaatgaatagagaggaatggatataagagataaaatgaaataaataacatcaaaatattttaaaaaatatttaaaataaactaatagagagatattggagaaattttgaaaaaaattttcaattgtaaattacaagataacatcataatattatcatattattctttaaatttaaaatatatataccaatgttatttatttaatgcaagaaaattatatttgaatgtaaataataataagaaaaatatatttgaaaacaggtttttcttgttccaactttttaggtcttttctatgctttttgatcgtattttcttgttataaacatttttatctccaaatcaaataataatttactaaaatagcatcgtagcatcaattgaaattattatgttgtttattatatttcaaaatcaattttcatgatttcgtgattttaaaatgaatagaactcaatattaactgaatataaatcaaaattaataaaaatttaaatatatcatataattctaaaaaatgtaatagagagatttttcaattttttaatttaaagtgaaattgattatctatcataaaaaaattagaattaaaataatgaagtatttaacaaagagcattaataaatataatttttttcggtttacaaattaaaattataaatgtgcattgatttattaacaaaacaatattttttcggtggcgaccgtttggagtacaaccttaaaataattgtttggaaacaatttgttgaaatgatgactgttaaaagtcacaaatgataaaaatggtatgaatttatttattacttatgaaaatttatcttaaaagtaccaaagaacaaatccatagtatagaagacatttcgtttatgtgttgttaatgaaaatgttttaatttgaatatgttttaatatatatttaaagatgtaaaatgaattatatccatgttccatgtccaaattcataatacatttattaattcttcaacaaaaaattcattttgttctagatttgttgatgaactttttggggtttcggaagaaacacttgaattcaagtactttgaagaaaaaacataataattccaacaataataagtcttaataatagtgtatctaatacaatgctgatcaaaagatatttttctattttattattttcttctgattttcaagtttattaggtaaattagtctaatatatataatgtgttgaatattgatggattttattttcatatgaaataaaatcggaatatacataaaaatatgttgaattaaagaatgaaatactaattgttttggaaatgattgtttgtgtatcagaatattttaaaatattgtttgaataaatgttacaccaaattttaaagaagcgggaaaagtattacttttgtggaaatgtatttgattgtgtaaatgaattggaaaatatatctgattttggaaatgcatttgattgtgtaaatgcatacgttggctaaaaaattattactttggatttaataccatgttattcgtataaaaatgaaataaatatgacttgaattttttttatagttaaaaataactttataaaatgtaacataaaaataattcttattgtattgataataattatataatgaaaataatacatattaaattaattaagaggagagatacttttatttaaataatttttgatgatagaaatcctccaaaaaatatatcattattattttttccattttttcactatactataaaattatatcttcaagcataattatattttttgcaagcacattgacatttattatcaaatctaaatcttatatcaacattcaaaaattaggttttcctaaagttaaacatcccattttgaaaacatataagtttatcacaaattattttattttatattccattcacattaaatattattaatattttcatgtgttctcttctttttctttatatgcttcataaaatcgaatgcaatgaacatattaatgaaataacaaatcccaaaaacccagcattgttcattgatgaagaatggacccaagaaatcctacaaggtaacctcatgaaaatttcaattggtaaaaatattaataaaattgctaaaaaagctttttatggaaagaatctggtaatagagattgacatgagtagatcacaagtagaaataatcgatcaagaagcatttcgattttgttctaatctcaagaaattcatgggttgtagtagcttaatgttaattaaagaatatgcatttgattcatgcattaacttagaaactattgaaggaattaataatgtcgagttaatattagattatgcattttgcggaacaaaaatagctcaaattaatttaggaaagaatatacaagatttccaaaaatcggcatttaaacaatgtaatcacttagaaaatatatatgtttcaagtatgtatttttcaaatattaatgatgatggaattgtttatagtcttcatgccagtatagtttatttctttccaccaagaaaaggtggtgtaattacatttgcaaaaaatgttgaatctatttctcgttatgcatttaataattgttatttggttaaaggaatatgtataccagatattcgtaacatttgtgatagagcatttataaattgcaataacttgaaatatattcacttcggaccaaatcttcttgttatcgaacctttggcttttattggtatttttaatttacatgtgttttattctggtgaagcggtaccaaatgttgcaattaatgcttttgatgaagcaataaaagtatttacttgggaaaattactctgcaaacatttttggcccatatcaagtaataaaagtaaagaaattaaattctttccacaagatgttctttggagaaaaattttgtcactgcggaataaagggaaaacgaaacacagaaggtgtatttagaagaacactcagaaggttttctcagaggagaaggagaaatgaaaaccaaacataaacaaaccaataaagatttatcaataacattatttttttcagaacacgtaaatgcctgagatttgtttgaaaacatatatgtcataatatgtgaattatttaaggataaatgatacatctctcttaatttacataaagaaaataattttatttctcttatttctaatattcgtctcatttctgtgtcattattttttttttgttgtaattttttatgttaataaaatttgatttatattcgattaatatactcacttttagatatgaaatcaaaatggtttaattattcttgttttgtcaatatatctagtttattaacatattgaaagtagctttaagaacgatcacatttaaaaagttaatattgaatagtttacataatgttcatttctttgatgttatagatttagcagaacaaacgcgcgttactggaattaatgatggattacaagtaaaagagttcacacccatttcatgaagcaatttcatagaatcaatatcactatacatatcattaattacattaatttccagctcattgttctgtttctttgcatttgatatgcagtctttaataagttgtccaacactttctttctcaattgttgaaaaataattttcgtttagaattcctaattttaaataatcgtttaaaaattgtgaatttttatcacaagaacacattaactgtgtaatatttgttgggttaattacaatgaaatttacatcttttgcaatatttgcagacattaaacaagaattaggtgaagaaatctctgcaccaacttcaacattgttacttttattaatttttttcatttcttttttaaattgttcgatttctttcttaaatattacatttggtaataaaatttttacttttgttttgtcgttaattttatttatttcgtttaatattgaatttaattgtatttttaataaatcgttttgtattaaattcatttgaatgtttgatataccaaaaaattcattttcgacattttcttttccgaattttaaaatttcttcttttttatcaatgattttatcttcgttcgaatcctcttcttcattaaattcttttttagctttaagtttaccaatttcttctgccaaatcaaataaatttggtgtaaaagaacttggatttaaagcaaataattttataataattacttttaatgaattattatttgatacaaaaatatcattaaaaaattttattattatttcttccatctttttaagcgctgattctcttcttttaccatataaagaacgaactaaaacagaatattttcctttaaaaatcgattcgattggtaataaaccaattccatcataaccaaattgttttgctttattaatatcatcaattttattaaatatggaataaattcgaatgttttcttttttacggattttatcagaccatttaaggatttcattcacattttcgtttttaatttcatttacattttcaagattcatttccccaatatatattttcccatctcctgaaatagttatagtatcaccttctttaataactttatccccaaatgtaatagtttttaatttatagtcaattcttatattaccacaaccaattacagctgttttacctagttttctagttattaaaacagcgaatgatgaatttgttcctttgtttgtaataatcgcgtcacttttgagtattgtagtcaaatctgtgggatataatttattggtaacaaaaataatatttttttcatcttttatgttagaattaatataaacttttcctattattggtttatttaaagaagaaattccgctactaatataatttgaatttgatattattgtatcatttaatacttgttgaatatcttcatttttaagtattaaaatcgattgttctttagtgataattttggatttgaccatatcatttaacgctttaaatttagcatcaaatttaaataaaacttcttttgtttgaacaacaaaaattttttcttgatcaataacaaaatcaattgtttgaggaattttaaaataattttcgattttccttgaaatggtttcaatttcttttattaattttgtaggaattaatgtcttaagtgttttataatcaatgattttggagtttgactcacgaatatctgaaatcgttgagttcattgatgcttcgcaataaaattcatttgttccatcatttggatttcgagtagaaatgattgcactaaaacaatttttccctttgttcccaaaaaccatttctgtacaaatgatttttggattataacaatttggaaataatgttttagacattcgatataatgatgtaataatattacgtaattgttcaataggattttgtggaaattgtttccctgttttacgcattattatagatttataaagcttggtgatttcgatccaatcaatagaagtaaattcattcgtagtttcataatttcgtgattgtttatattgctcaaaaagttcatcaaatgattcaactggaattttgaaaacaattgtcccatacccttggataagacttctatacgagtcatatacaaaacttcgatcgtttgtttgctgtgaaagagttcgggcagttatatcatttaaacctatatttggtatagaatttaatatatttgaaactgatcctaaaaaatcatatttacaacaaagaagaagtggattatcgcttgttccaaatgttgatttagaatctttttcaatgcgctttaatgcatgaagtatttcttcccatgctttgtctgaaatatggatttctgtgttggacatttcattgaatgctgttgatgaaataacaaaaccatttgggatatttatgcctaatgattttatttctgataaattcgcaacatcttctccaagttcttgaattaggtttttacgagaaccatatttcttctctagttctcggaaattatccaataattgaacgaatttacccatatttctaacgttttcttgggtaccctatatgagaaaaaatgtcttcaagcgaagaaagaatagctattgttaaagaaagacttaatcaaaaagaagtaaaagaaccacttctcgaaaggttcttaagatatgttaaaattcatactacaagcgattcatcacaaactaaaaaaccatcaactgaaaggcaatttgtattaggaaatctactcttagaagagcttcgttctttaggtgttcaagaagtttcaattgatgagcattgttatgttataggaaaaatccctgcaacaaaaggatatgaaaacgttccttcaatagctttcatgtctcatattgacacgtcagaggattgttcaggtgaaaatgtcaaaccacaaattcacgaaaattatgatggattttcaattattgaagttggtcatggaatttttattgatcctcaaacaacaccacaaatcactaaatgcattggagatacaataattaccagtgatggaacaacacttttaggtggtgatgataaatgtggtatttctgaaatcatgacagctgttgattatatactcaatatctcaccatttccacacggtcctattgaggttatttttagttctgatgaagaaatcgggcgtggtactctttattttccaattgaaaaaatttcctcaaaatttggatataccattgatggtgacttggaaggtaattatagctatgagaatttcaatgctatcacagccaagcttacatttcatggtttcacatgtcatcctggagatgcatatcacaaattaataaacgctaattttatggcgtccgcatttgtctcgatgctcccaacgaatgagcttccagagagcacctttggcaaggacggattcttctttgtgaaaaatatagatggaaatgttgaaacagcaaatgtaacactttttattagggattttgaggaagaaggaatcaaatcaagaatagaaaatttagaactatttgctaaagcagttgaggctaaatttaagggaggaaaagttgatatgcaactggatagaacagggtcaaatatgtataatgctatgaaaaaggatatgagagttgttcggttccttgaaaaagcaatgtgcaacgttggtatagttccgagtgttgaggctattagaggaggaactgatggatctagattgtccacgaattacggaattttgactccaaacattttcacaggaagtgataacatccactctaaggctgaatttgcttgcttgggtcagatggtgggagttgtgagaataattatcgaattaatcaagatctgggctgaaaataaagagatataaaatacatgattcatataattgttactaaatctatttgataatttttctattcaattcacttttactgtgagtagtattttactatttactattttactgtaattaatatttaatatggaattaatctgtgttttaattagagggtttcttttgtcactttttctaaagagcacgtttacgaactggtttgaaacgtacaaaaaatgaacaatttcgttatcctttttccacaggagtgcgacaaattcacggatttgttggaacaaataggagaaaaaggagcaaatttatataaagcatttcagtgcggggcaccagttccaaatggattaattattacaaaagaagcttttcaaaattataaatcattaggaaaaataagtgatgatttatggaagcaagttcaagataaaattcaaatgttagaagatcaattaggaaaatcttttacaaatgaagaaaatcctttaattatttcatgtagaacaagttcagggactatgaactccattttaaatcttggttataatgataagacatttgaaaagatttcttcaaataaagaaaatcaagattttgcttataacaactacataaatcttattgaaacttatgggtgcgaagttatgcatatttttaaagataaatttaccgaaataattgattcaattaaagctgaagaagaagaagacatttcaactgagtaccttttagttaccaacaagcttaaagaaatgattttaaaagaaacagaacaagaattcccacaaaatccatttgatcagctttacaatacaatttcacatattttttcatctctagcttctgaaaataaatcagattcgattctccttatgcccatgatatatggcgatctcaatgactcgtcttgttctggaattgttttttctcgaaatccattaaacggtcaacaatcaatttatggcacttttgctctatcggtttcgaatcatgaacttaaaaacaaacgaaaagaacaattacaaattaatgaacttaaaaagactaatgttgatttatatgaaaaacttaatgatattcttaaaaatctcgaaaaacattttaaaaatgttgttaaagctgattttgcaattgaaaatgacaaaatttggattctaaatgttcataaagcgaaacattatccacaatcatcttgtaaaatagcaattgatttatttaatgaaggcgtcttaacaaaaaaagaagcgcttgaatcgattgatataaatgatattgaagttattttacagccatattttgaagcagatgaaatcaaaacgtttaaaaacaaaattattattcgaaagcaatttccacaaaaacggaaatttttttctatttgtgcacctgtttgtttaacaatcgaaaaagccgaagaaatggaagaaaacgaaatcgattttatttatattgctgaagattttactgatgaattaaatacattttcttttatgaaaggaataatcattaaaaatgattgtgaattattatttgattttccattttttgtcggaattaattacattgaatttgattatgatgaaataagtgtaaaaattggagaaaatgaatttcatgaagatgacgttctttcgattgatggaatcgatggcactgtatataatggaactatgcaagtaaaaactatttctgataaactcataaatgaacttacgaatatatctaaagatattacgcaaaatgattttcctaattcttcacttcttatttattcgaatgcattaagttccgatgatattcaagaagcattttctaataacgccgaaggaattggatattatgatataacaaatgaatttatattaaacgagaaaaccgaaattataaaacagattttaattgcagaatatgaagaagaaaaagaagatgcattaaatgattttgaagaatcattagaatcaatttttttatcagttttcgattcttttaatgaagaaatcggttatattaatgtcggcgattttcagccgaaatattttcttccaaatgtattagaacttatcgaagagatttcgaaattaaaaacttattctgaacttggcgatgaaatagatgaagaagaacttaaagagaatgagcgaatattaacaattactaaaaaatattatgaaattaatccaatgattggaatgagaggcattcgatttagtatttgtgttaaaggatttttaaaggcgcaaattaatgcatttgttaaatcggcatataatactgttgaaaaaggaatacaattcattccaaatttaatgattccatttgtatcttctgaacaagaaattgaaattgtacaaaaagaattaaattcagctatttcgataatcgggaaacaatatgatttagaagaaccaattaaatttaatttgggtatatcaatagatacacctcgagcaataatgtacatggataaaattgctgaaaaaataaattttttggtgtttaatataaataatttgtatgaaatgttgtccggaatttcgaaagaagaaatggaaaataaattaataaaaaaatatcgtcaattaggaattgtttcgcattcaccttataacggaattgattttgatacaatcggaaaattgatcgaagtcggaattatgaaagctaaaagcgtaaacaataatataataattggaatttcaggtgacttcgcagataatgtgaaggcattaaagttctgtcaaagagtcggaattaattttatatcaattcctccttctgaaatacaaattgcaacaattattgcaacaaatttacttttacatagagagtgatgtattattaaaatgttataattaatagagagatatatttaataaataaattttgtatttgatttatttttcttattttgtttgcaaatcatataaaaatttgtgttttttactcatagatgtagaaacaaaaatatttgaaatttattttcagaaaaagtctttccaaataacaagtcgttacgcagaacttttatcaaaaataatttttgttaagtcaactattggaaattgaatcacacaaagatatcttaaaaatcatgtttaccacaaagtaatttaactatttctgtatgacctttttgagatgcattcataaatgctgtttcaaataatataaatcatttccaaattttgatttgaagtataaaattaccaaaataaataataaataaaacaaataaatatcagttttccatatagccattatcaaatggtaatgtaagtgctcttcttaataattaaaattactttttaatatcaaatagaaacattatattattatatttgattttaaatataatagaaaagtatcttgataattatcattaaacctgattgttttttgttcaagcaaaaaattaaatattttaaaatcattaaatatatactaaataaaaaggaaccctcataagaataatgattttgttaacataaatgaatgatatcttccgccttgattttttctaaaatacgataaaaaatatcgaaaatgatgatgattttttgagaaattacgatttttggaattcagccaaaccaagttaattcaagatatttgattttgacaatgtttgtttagatttattctttctaaatgctaattccagttcgctgcttttcatgcggccgcatgatagccaacaaatggaagccatactctgagcttcttagaagtggtgtttctgtagctgatgctcttaatcaacttggtattattcgattttgttgcagaagaatgttcattacgcatgctgatttaatagacaggatgattgaatattcacacccgtatattccagatgaagcatttggaaattagttcatttttaattttttttttgtaaattaactttttcgaatctcttattattttcaagtaaacttctatgagatgcagtaattcttgtttcctaaagatctcacatatgttttatcatcataataagaattctgatatcgatatttaaattttgcaaaatacaaatttgttttattgctttttccacttcaaaatataatcgaaagaagaatttatttcattatcaaacgtttattcaaagttattttcaacatctataccattattatcgtcttgtgttaattcttccacgaactttaagaagtggtttggtcggtgttcttggctaaagaatggcaaaggatgacctaattcaatttcataatttggagaatttgccaatttcaatgacataaagttcaaattccattctacgcctgaaggaaccataaaccatccgctataattttctgtcaaaacgattggaattctatggaagaaagtatcttcaaatcccactggtctatctttagtgtctttgttattgataccccattcgtaaccaggttcattaagttggaagcctcttatgacacaagatcctggaggatatgaaattacaattgtagaaaatagaggcttatcaatgatttcgtcctcattttcaggatcgctaattattgatgttgcacaaattgcatcatttggtgacattaaaggatcatcaatagccattgtatgaatccatccaacaggtttaagatcattcatattcaaaagttcatttccctttggtaagttatgatggaagtctatatgatcataactaccagtttgaggtgggattacgaaacaatgaatttcaatgatcatgtcgctatcgtccgccggtttaccgtacaacaaaccgcaaatttgaatgtaagggtcagaaatttcgatgaactttttcaggaggttcaagggcaaaataaacgtctttgtgaactcatcgttaataataccttctggtggaacgttaattctatttgttttcaaataaatatttgaactttgaataagtctctttctccagtcactttttgactggaattgagtttgttcataacttgacagagtttgaacgttaacaatttcaccagtttttgaagcagttcttgtagttacagcgactatattaccagtgttaacgttttcttctattgccagtttttgtctttcttcacttggcggtgcaatttctatacccaaaattatatctctaatttccgattgtgtcaaagcatttgcaggcactgaattcttctttgagtaatcatcgataattaaatcctttaactttaattctattttcatccaatcttcaggtgaatgtgttggccataaatgttcattcttcgtaatgattgaagcgtttggcctcaatatgtcccaagttttatctttagccacttgtaaagcgcgcatcactaacattagacgtgtgaaacaagtataaggggatattgtttcaagccaatcgtcatataaattgaacaaaaccattttcggttctgatgaatgtataaccaaatcggcgagttttggtattttcatgaatgcaggtaaaggtaaattcatgtcactacctttaacattaatgttcgggaaatcagataataataattgtaatggatctaaaagtaattctcgtgtagcaatgatttgttgtggttgttcttcaggtggtaaagtacgtactaacgcagtagtttcttctgctgctttccatttagctaattgatgaatacgcttttgttgttgccatacacgtgtatgaataatctttaagaacaattgtcctgtagcaggattcatgataaagataccaccatttactggtgttgttacgaagttaccttcgaaacttttatgtactttaacacgataagtatttgtatcatcaactaaccatgtcattttattaccaaacatttctccgaaattggatgaatttaatgctggttcacttggatcagaagaatataattgtaatgctttacggacacgttcatgtaatactgatatagaaggattataattcataatatttttcatagcttgttcaatgatttcttgtaaaccaggaatccaagtaccatatacagtatataaattataacataaatcaattccaaccattatacctgtttcactaggatataatgattgtgtacttgtagtataagcattaaataaacttcgcgtataacgttcgatatcatgtgaatcataatcaccccaacgtaattgtacgtcgacccataaacaagttgttttatacccagtaaattgtatatttttatcattataaaatgtagggtttgatacattccatgaattaatactatgtaatgtaatatcggcacaacttgaattcattttatatgatttacgtggatgaattgtttcttttttaattgtatctatttgtaattcattttgtcgattatcaaacatttggactaaatccataacaatactttcatgtgtcttttgccacatatgagctctaaataattggattaaacttactttcattgtagggattttaccatgcataaaaataccagttaaatctaattgtacttgaaatcctacataaacattagcacgattaatagttggtgaccaccataaagtaaatcttcgattaggaacttgtgataaaccttgtcgttgagcatttgtaagttttctaaattttaatgcttcttcaaaacctgtacttgtatcccaaaataatccttcccatttattataacctgtagctttaaatatcgaatgtgataatataccttcaactcctcctaatgcttgaattacatctgatcgataatcatgtaaattccataatttcccatcatgacgatgatgtgtccaaccaaaaggatttgttttgaataatgtatatttcttgaaatataatcggactctccaacctttatcatatgctaatatatgacgatctttttggaataatgtattaatacgtggtacacctcgatcccataaagaatctaaatcttcaatattaatttgtttgttttgtaacatcgcttcacgtttaatacttttataatgtgaccatactcgttgactatcattaatttctccttcccaagtttgaacataacgatataatgctgggataaatgcactttcgataatattatccataccacttctaaaatgtgtcgaatccattactgtttgtttggaatattttaagtcacattgtggtattaatatatgacccatagataataatcctaatccaccaaattctttaggtgcataaaatactactggtggaaaacgatttggcattttagaattcattccaagtttaactcgtgttaaaactcgattttcacatcgtactatcatatctaaaagttctggtgtagctactaatgcttctctaaaatatgatactaatgatataatatgtgtattccatttattactaacttttgaaaatgtagtacattgtgatgataataataattgtcgtgtacgattcttaaaatacataatacttttatcagatactcgtaagaatacataaccagtgatttctttagttttttgatcttgtaatatccatgttccttctttagtgatataattttcatgattaattcgacattttggtaatattcgaacttcaaatccacacatataaaataataaatttggattatctttggaatatacagaagcaaatgttgcatcccaatttaaacttgctatacttctaggaattcgattctttaataaccaaaagactgctctccctaagtttacgtcatgtttaattaaacgcattcgtgcatctcttggccaacatttcttattattataacctaatatattttcattattaggatctggattatcagttaagaaatctttaattaaatctcgtgcttcttctgaagtgaatttaaataatatatgaatacgcattacataacgttgataaaatcgtattggatgatgaatttcttcttcgattgaagaaaatgtttggaaatcattaggatattgtggtggcccagcaatttcttgtgctcgtttaatacccattaataataaatctatcattaaacccatatattgaactataaatgatgtaaattgtaatccatgaataattccatatgaatttaaatgtgacatatctttaaatgttaatttaacattattcttagatgtcatataatcagctaaattatgatcaactactaaacgtaacatataatttaaaaatgttaaatctgttttctcataaaacttttgtaaacttgtttcgattaataccatacattgtccatcatctgtttcccatgcaccggttaaattatttatagcttgacaccatttatatattaagattggattcggttctttatcagctggtttaatccaattagggaataattgacgtttatctgcttcataccataaataatgatctaaataagcatctgtaattttctcgattgcatctacttcatatactggtactaatttagtatataaatctaaaaacataaaattaacttctcgaaatgctctttgtgtaaataaattccttttgattctattcaacgtttcatgaggattatcatgtgcatgttcaattaaacctaattcttcacgtaatgtttgattcatacgttgtgatacatcatgacctaatcgtaaactttctaatgctaatattaacattttggtatcatgtttatattgcataggtggaaatggtataatttggaatttccgtgattctaaccaatgtgccatagttgataccatagctactgcatcttgtggtgataagaatggtccatcttttaaatatgatgcttgaatatcactttgatccttaaaatataatcgtgttaatcgtgcagtattcttacggacaatagctttatcaattgtaccttctctcgaaattctttcacgtgcataatgtgtattagatacccaccaatctgctttcgatttaacatatcgtaagattaatgattctaatggtggtggaatccctggtactttccatgggatattagctttccaacatctccatgcttcacctaaatgtgccattactgtatgcgccttattttggcgaatactttcaggcattatgtccataatatcatgcattatagcacctcggaattctaaatcataattactttcaactctttgcttagtgacacatgatggagttcgtttcgcaacacgtccttcatattcacgtgaaatacgactatttaaccatcgctccattaatggtaccattcctcttaaataaaagacccaaactcgccacatcggtccccaaaatccgactcctggtccacctccaactgcgcctgcattaaatttggaatatattacatgttttaagtctttgcaacgacggatttcatgcataactttatacttgtatcgatacatacctgttaaatgtccagcatgagcaaagacatattgtaatgcatctgctaattgatatccatcgattgtacctaaacgatatttaacatgacaatcaactaataacttaataaacttgaaaaactcgcgaattaaatgataaccattaccaaaacgacttttacgtcgttctttagtattaagtgtcttaattggtttaagattaaagttataatctaaatgtaaaaatactaatcgatgtcgacgtattaataaattacacatgttaaaaccttgagtaataacttgtaaacctgcttcaacccaatcaagtgttgtactatggaaatatggagtacctttaagttgtgtaattaatttcttccttcgtcgtaatttatattgtttcttatgatggactcgatttaagacataatctttaagaagcttttgatgactaactcgaactttaactggttgatcatacggagatcgttgatgataccatgacctaattaatggtacatcttcagctcgttgtgtattcccagaacgacaattgaatggagggggtgcccagaaaagtgacagggtgtcaaaagtgttttcaacaaaaagtggcagctcatcaaataatggatcaaaatctaattcaagtggctcaaaatatgttgattctggtggttctcttaggcctttatggttaatagagctaatgccatcagttataaatggtggtaaatctggcgattctaatgggacaaatgctgaacatggataatgaaaaggtgcgacagaaacttttcgtggtctgttgttgtataagaaaggaaatgtaacacgacattctgtagtaattggcgttctaacaataatcttattaatatcattaaattcattccattcttcatttggatcagaatctctaaataagggctcatatcttggccctcctggaatagtttcatttaatgctttcgatgtaaataatgctggcaaatcaaataagaataaactatttggatcatgatagtcaccagtaagttgtttcgaaagtctaaataaagttgacattgttgaaagagaaaaattccatctcttgtaagattcaccattgaccattggtgtaccaacaagtcctaaatgatcataaaaccatttgtaaacatctttatcttcatctggatcaagttcaagcataacaggttcgggtggttgaacgccatcaatatttgaaacaaaatctaatggatgttcttcatcatcaaatggtggaaattgaagacgtctgaaatgagctctatctcttttttctcttctcattgctatccaacatgttgcccattgtgctataaaatgtggaggaattacttttggaacttcattaacaaaggttatagcacctgctgtatgatacaaacatcgtacgttcctaagatcttcccatggcattggcatgttttcaagtaatttaagtaaagcatgtggagcatattttaatgcaccaatatatagacgcttttgtccagcaaatttctcatggctcatatcgccatgagctttaataatttgtcggacatgcccaggtggtaattctctttgtaatccagtcttaggagtggatcttgctttatcaagtttaaaatgtttccttcgcaataccttccattgcttaatcctggcttgaatttcgtctgaatgtgaaagttgtacacctggttcttggttcattgcaaaattcaaatgatgccaaatttgtcactttttgtaaaatccggcccaacaaatcaaatgattcaaattatctcgaaatccaagaaatagatcataagaacaaagtaaagcaattacattcgtgaattttttttacaattaaaagaattagtaaaaaaaaaaataagatttaactccaaaatcagatctttcatttaaaaaaaaaacataaaaagaagatgaaaataaaaactttcatttatgtaattataaatttacttggcttgtgcttcacggagacgcttgatagcagcacgagctgtaagagcagctggtgttgatggaatataagcacctcctgttgttgctttaccgcatttttggcacttccaaataccaacgactgttcttctgactgatgtttttccacagaatgggcatgggtatttcttacgttgtgaaatctcaatcttctttattgtcttacggagagatgcaccatagcgaacaccatatttaccaacaattccgactttctttgttctgcgagccattcctccaaaaaggatggccgaacaaagcttttcaaaaaaaactttactgccaccaactttttcaatgcattttgatcgtgaacttgacttcacttaatcttgctttaatcctaaagacttaagcaatgaaagaagagatttatctttttcatttttaattacaattccaatttttttagaatctagattttggttgctattatctgtttcttgattttcttctatcgacgactgattctgtgattttttgtttgtcttatataaagcattttctgttttctttttgctaaggaatcgaaaataaaataaatgttactttcattaatcttccaattccccaagaatatgttaaaccctatggcaatgctttgaacaattttttatatcttgtatgtaaaaatatggttttattatatttcaatcatttttattcaaagatatttatatcccacttttgattcaatggtttatatgattttgagtcaaaaatgatcggcttttcatatttttacttgggctgaagccactcctacagaagaatcatacgctcaagttttttaaacgcttaatttataaattttaatgccagtgaaaaaatgaattcacctctaaatttgggaatgaattatcaaaaaaaaaaactacataaaaaacgacctcattgtttacctagtcggttttcttttggaagatttctttgttagatctatttgatgctttaactccaagataatttgcaattgcaagctcagtcatttctgctttttcttctggtgttttggactttaactcttccttcttaaatggtgggaagaatttaatttcgacaatgcacgctgggagtgcaaatgcgagccatgcaaattctaatgcagtatcagttgtccagttaagagtaacaccacagaagccaaagatgttgcgatagcgaattgcaactggttgaatctgttcatctgttagaaatcctcctgttctaaatttgtaaagtaatgagccatcggaaatcttgccttcaggtgcaagtgcaagtggatcttgactatggtccaacatactctttttgatgagctctgagttgttagaagctacggaacgatcaatgaaaattgcattgttatattgaagaatccaaccaactaaaggattatctttaaggcctatgtggcaaacaactctaaatggtttgatgacatagattaatggtccatcaactaatgataaatgattaaatgaaaattgacgagtatttggatctaaatcaccaatcttacggatatagtaaacacctaaacaaaacgctattaatctaatataaattctagtgatagtattataaattatatagaaatatggtctaaggggtgaatgaaagatgatgtaaaatggaagagaaataacaataaatgttagtataaggaatataaataataataaacggagccacccaagaccaaaaataaatagtaaaacttgaataattctatctttagtggtaaaaacaggagcggcatatgattttttgaattcttcatcgctaacatcggataatttagtttgattgtgaaatcctcgatcctttggtacttcgaacataaggtgaggtcacactttttgaattgtagtttcggttgctttcaatatttaaacatcatacgatgcttacaacggaaatttaaaataaattttttcatttatctacatatttaataacaatcaaaccaatagaaatcaataaggttaataaggccaaatcataataatttattttattcaaatatattaaaatttattgtttatcatcatcattttgcatcataccaagtgcaacttcttcgccctcaatatcagcaattgcctgtataaattcaaaaggtaaatcaatatgcgaaaaatcaattgctattttcggaaaaggtcttccatacttaagcgcataatgtaatcttatgtgtggaggtaatattgtaaggaaattatcaaacaattcaatgattcccaaagaatatattttttggataatattatcgacatttacattttctgattgcattgattcaattgttgcttttaaagaatttgccttagatgtaggaagtctgcttaacgccctttcgatgaattttttaggtgattctggcggtggatactcaatatgatcatgaagaattttaaatgccaaatgcattgcaatagtatacggagccggaagaagtctaacaacttggtcaaattcatctggtaaatcaataaaaaatacagccatttcaaaacaaaactgttgtgtatttgtgcatccaactgcatatcttcttaaaatatcaacaaaatgttgttttatttgtgtagtcacaggtataagataatttggaaagattgtattccataatgcaactcttgcagatgatgattgtttttctttaatatttccttttaatgttgaaattgcatgtgtaattgtttctcttatttgataatatccatgttccatttgaactttacgacgtgttgaagccattttaacactcgcaagccttttaaacggccttctatcagccgttgtatcgtttattttacaatgcttaatgaatacattgaaaatgaaaatatattgaaataaagactctatttgcatatcttaggtagagaaaaattcttttgatgtcaacacattcacattgatgattagttattgaatttttaattcaatcatttaatttgctcatataataattatcctcaaacataatttattacatcaatgtatgtagatattaaaaaccatattttcctcatagaagtattgaaaaaaattttaaatattaaaaagattaatttatcaatttcaagtgtaaattcgttatgcttgtggtagctaggggattctacaaagctgttttgatacttgggtgaagcatttaaaaaaagtttggtggggaaaaaattaaatattattttttcgcgttcgataaataatttagaaaagttatttttcgaatcgataaactacattataaattaattctataaatgaatttaagttaaacttcatataaaaacaccaaatatggcgattgaaagtgttgattaaatctacataaatacaaaatattaatcatattatatctaataatacttaaaatttcattgtgtaattttttgtaacagaacgatatagtgacaaatcaaaatgttcaaatatcataaaaatacatcaatattttaaaaatacagaaaaaaatcgaaaaatttgcaatttaaattttttaaaataaaatacaaaattatgtttattaaggaatctttagaatacattttttttcacactaaggaataaaggccgttcaaatttttgaaaatagataaaaaaggtgaaataacattcaagattttggtaatcggggatgataacacaggtggaacatctttcatagaacgtttggtttacaacgaatttgatcgtcccatttcaccaacacttggtgcaagaattcaatttaagtatattaatctcaaagataaaccaaaaattttagttgaattttgggagaatcatcttccgcctggttttgaacccatttttcttcatcaaaaatcattatcataatcactctcgaaaatttatttatattctgtgtatttagttatttaaacttttttcttctactaaactttttttctttctttttaatagaatattttctttgttttcagctctttccataaatctagttagcattgcttcatcacaaatcagtgtgtaatatctcggatcttcttgtcttttttcggtaccactcctaaatttcttccatattttgctgcacttaattcaccgttttttggaaagcatttccaccagacacatgacgaaaaacttagcgaattatcattttgtttccatttggatcgacaaacgaaagttttagtattattttcttcataattaactctttcaataatagctatgtagattccaaagtgccttcatcaaaacatatcgaactaatttttattggtttttaacaaaattcgaaagcagattttcatgaccttataaaaaattattaaagcttcgaataaaaatgtaactaacacaaatatatagtataccatatatactttatcaagaattaaattatcttgaaaaattgatgatttttttttaaaatatatttaattacttctataaaacattcaaatgtcataacaaaattatatattacagaaaaaattattcgaaataacaaaaatttattaactgtttcaaaaaaaaatttaataagaagaaagaaacatttttattcattttgttcttcatcaacatttttcatttgttggcatctgcattctatcaactccatttctacctttgagtatttcttgatgagtttattatgttgaatctttaaattatcgaattttgtctttatttcatcattttcatataatatatcttttgctttattattcatttgaagtaaacattcatgtgattgatcaggagaaacatcgaaacatatcaaagtctttgagatttggaacacgtttgtttcatttataattcttccgatgttagttgggttaaaatattcatttccccaaactaaaaatgattgcggaaagaattcatttgattctccaccagcaattggattaattttatttcttttggaattgaaaaattgataagcgtaatgaacgcaaacatttttctgaattccttttttaccagtcacaatacaattagcgcatgcgattgctctattttcttcgttctcaggactttgcgctattaaatcagctccttcaatatatatctttcgttgcgttgcacacgaaagtaataatgataattgatgatcttttaattctttatatttggttatgtctaattttgtaactcgtttttgttcatatgataaatatgaaacaattaaagaaaactcaatcatcttctcttggatttcattgttggataatattatttcgtctgttgggaaaattgatggatttgaatttgcaatgttttcaagaatataaagtatagaattagtgagtttgggacgagctaaaagtaagcctgttagaatttgcatttgaaatggtaatgattcaagtttataatactttaaacaatcaccaaaacaaatagcagcattctcggcggtttcgtcggttgagtcctgtatcgtcatcgaaatcaaaagttgtttcggaatgcccaaagaaaacatttgggactggataagcccaagatgaatgagatcagaagaatccaaaagcgaacgaaagactgaggttgaaagattagaaatacctgtgtcaaataatactttcacaaatttcgaaacatgacccatgtcaatgaaatattgtcgagcttgctgatctgaaattaaagaaccaagtaaagaaagatgtttttcatttgtggagatggtaggtaaaatttgttcgattaatcctgcaaaaacaaatggcacacgaagacgtggtgtaagctctgctactcggacaataaatgaaattattaggtcgtcatttgtaaaggatgagaaagaaactaattccaagggatcatcaagtaatgaatttacatctgattctgtattcaatgatttttcacaaaggcctaaaaaaggggatataaagtttgatttttgcgttccttgattttgaagtacaatggtcataatttgtttaaaatctgattctttaaataatgtttgctttgttgtaagtaaaactgaggcaatttcaccagcggcatcaacagcattttgttcaagaaaactttctatttttttcaaaaggggaattaaatcttttcttgtgatttcatttgatttagcaaataattctttaatctgaaagcatttatctttagaatttcttggtgtgatttcttttgttagttgtgctaaatactgttgatcagttgcagaaggtgcaaacaatgagagaacagacatttatcactaaacgtattaagggtacaccaaaaggtgggcacccctctttggtacaccccatttcgactaaaaacactttttcacagaaaaaaattgctttggtaagtcagtagcacttttgaataaaaataagtagtgacgctatagcaagaggaaattcgaacttttcgcaacttcgataatatcatgaaattaattgagcagtttatattgatatcgtcatgttagtcagaaatgtgagcactgtcgacggttatgatcggtatatattgaaaaggcgttcgggctgttttgattccaacaaaagcaacgaaaaaactatgaataaagcgcaaaaatgcaagaagggtataaatgttagtcgatcgatcagtgttcggtctctaacatcagaatccaggcttcgactaacaagcctggcgaaagcctcatacaaaagaaaaaaaagattgaataaaaattagaataccctgttcatctaaagtattcaaaattggcatcaagttgcccattgtacttctccatctgattccaggcttcagatgaaatgaccttttgattttgaagcttactgacacttcgatgttcccatcttgtacaagataactcaagtatggttctcgaaggggcgatgtcttagatcgtttcagagtttcccaccatctctccatttttccgttctcgtggggagtgtatggatgggtcggatggagttcaattccaagctcttggagtttattgctgagatcaccatctttggtcttggatcctttgctaaggtattgacaagagcattcatcgccaaaaggcttgttctgttaagaagtatttcatgggtatgattcgcctggttcgatcatcaattaaaccaatgagatataatttcccgttctctcctgaaagagcatccaattcatacaaatctgtatgccaggcttgcccagcatactttgcaacgaacattaaagtatgttcatcaccgggaggaacttattcttgtagcctaatgtaaagatcagaggattcataaatatttccaatcatccactcggttagaccaggtggtgctgttggatctctccttgctacaccagccagcctctgatatccaacatttgctttttgtagatatctttggatatgatttacaaattcagttggaatgtcatgaggccgtcgacctcttctaggaattttcattcctagttcgatgcaaagattatgtaccattttgcgtccaacatggtacttttgcatcatgctgtctactccaagatttgaaatttcttggtgaagttgatcctccaacgaggtaggttggttcattaacggagcgttcatcaaaatatataaatttgtaaaatattcaaaagataaatgcatttgttaaacccaacatgtaaagtattaaaaaagtgactacaaaaacttcatcgtagcggttattatcttaatcacaaaaagttgttttcatataaaagtgacttttttgcaaaaaagttcttctcttaaaacataataaaaataatgtttcgtttgatttttgaaagccctttatgccaccgtagaaaatttgtaaaattctacctctaagatttttaaaatattgtgtatatattgaaattctcgtttaatttaattcctttttgttctataagtaatttgactatttctgtgtaaccatttttggatgcacacataagtgctgtccaaaataatttaaataatttccaaatattattttataatatcaaatcattttaataaaattcaaacagcacccaaatattatttacaaacattaaattattaaaaattatattaaataaaacaaagaaatattttgagcattaatatcatttccttctccagaagtaatttaacattttccatatcatcattaaaagatgcaaacagaagtgcagtacaaaatattgattaaacaatttccaaatagtaattaaatacataaaacaatcaaaaataatattaaacaaaaccaacgaataccttcagcattaacatcaatgtttatttgaagatatgtacttaacaattttataacatccagattcagaagcatatggtaaaatttcttttgtggattgattattttgtaaaaagcattcaacaagaaatatatttgtattttttgcagcattattaataattgaagcattaactttatatcctttttctttcaaatataataaaatttcataatttccatattcttcacacatttcatcgtgttgattttttttttttccagtttgatttcgttgtgtgacaagttgtgggttcctaataaataaatttgtaatattattttcaaaaagatatttaaatatttcatttcgatgatatttaattgctgtttcatatgcatatgaacatatcattaaatggtgaatgattgatcacataaatgaataattttttcatttccacctgaaattgcatattatgatgcattttttatattcgcaccattcataagtaaaaatttaaaacattttactgaagaaaatacagcataatcaatgagtgaagcattatattgactaaagaatatcattcataaattgtttgattcaaaatcaaaacattctcgtgatgacttttcttgaagcttttctatttcatcattttgaatcattttcataagtttattatcattaaatccttctttaacatatttcttatgaaactcccaatcattctttgatagttctttataatttttataaaaattattttcttgaatttgaaatttatttttcttttcaagtgatttaatagattttggaagtggtctttcgtattctagcttataaagaaaaaaatatttggatttatgagttagtactgtgtttttattgtttaaattttgttcagtcatcttctcaagtaaataatatgcttcttgtgattgaattgaagagatatgtttaatatcataatatgatatttggattagttttgagtatctcttcttctaaagtttgaacagattttaaatataccagatattaatcatatgtgtttcttcgagaaaaatatgatgaatatactaaattacagataacagaattaaatgaaaaaatgaaattgcgatcaaataatttcatcgtttgatgaattgcaaattcaatgtcatctttattattctttcaagtgaaataataattgggaatttgaggaattattacaatatgttaattcaaacttaaatcattgatattaataaagcagtacttttcatttgatcatatcattgtgcataccaaaattagtgagttttgccctgctgacaatcctatgattaacattttcatattcacaaaaatttcatgttttccctatcaaaattaaaaaatcgaagcttgaacatatccaaacattaaaaacattttattccaaatcaaacacaacatattttacatttttatttcattggtttgttcgaaatcggcttttgcttttgcgccaatggcctcatcactgaccatctccttctaatttcgagcacgaactttcttcccttttcggatccctttttttccaggctttccaaaaacgaaacgtattttttatgttgaacaattttcatattattttccaacgttttgatgataatttgcggcaaaatttcaaatttctcgactaacgttggcgacatcccatcgatagcttctggcgttttaagttttatgttgatgaacattgacaggttaaaaagtgcatcacttcgccattggtaacattccgaaaataacttcggatatatcgcagtatgcatcaaattatagtttgtggcatactcaaatgctgtcgcagagttacaatattcgcaaatagcattgataatgccgggcctttgttgaaatactgtagatttttgtaaaattggctcccaataaactgtttgatctttgatttcttgtatcagggctttggtatagttactcattttgacaatatttgacactgatttaaatacttcggaatcattaacagaggcccatcgtaaaaataacgtcgcatcttcttctttacgggacattaatccagctactgctatacgattaattgagttaaaaatgatttcgatgttttttcgatcatttgctattatatcgtctaatattttaaagatctttgaaaacacattcgaccattcaccgttagcttcactaacgagttgttctatcatttgattcacttgtgaaagtattttacgaccatttgatgagtcaagtctatgatcttttgaattaataaaagaatttacatcattcggaagttcaggtgttttttgttctataaaacgtaataattctcttttataatgatctttaatgtagggcttcgattcgatttcactcgcattcagggtgccccgaaaattgagagaaactttgaatgaactgtgtttgtatgctttgaattcatcgctgcataatgcggaaagcaagacttcgataccatgacacgttaaacttgggtttatacctgttttaattatcattaaaaaaggagttatattcttatgtaattcattcggatcaaaattaggtgttatatataagaaatcaataattaaggcttgtaatgcagttattggtgttttgttttgggcctttttaacataatcataaaaaaatgaaatgatgtcaattttctgttcgattttattattactacaatcaatggattgtagaaaataacgatataaatctgaaagtataaaatcatagtccgctaaaaccgtagatcgcttcaaaattgaacggtctttcgaattttgactgagcattctcaaaaagtcggacaaatgaccatatggaagaaacaactgaagaatatttggacttgtaacagtaattatgtacgacatatcaatcttactagttaaatcatatataactgggaaccttgcacgcattttttccaaagttcttttgttatataaaatccgaatgatttctttgaatgcaattcttggaaaatgctgatagcaaatttgaaagaaattggtaactgtttgatgaattgagttgataagctgttgggcatctttcagtaaacgttgatgattttcttcttcaaatttgttttctgagatgacaaaataatcttgataaaatcgaaggaattttataagtagaaatgtgcttaaaatcggttcattgatatatgtttgttgataattagaaacgttgaatgaaaaatatttcataattcgaagattattttctgtaatacatccggtgtcatatgaagaaacaaccatgaacataagttcgtgaacttctagaattttcgtaaaacgattttcaaggagagtattgatgattctgaaaacattattggcgacttcctctgatgcaaattcgaaaagctttcgaacccctgtgattaaaaactttctaagttgattaattgaaactttcccagattctaaaatcatttctaaaaatttttcttgaaatgactcatttcgaagagttaaaagagcacacgcaaccccattgcaattctcattgcttttgcagttttcagtgcaagaaataagaaattgaaacacattttcaggagaaacctcagaatgatttaaataaagttgatctctcgctcttgtgaattcattataaaaatctttctgagcatggcttaaatatttaatatcttgatttctaatcaattgattaaaaacaagattcattttgttctactaagattttgactgtgtttgtttgatttgtttccagaatcgaaaacaagggtttaaaataacctataaatatatatctaaaattacttcagatcattttcttcaaactccttttagaatttaaattaagtgagtttttctcaattggttgaaattaaagatcataattatgaaatatgtgaattatccctcatttacaaccttaagacgaaaccaaaacttataaaatatttcaataaatattgattaccatcaaaattcatggttatcatttcgaatatatcttcattgcctaatagtactgcataattaacagctgaattaaataaatcgatttgattccaaatgaattattgaaatatccaaataataaaataaacacttaataaaaaaatcaaacatcttcaatagcgatatcagttcctacatatttaagaagtaattgaactgttggtatacaattattttttgttgcttttataagtgccgttttaaacaattttaataatttccaaatcatatttttatattttaaataattaacataaatataaaaaattacaaattattatcttgagcattaacatcaattccttcttgctcaagaagtagttccacaacttttgtgtaaccatattttgatgcatacattaatgctgtatgaaaaaattcaataatttccaaatattattttaaaattttaaaataataaaataaatattaaataaaacaaataaatagttttagcattaatatcaatttcttcttattcaagaagtaatttatctattaacaaatattatgaatatctttaaaatttatatcaattcccttatgttgaagaagtaatttgacaatttctatgtaaccatttaaagatggagtatgaagcatataactaaatattttaaataaattccaaatattatgaattcataaattaaccaaatgatcttcaagttgacatgacactcaattgaaatttggtaattgcgcgatctcatagaaaattttgaattgtccatcagccacataaaatgatacgcataacgttcatcggcatagtgtttaacagattatgctaaaaattgacagatacaaaaatggaaaacaaaacaaaaacaagaaatcatccaaatccaattgaaatcagccaggtttttgatatgagcgattgcacagaagccttagataaatttatgaaaacaaatttaaaaccaatattcaaaagtgaaaattcttatttttggccaacagaaattgatccaaatgcaccagaagtcgtgaactggattaaagaaaatgaggttactttatttccaaatgttatgaataatcattaaattcattgtttttatgaataaatgttttttctttattaagttaaaaaaaataaatttttattttagcaatgttcaaacattcgtgtgatccaatctaatttacagcatatatatcagtaaaaacctaaagaagcagattttatgagaccgttattataaacggccgaaaacatctgcaaaaaagaactttggtctctttaatctgatgtttattaaaggtaatcgataaaaaagaaaccgatgtttgacctccaaaacgttagtttacaatttagctgatttttgaaaattaatcgaaaataataataataattgtagaaaactaaaaacatttatttaaagatgtcaatgaaaccacactggatcttgatctacaaataattggtctggaatgtatgtcatatcaaatgttgggaaatttggatgttcttccagaaatgtatcttcgattttaagagtgaaagggttaaaatcgaataaatcaatttttttggattcagaaattggcatgttttttgtttcttcaatgttttttgtgacaagctttcgaactgtccattgcctcatttcggagaaattgcttttaaggaaaggaaagagtttaccaagctcacttgcaatttcagcagttgtttgaaccaaaacatatcctattgcttgtattccattgttaattgatgacttacatttcccaatgatatgttgcagttgcctagtgttaataactatgtgatcttccatccaaaaaattccacatacaagagattttatgttttgagtttctggttctttttgaatatattttttaatgagctcaaaaacattgtgaaaattatcacatatttttggatttttagaaatgagaaatgatctaagaatatctttttgaagatttaagtaatcaatctgatcattttgtgaaagatattcaaaaaactttggaaaagatttcatctgtgtcttcttcgtcatcatcagctgaaaacgaacgtgaaataaaaatgcaaaggtttcaaaaagttcaataaattattttgaatgacatcgagtgatatgtttcattcaaattattgatgtcgtacccagttgtgacatgttaaccattaacccactacacaaataactgtgtgatttcaatggctttgtgaggcaacacaaataaaatgtggtgatatccagggtgcaccaaatttttacaccagcaaaatggggtggtcttaaaaattttttttcaaaaaaaccaaatatctttcattactatcatatcatagtattgttcattaaaaaaagatttgtttatatcaattcacaacttaatataggatcttcttcttcaaaaaaaaaaatgccaattatcccaattgtttgatcccagctcaaagaatccttttcaagatttgaattggttgatagggactgtcactttttagcaaaacctgggatacgcttgttcataacgtcctccacactttatcatcaacacaaaaaaattgagctcctttgaatttttttgtttgaatgttgatcgaacttttcattaaagtaaacatttcaaatcaagtgaaagaaaaaaagtttacttgaattttcgtcataatcttttgagatgataagaaaaaggaaaagatgacaattttgcacgattgatctttcttggttataatttgatcttgtctcatcttatgtatttattattcatttgtttatgcccatgaattttatggtaaatttatcacagatagaaaaaaaacaagtttctttttaatgtccagatttagtcctgattcaaaattttcaaaatcgattgaatgaattgtgaggctttggaaagtgtcagaaattttgttttgaattaaatgctatacctcctgctacatgggattatatgctatcaagaattcaaaatatctaccttcgggaaaatctccaatgtcgcatcattcggttttcaaaagggcgcagttttttctttcgaatttgaaacatcagatccttatgattttgaggcattcttgcttacaaaaagacagctagacacagcagtacaaaaatcaacacagttatgtcaaagtgatggttttaatacaaaatattatttaacgttaaaagaatctacgcaaaaaaattattggatgggtacaattcaagaaagaggaatatatttccttgtattacgcaactgccatccgaataacagtgaagtaattattcgagccaatttttcaaatggtaattcataccttgatacaagagatcaaatacttccattaacataccaagtattttgcgctatttattatgccattgctattatctgggcaatcaatggttatgttaattccaattttagaattcctctccacacagttttcacggctcttcctattgtccgtgccatttcactctctatatcaggatcaatatggatacaaaagaaaaattttgattatgtctcaccatggaagaattatgccacattattactggaagtaacctattactgtcttttatttacgggaaatgcgcttgcttgcacaggattttgcacatttaaagaaagattaaaacgggatgatccaatacaaatcatcatatcgtcgttactactttcgatgtctttgactctcatcaacagaggctcatcttttaagggcattatatcattaatggtgttattgatattaagtttaatttggtatctgaaatatagccttataaacgtaataatcgcaatcaaagtgctcaaaaagatgaaaaacgaactagtccgagctaaattaaagctatcgatagatttcgtattgtcatttcaattgacattgtttgtcacaatattggtctctttcttcatcgcaggcatagaactaaggcaatgcatctgcgcaataacgttagaaatcggtcttgtgatatgctcatttatacagatgaaattcttcttgtttaggaagagatactccggaaacattgtaactgtacagaaacagaagacagagcacaggttctcatggttggtcgagccaaggagtcgaagtttagtttgtcttgaacgtaattatcagtaataggattgttttgtttgattaaaatttgttattttatctttttttttttagagtttttaagttaaatatattcgagatcttaaattttaaagttaattatttccttttaagcagtaaaaattatgatatttcttataggaaacaaatggcttttagagttataatacgttcaatgagtttaactgcatgtatatataaaaaaaaataaatttgaaataatttgaaaaaaaattgactaatgacgttaattatataataaacaatattattcttttggaactatccattattgacaattttggaataggtttcgatgaactttgcatcggaaggtcgcatttgaaatcagttttgcacgtaacgtatgtaaactatttaaaagctgtgtgtcaaaaacattccttttcactttttcattaaattcgtttacaacacgctttttggccattgaattatccggaataatcaagtttttcaaagcataacagtcaactcaaatttgataaaaacagtttttgtatcacttaacaaatgtgtgcagttcgtctccacgtaaggattatcgaaggaaaaaatcttctccaaatggatcttggaaaatccgatccatattgcgttcttcgtcttaagagccagaagcaaacacaaaaaacaaaaacaattaaaaatacaatgaatccagtttggaatgaagattttgatttcttccctgaaaagcccgatgatgttcttcttatcaatatgtttgatgaagatattgcaaaagatgataagatgatggatgaacttcaatttaaggttgccgacttcaaaccaggcgctgaaccagcaaaactcacaaaagaattagtgttaacaaagttacttaagaaacaaaaagcaggtcttcttattcttgaaattcaagcattcccacctggaaaaccaaaggacgagaaaaagaaagatcataagaaaggcgacaagaagaaggatgataagaaacgtgaaagaagaggatcctcttctagcaagaagaagtcagcaccaattggcaacatgaagatctctgttgtttgtcacagcgcaagaggtcttgttgctgctgaccgtaatggcttctctgatccatatcttgttttcaacatcaagggcaattccgaacgtgttatgaccaagttcattgaaaactcacttaatccagtctggaatgaaacagttgaaatcaatggtgttgaccaatctaaagacattatcgaaattgttgttttcgataaggacaagaaagttgatcttaagaagaatgatcaaattggttatgcacaagtcaaagttgctgaaattcgattcggtgaacaagttgaaattccacttgttaaaatgtcgaagaagaagccagctaaggattccaaaccaggagatgctggatttgtcaagcttacattcaacacagacaatgaagtcaagccacaacttgcgcttaatgttcgtgttgtttctgctagaaatcttaaaatcgcagatgctaatggcaaatccgatccatatgtcattgtcaaacttggtaatgaacaaagaaagactaaggctatccaaaacacgctcgatccagtttggaatgaagaaatgcgctttgtcccagtcacaccagatcaagaaatctcgttccaagttatggatgaagatatcattagcgatgacaaacttggcaaagtcgttgttaaactttctgatcttaaagttggacaaatccttgaaaaggactacaaacttgaagatgttaagacaggtatgatgacaattgttcttcacttagccgatgctaaggatacaccattcggtgcacacgtttctaagccaaaggaaaagaagaagcactccaagtcacactgcacaaacttcacactcggaagttactcatcaagttactcgacaagtttctctggctacaccaactgctcgacaacactttcagcactttcatcaagtgaagaagtatatcacatccataaagtttatgagaagaaggaatacaaagtcaagccaaagaacgaatcacttaagggtgtaatcgttggctgcaataacttgatcaaggctgatagcgacggaagtgatacttatgttacacttagacttctcggtaaggaacacgctaagggtgaaatgatcaagacacaaactatccatgacacacaagacccagtctacaacaaggaattcgaattcaagaaggtgaagaagggtgaagaactcgaaatcattgtataccaagaccacaagatattcaaggacgtaccaatcggtatcgctaagattagtgtgcgtgatctcgatgatggagaaggcgaaaaggtgatccaacttcatagaccaccgaaattaccaaagattttggagaagttcacagacttcggcgttctcaagatcagactaaaccaccatagggaattctgattaagtaaacaacgagtttgcattaaattttgtttaatttttgtgtgttgttggaaatatcaaaaattgctctttaagataatgtattgatttatacgaaaggacaaagaattccaagaagagattcaaatcgaaatcattttaaaatgttaaagttaccctcaaaagaatatgtaattatattaggatgtattatattaaataattatgaaccatctttattcccatatcatatttatttgcttattgaaatggatatcatatgatttaaataaaacatatcactttaaaagattgtggtcaaatttttaacaataaaacttacaataacagtacaataatcaaatatgttgttcgattttggaattgaaattgagaaaatgaattgttgtttattttgaaacacttttctctaaaaataaaattatcattaagtaataagttagatgtagttcatgatcaaaaaagagattgattgcaattttttttcatttgtccattatattaataatatatttatataaatggtcaaaactaattgtgaaggggactctagctcacctgggagagcacacgactgaagatcgtgaggtacgtggttcgagtccgcggagtcccatttttttcaaattcccattcacaagtgggaagggtttttctgaagcaagttctaaatgttttgcgacaaaagtgtcatataatcaccacatttatttttgcaaaaatactgaataaatatttattttcattgtctcattaatttttcatatttacttataatatgatacccttaacatgtaaaagcccgaatttattaataatcgatgcttctaattttgtgattctctcttcgatataaaaatatatatctattttcataataaatgtatttataaattataaaaaatattgtttactaatgaagatatttttgtattattttgaggttctatcactttttcttaaaacaggttcgaacccattttgtttgggtaacctcatttggggagtgatttgtaaataacaaataaaacaaataaatatatttatcattaatatcaattccttcttgttcaagaagtaatttaactatttctgtatgaccatattcagatgcaaccataagtgctgtatctaataatttatataatttccaaatattattttgaaataagaaattgttaaaacaaattttaaataaaacaaataaatatttttagcattaatatcaattccttcttgttcaagaagtaatttaactgtttctatatgaccattttcacatgcctttataagtgctgtattaaataatatagataatttccaaatattattttgatatccaaaattattaaaataaatattaaataaaacaaataaatatctttcgcattaatgtcaataccttcttgttcaagaagtaatttgactatatctatgcgtttccatgaagtagcaagcataagtgctgtattaaataatataaataatttctaaatattgttttgaaataccaaattattaaaataaatatcaaataaaacaaataaatatctttagcattaatatcaattccttcttgttcaagaagtaatttaactgtttctgtttgatcatttaaagatgcaatcataagtgctgtccaaaataatttaaataatttccaaatattattttgaaataaaaaattattaatataaattttaaacaaaacaaataaatatctttagcattggtatcaattccttcttgttcaagaagtaatttaactatttctgtacaaccatttgaagatgctaatgtaagtgctgtataaaataatttaaataatttccaaatattattttgaaatattaaattattaaaataaatattaaataaaacaaataaatatctttagcattaaaatcaattccttcttgttcaagaatgtatttaactatttcaggattacccgattgtgcagaaaatattaatgtatcatatggaatttggatttctttgagaaaatatttgagaagatataaattaccaactttcgcagatgcaataataacagaatcatcaatctttattttttcatcttccaaaaatgaaaaaatttcatagttcccatattcaatacaaaattgcatcaaattaatacctaatttttctggagcattaattttttcgattttattttcataaatataatggaaaattttatttttatggaatttaattgctgtttcatatgcaccttcaaatgttgaatgattttgttcacataaatgaataatttcttcatttccacctgcaattgcatatttacctgtgttttccacatctgaaccattcataagtaaatatttaaaacatttaatagatccaaagaatgctgcataatcaattaatgtaacattttcttgattaataaatgaacatatttcataaagtgatagttcaatttcttgattaaaatcaaaatcgctttgtgatgatatttcttgaagtttttcgatttcatcatttcggattattttcgtaatttcatttggattatgaccttctttgattaatttcttatgaagctcccaatcattctttgaaagttcttcataatttttatgaaaatatttcatcgttacatatagaaaatctttaaaacccatatcgtcttcatcttcatcaattgcattagtattatgttcaacttcgttatttatacgatgtacaaaatatattgattcaagatgatccaagatatttgcatcaattaatttttgctcaagcaaattctcgataaaatattgtgcttcttgagatgcaaaagattgtttattaataaaatttaataaatacttacaaaaaatgtcaaaaactttaggattgtttgcgttgatttcttcttcttgtgattgaactatttgtaaatatttgaggtatgtgcttccattcacatttttttgtgagcaaaatatgtagtagattaaatgaattaaaactagattgaacgaatatgggtggattgaatcaaataaattcattgtttgttgaactgataatgtgatattttcatttatcaaaccatgaataatttgttgcaattctttcatattttgtaaaggtatagaagaatcagagctcatttgccggtaaatttgcgccttagaccaaaggcgaaaacaacgatcaaaatttacaacagaactttttcataactttatttgaattaattgactacacctattaacaatggccacgtcctccggtacgttttcacattttaaatttggaatagttctggttcctattttccaaaaatagattcatcccaatctttaggttgtattgaatcttgattaggaattaatttagactcgcccattaaccatccttttggaggatcaattttttctggatcaggtataaattcgaatttatcgggttatctttcatcccaatcgaagggacgttactaagtctaccaaaaagtgaagttcgactttttgaaaacaatttcaatcaaaaccgatcaaaatgaccacaactttaagcttttttgtaaaagtaggttaatgaaaagaattgacgatcaaaatataggccaccccaaaagggggaaattgaaattaaacgttctttttgaatttttattcaaaaagtgctggacttgatgcaccaatacgggatgcacctgcttcaatcattgcatgagctgcttcctttgtacgaatgccaccggcagccttaacgccgaattttggtccgacaacagcgcgcataagtgcaacattttcaactgttgcaccagcttttccaaaacctgttgatgttttaacattatccgctccactgataacagtaaggattgatgcatcaataatgcgttcacgatcgaggtagcatgtttcgatgatacatttcacatatttacctggaacagctgctacaatttcttcgatatcttgacgaactttcttatagtctccttcaagaagagcaccgatgtcaatgaccatatcgatttcgtcagcacctgcttcgacagcgcattttgcttcaaatgcctttgcagctgatgttgtagcaccaagtgggaatccaacaactgaagcaatacgaataccagttcctgcaagttcacgtttgcagatatggacacgatttggattaacgcaaacagaaattgttttgttttgtttggccttttcgcaaaggtttacaatgtcagcttctgttgaaaatgcgttaagaacagtaaaatctacatgtgctgggatgctattcttgtcagctgggattgttttgtcctccttcgcatttttaagcttgttggcaacttcttcggctggaacgccaagtttttcagcaacaaatgcaatgcggtcagagaaatccattaaagtgacacttttatcatcgtttttgtcaaaccactttttaaataaattaagtgaatattgaaatttttctttgaaatacagcacccttaaaaaagagaataaaatgcttgcatactaattaatttcatccttcactagggaatcttttgagcaattccaatataagtgcaattatttctatatatatgataaaatcattggtaattatttaatcttcattagaattaaataaaaaataatactcacaatgtttaacatgcgatttcctttaaattgattataatttaattatccggtatgagaattcctataaaataacatacaaacaaaaatgtgcaatcacaaagatgaaatgtgatgccgtaataaagtatttaaaattctatcgttaagaaacacaagccataaaatgcaaagtttcggcatcccaatggcaccaacccttgtcaccagaacaaccaaatcaaagtgggacagtggtgacagtaaaacagttataccaaatgtggcgtgtattcttccaccagatttaaaatcagatttacttcatgcttatcttcttagattccagtttgaagaagttcaatacaaaataaagaatcttgaagacgaaacaaagaatgttaactttggtgaaaatctcatgaacaattttactcttgataataagcttcaggttacagcagatgttcgtgcaagagattcccttgttcaagaaaggcgtcaaatcacagaatctattgaaaaagtttatccaatatttcgtgcacctctttctttgcttgtttccatcaccaaatcagttaagcgcgttgagataccttcgtacaagcttcttggtgttattcttggtcctcgtgcaactatgctgagacaaattgaaaaagattttaatgtaagaatatcagtcagaggtccatcaaataccacggatgataatgctccaccagaagaaagaggccatcttctaattattggaaatacagaagatgaagttacacgttgtgccaaaaagatcaactcaatcataagtagtgaaggaggaattgtcaacacaaacacaggagggtttaaccaagatgttgacccagatcaatattctctttcgttcaatcccaacgaagacaagcccccatgggaggagaccgttaaaggaaccgatacaagcggttataacacttttgactcggcttacgatgaacttttgaatagtttaactcgcaacgatacagttgatgaagaaaccgaatctgaagaacgcaggaagctattcaagaaattcactgttgatcttgcaagaaccgatatttcatcactaatggatgagcctcttcctcctggttttgcataaaatttttttcatcttatctcatttttcgaaatttcaaaactcagaaaagagtcaacacaattgatacttttgggttttttatacataagtctaaaatgaatgaacttctcctttgatcttttctattaaactttcaatttcttcgatattttgtttcttttcattaaccatttttgagaattctttttgtatttcataaaaacaatcttttttatcattaaattgagaaacttctgtttttgttgagttgctttgtattaaaattggtctctgaggtgtttctatattttttaaacttaatatttcataaataatatcagaacatttattctggaaattctctttgttcctatgaattgttgcataaagagaattgtttatttgtattgagtttattgattgtttaatgttttgaagcatttgttgaatttgattaatgttcaagttttgaacttgttttaatttaatcaaatcgtttcgatgagttttaatgcatttggattgagagcgtatcactttaagtgccgatttttgttcttctagtttctgttcgagtatttgtatatttcgttgatttgatttttcttctctaaatacaagttcattgagtttatatagtttttgtgtatttattaattcttctaattcattttgaagtaagtttggagttgatgaaaagtttttgattatatcatttttagtttcaattgttgattttcgaagtgaaacaatatcatctggttttaagtctgtggagatctcattttgagcaatatttatgtattgttgaaaactaggaaagtattcttcgaacacattacttaattgtgatacatgttgaggtggaacttcattctcaaaggaaatggatttctgaatttctgaaattaaatcttcaagcatttcgttgaccatgaaatcttcaatttccgatgtatctacaagtgaaataatttcagcatgtaaatcacttgctacttttatcaacgaatgtgacaaatagtcagaaatatgttcaattaattcagaaagaattgcattatcaacttggaaatcttgaatgagctctttttgatgtttctcttgtaagatgagatcattgtttgttttctttaaaattggttttagcctttttcttcttctgatttctttcttttccatcccatgatctcttaaacgtacacaaataacatatttttcacataacatttcacacttcgaccacaatttttacaaataaaccattaaaatctaataaagtcatgagtggagaaacagttcgaattaaattcctcacaaaagatcctaaattagcacttcctcaaggtgactttgatgtttcaggtgcattaaatcgaaaaggattatctgatgctttaaatcaagttttccaattcgaaacaccaattccatttgatttcaaaatatatggaaatttccttcgtcagtcccttagtcaagcaattcagaaatatgggatttcaacagaaaatgttattccaatagaatttttcccagcttttaaaccacctactcctgttgatgagggttcagtagaagcatggatttcctcgttaaagattcatgataagaatcttttaggatcactttatgatggaagcatatttttaaatgaacaacgttttagatataatgaacaagaacaatcacctcttaaatgcgtatcttggcttggtgctaatggtgcagtagcaggtgatcttgatgggtgtgttacatattttgattttgaatcaaataatcacaaaaaattcactcttcacaatgatgctatttattccattgccacttatccctccattgatcatttatttgttactggttgtgcagatggaagtatttcaatgtggtcaacatctgaaggtggatcattattaagtccatttgtaggtcattcagatactattcaaacacttcaatgggttgaccaaaacacgttagtcagtgcctcattagatcgaaccattcgattttgggatgtgaatgcacaacaagaaaaaagtcttttatcagcatcatgcggaattttaacggtcgccgtcagaggaccgttaattatcacggggcaccccgatagaagtattcgattatgggatattcgctcaagtgaaagaagatcagttgttaatgaatttaagtcacatacaaattgggtctcatgtttaacatgggttaatgatgaattatttgctagtggtggatatgatggagcagttaaatattggaatattggaacagaagttccattaggtacaatatcacaacatgatgaaaaagtctttgcaatagtctcatcagaagaagatttatatgcaggtggctcaggccaaacaattcatcattataaattcatttaaaaaaaaaaataaactttttataaattaaaacaatttttatttaatcaatcattgcaggaacaaaaattattgattcatcttctgtagaaacaacaaatctacaaaattcgttttcatatttaattgacaaaattttatgatcatatttccaaagaattttctttcgttttaatgttattgcattcagtattactattctattttcttcatctactaaacctatataatccatttgtttataatcccaagaattagttgcatcgacaactcttttatcatattctatttcagttatcgggcgaccgttaattgtaaaattcttaatataacacctatcgtcttcgccctccccaaaaaccactatcgtacctaaacaatgacaaattataacgttcttcgcgtaaacgttctttttgaaatttaatgaaacgactctaagtaaatttaattggggcaataaactaataaccattgagttatctttggaacaagttaccccaattccataatcgacacttgtatcgcaacataagattgcgtcatggtgagccattaaagaattcaccaaaacaattttattatctttttgtttaaacttccataacccaatacacgaatcagatccaccactaattacgtaattaccgaaagcttttatacatacaatacctgacaaatgtggtgtattataagacactataattgaacaagaaacatcatcgaatactcttaagtaaagtgaattttcgacggtaaaagcgaatgaagtctccaacagataagcgattttgttattttcctttgggaatatgtccaattttttagaattctggaaatttacttggaagtaagaagctgttgatctaatacaaaacaatttactattttgtaatactgtatatactttaatatcttcatatgtattactaaacactttaaaatcaacaacaaccgaatgaatgttttgtaagaatataattctttgttcattaacatcatttgtcggtaaagaatttatatgatgactaaagaataattgttgtggtacaattccaatagtatttaaatattcgacagtcatttcagggtcttcttttccgattccattctctgaccaaacgtttggatatatttgaggtggatatgtattcatatcttcaacagagtattgtttaattccccatatcatatctatccaataatttaagttattacggacataattactttctaatgctatgatatgattatatatttgttccattggcgtcttactatacttagatagtcgtacatcagaaatagacttttgttcaatatctttccctaaatcgaattcattcgaattaattaaaaattcacaatcaaaataaaactctggtgtatactctttcactgctttcccaaaccttaagatcgatgatatgtttcctggtatggaaaaaaacattcgcatcggtaaatcaaatttcccgtcttgtaatgtaacatgtaatgtagtaaatggttctaagcgtactaagtataatccaatagaaaaaacattcgtataaagcgctgagaaaatatatgaattccctgagaataatgtttgcctggataactcttgaacacttgacttgttctgccataagatgttcttggataagtctctgtaattttccgctgattcgaaatcgatttcttcttcgtctgatatgatcaaaataggaaaaactggataaatgcgtccatctaaaaaggatcgacctgataataggtttaaccacattaaataatcaaagttggataattgacgatgacgccaacgttgtgttaattttaagttttcaatttcaatatgtgatggattttcttggaaaaagattttgttgggtaattggattttctttaagttggagatgaatttgtgcgatttttgattaggaaattggaataaataacactttttgtcagtggtaaatatttgtattgactgtggcatttgttgataccaacaccaaaacaaatattggactttggtgttcttaatgaatacacacttgtttttggttaaatacatataacctttggagataacattaaatattccgttagttcttttcttcgggattaatactattcgattacattcatcactccatataatttgactagtattaagagtaggtaaaggttcatgtttcttttcaattttatcaataattaaattcggttgtaattgttctatttcttgtaacgtagtacgattattagaattacgttttaatgattcctttaagtggttatcaaaatgatgatttcgtacttctaaaataggtctaaaacgaaaatcatattgattcccacgtttaaaatacggttttgttttattttcataaaacggcgaacgatcataagccaaagaaaagtagagtctttgccacgaccgtttatgctcattttgttttgaaatgaacgataattttccccagaattttgttgtcaaaatttcaatacgcggaatttctaattcgaatttatttaaagttttataaaattcttcgaataattgtacagatatttcaacgtttgttgctaaattatttttgtttaaagtttttgcataaattattggtaaatatttttcagtatttttaacttttttaatgatataattaattaaatttataatatcttttttcattgtatcatataaaaatgaagaaattatgaaaaaagataaatagcttaatgatttatttgagatatataatgtatgaagttgtaataattgaaatgctgatttcgtatcttgccatttattatcgtatatatgtaaaccatatttaggctttatatcgattttattaaatttaatgaattggaacacgtctaattcgtcatcattttcttcttcttcattatcataaaacgacaaatgataattatataaataatatgaacaaatcaaatttatgaatttattaacaagttttatatcatttaatttaccaatttgtactattaaatcaacaattaaattattcactaaagttcgattattatatttctttaaaatcgatataatatcaatacaagacaaaaacttatttaaaaattcgaaattatttaataaaacttcatccaaataattaatcaaatcattccatttaaataagattataaaacttaagaaataaacaaaagttattgatttaatacattcattaaattcgggcattgtaaatgattctttaataaagtcataagcacatttactatcttcttcatttaatttataagaagatattatcaaaatcgataagcatttacaactatggaaattacataaatattttgttaaatcaactaagaattcatttgaataattttctattaattgtacaaaaaatatcaaaaatttgttaatatatttctcttcaattgcaataaatttctcaatgattatacataatatcattggatcttctgtatataagaaatcatgtgtaacgattatatgtttagtaatttcattttttgtgtttaatgaatttaatacttctaatatagtacaaatactttcataattaatattatctgtttctactaatttaaacaataataaaatgttattttcttcattatttaattctaaaatcgattttaatatgtttttaaatccatttaatacattaatatcaattttcttatttaatatacatgaattaaataattggattacattcatatatacgttatttaactcattgatattattagtttcatttacaagacttttccaatcatttaatataattggtatagtttttacatcggatttctcccataaccccgaattaaatattaaatgatctcgataatttttaagttctttaaattcattatcatatgaaaatataattttccaattctttttagttaataaatttggattcatatttaaaaaaaaatcgataatagaaaacgcatcaattaaatcaatttcttgtaaaaattttttatttctaatcaaaatgttcattaaaaagttatacaaaatctcaaagaaatttaaatcatttaagttaataaatgaaaataatgaaactaaatatgaaatacctttcgatacttcaaaaactcgttcgaatcgattcacaaatttaaacattataccattaaattcacttggttgtccttgaatataatataaagtattttgtttttttaatctcgttgtatataaagatataattttcgaatcatttaataatcgtataaaactttttaatggcgtttcatatatttgttttgctaaattcttttgtacaggtaatgaataaaaactaatttgaccaaataacatatcgatcatttcgaagttcttttcagtatctttatatatataaattttatctatttcatttatcaatgaactttttgttaatttttgttcatatatttcattcgtatttaataaaacttttaagtaatttaccggattaaattcgatatataaattattccattgatttgtaggtactttattattaatgattatagtatgaaagatatttgtagttgattttatttcaatgaattcttgaaatattcgtattaatatatccgattgtttactttgtaaatttactaatgtaatatattccgattcatttaagaaattcgatattaaaaaccataaagaaaatgcaattccattcgaatgttctttaaatgatatccccggaattaatatataatcgaattctgttgataataacaaaaaagtatccgttttcttttcttgtaccataatcattttatctaaatatttatacattaaatgataataattctttaaatgattatatttattaggattcaaatatcgtaaatatttaaataatgtctttcgatcacaaatgtttattgttatattcgagaatatatttaaaagtaattcaatcgattcttcattattattcgttaatccaatttctttaagtactaaaaaatggaaattaaaatgaaataatttaaaacattcagtgattgaattttctgtaatgtcttttaataatcgtaaaaaattaattttatatttcgtcctaaataaaatttttgaaatttcatatgtaaatttggactttattcgtatgttcttaggatgattattactaataatagttattaaatatttatatgccttttcattaagttcattagctaatattccattacttaatgtttcccaatcgatcttaatgaaattcgaaacttttggattcataaaacatttaaagaatttgataaattgattttgattttgaggattttcttcaaatttctttgttaatattaacaaataattatttgcgaaattaattttgaaatcaattgttaaatattttatataaattgtaaatatttggatcatatgataatataaatcattttcttttttaataatattataaaaaaagtaattaataattaaacttttagaaaatgtatcgaaatcatttttatattgatttaataaattcaaataaatatttattatatgtttataacagttttcattctttaataaaacttttaactttttaataaattttttattttccgataaatatttacataattcatgatgattttctaataaataattaatcttttgtaaaaactcaatgaaatattccgaattctcattgtttaatttagatgttatacatgaacttaattgtgtaataaatggcgtttcaaatggagaaatgtttaaatatatataatgtattatttcattcgcaaatattatattagaattattaaaatattcaacaaaaatatttgaaacttcttcaatggatgaataacttgagattaatttaaagattaatacacgaattggtattaatattgataattttccggttcttttggcttcaataaagttaatttctggattaaaaattttcggatttattatgaaatcttgaagtgaaattttggattcattaaataaacttaaaaatttatagttattccgctttaaaaaatgtataaataataagattaacgttataaaattaacttcagaacaattatattcattataatttattttcattaacatattaataaaatgatacatagcttttttggatagtaattgagtcaaaattgtcatcttcccaaccatgtttttggattcatttaaataatatattaatgtcccaatggttgaaaagtcatttttatgatttgctccaaatggaaattcgactgcgtctaacggttgcttgccgatcatttcgaatacaaattggacgaaattcggaaattcaattgaactgattctgatgaattcaatgcataaccctaaaattggaaatactaatgaatcatttggatttctcccgtatatctgtttaagaacttgatatatgtttaaaagctcttggtttattgggaaatttattttgtttttgtgggattgtgcaaaatgtaatacacataaaatatgaagattggcattaacttgggttgaactatcagacatgtacgaaaaaagaagcaattcgcatattgtaagatgttgtggataaaaataatctggaagatcaccaaaaagaacaactaaagaatgtaattccgaaattatttcttgaatttgagaatacttggcggcttccttgtagactttataaaataatttaatgaataaatcttgatattggatatctaaaaatttatatgcatgatttaatgcctttaaaaaaatgttccatatttctggttcctcgctaagaacatttgtatggagaaatgaaaagaaattttgtaataaaaatattcctaattgatttcttaaaaattctgaattaggcatgggaagattttctagctctggaacaacacgctttaagacacgacagctgctattgaaatcttttctgtgatctaaatttttattttgaattattgaaaattttgtttctggacgaaaagatatatcagaaagacattctttagataaaggaagtttaaatatttttgttttttctatttctttgattttaacaataagtttttcttcttcttttgattccattttttacatctgtatcgtggccgattcaaattcacgagtataaacggttctatattgaaatcatgacatatcgttgctcttattttttgattgaaataaataattgagatatttgataagggtatggtaggtagataagagtgtgtttgtccgagcattgaatttcctatcggctcatacaaaataccactttttaagagatcaaaaattctaaaacaaagattgaataatttatttatgtgaaacatttttgatagattttgaagtgaaagattttgacttcttacaagaaaaaagtattagttgggggttcaatttcgtctgtatcttcattaggtttttcatctgttgtattaggaatatttttctgatgtctatggaaacgaatcaaaactactactaatgaaatgagtagaattattgcaacactaccacaaattaaaccaattaatattggttttgataaagttttagatttattggaataatcatttgtaactaagaaataacctgaataatgaattaaagttggtaataaaacagtttgataattataattaatagaatttgtaattataaatgttaaagttgaatcatgttcagttaatattttggcgaatgaaataaaggaatttaaaatcgtaaatgatacagaaattgtaatagaattggttgtaaagtatgagtgtgatatagataccccataatatgtgaatgtttgtgattgtatattcatagtgggatatatattgtcaatcgtagaagttaattcttgagtttctgatattgtttctacaaatgtatgttcaattgtttcagatttttcatgatcattatcatctactctatcattaataattaaattttgtttgtttggaatatcttctaatttcacagttcctccataaataacattaagtttcttttcacttgtaattttcaaattaggcattttatatgatgaaagaataattgttagattttttgatgttactttaatttcaatttctttgaaattatttgatattattttcgtttcatttacttcaatttcgtcatcttttatttcgatttgatttactatacagttttgtattgttattgattttccacatagaaaagtttgcattatttttaatgaatttgtatctgtgattacattatttgcattaagtatttcaggtgtattatttccaatgaaatttaatcctttcatttctaaatcccataatgtaatattttctttccccttaaatccaatatataaattttgaagtttggttgttgaatgtttgattaaatcactataattcgttatttgatcattattaatccataaaggagaaccatcttcagtttttatttgataatttttttgtaataaaacccatggatcaatggttggagcttttgttgtaacttcagttggatactttgataaaagaatattaatatcgctatcttgaaccattttataaaatttattgagattagcttctgttgaaaatttattatattctttagaacatgttttactgtcattttcataatatgatgaacatatatagttcgggaaacaatctactgcccagaattcataatcaatgttttgtgaagaattccatttctttgaagtaatggatacttgacaatgtgattcaaaagaaatttctgatatattttcaatttctataactattagtttcttttcaagatgaataactttggttgaaagtaatttgtcatcacatttcacagaacctgtagtgcctgatggaaattcaatcataaattttggtacaagtgaaattcgaggatatattaagcgataaggaactggacctggtggaggatatgcaatgaaatcttgtgaattagataaattataccaaccaagtactaattgagatgtgtaattatcataaacaccaaatgcactttcagaaagagatggggcgaaaagtttcatacgatgtctaacttccttactgaattcaccttcatcttgaacaaatgcatctatagcacggtgggatggggaagatcctttgttaatatttgaattcataatagcagtcatagcatctttattacaacacttggattgaggacatgattttaaatatggaaactcaggatttaaagctataatcatacaacctttttgcgctgctatttgttttgatcctctattgtatgtaactgatgacaatccaaccagatttcgataaaagtttgtacgcctctctacgtcatctacagtttcaggattcaatatcccaagatcgcaattatctggatcagaaggagcaatccaactccatcccgaatttgctatatattgatttttcatcattaagcaaacttcctcttttgttctattttgtaactttaaaagctgttcaggagtatatggataagcaagattaaataaaattaatattaaatacattaatactgaattattgatttaaactttataaattgagatcaaagtaccttttaagaagtactcaaatttgaatattggaaaactcggatttatgtagatagacgccagtgtaatgaattaattgtaccaatcaaatggtttttagttaattttctgtttctgcctccaattttatgtctcaagagccaaatttatcattttcaaaacaaattaaatacatttattaaatatcatcgtcaacttccagatcgagatttgtttccaatctttctacctcatttactcttgtgagttgccgtgtcactcctttgctttcactcgccaatttatcaaatgtgtccaagtgtttcctgagagattcaacaatagctttcttgaccgtatcgcgaagctctggcgtcatttcctgcggaccgtggttagcattcgggtcttctttgtcccgtcctttccttcgcgtgtatcgatgcttgattcgagctcgatgtcgtggagtattagattcatcgttttcatttggtttgtgttctttaggcgccatgaactcaggaatcgtttggttatattcattggaacatgaattaacgatttcggggatttcgtcaagcattgatgagatttgtacatatgctaatgaatacgttaaattggtctgtggtggctcagtttgaggctctcttaaaatttcatttagtttttgaagtaattcgcgcttagtttcgccatcatcgattttcatgattaattcggagatcgattcaactttcatatcccaaaacctgttgaaacctgtgatgccaagaatgtcaaaacaacgctctgtgagatcaaataagctttcatagagacttggagtatatttaagattccatttggaatttgcttcttcaaatgcaggtgctctatcatcaacaaggacatctccatctatttgttcttcatttgttttagaatttcctttaacaactttttcaattctatcaaaaatacaagatattatttcttcgacacatctattcctttcactttcatgtaatgacttatcaatggttgctctaaattcggaaagatttggagctgatacatcacatctcccatgaagggagaccgttaaaggtagatcggtttcggcagttggggtggtccgcattatccacttttctgtaaaacaaccggcgatgttagatttgaatgcgaactcgaaccttttggaattgccaggaagaatagagccactccgctgaacaaaagagaactcagacggagaagggtcttttaggcctttagcaacaataaaagattcagaatctctccaattaaaattatcaatatcttcaacaggtttccgaattggaacacgagatgaacctgagccaagtaaaagtgttacgtcttttgctttttcccatttgtaataaacagcagtagttccggtgtttttaacatcaacaaacatcgattttgcaattccgggttctgttgtgaaaaaaagtcgatttttgttaattgatagtcgtacaacgctttgtattgactcttcgttttctgtagttatctcttcttctggaatttcttcatgttcatcttctggtggatttacattttcaaattgtgataaatcaataggttgaccaacaacaataagaccattaaaatccggattatgtggcttaattttgcccagaaatgatttaagctgtttgacacgctttttgtagtatttcgatttgaaaaaatctgtcggtcttgaaccaggaacatcttccatgattgtaggatcgcctatagcttcatatgtgactggatgcggtttctctggctgtgcaaaaaggtcaccaattcgtggaattggtttccatacaccagaatctttcgttgataaaatattaacaacttgagaaattaaagctctctcttcattgactcttctaaatttttcatcactaaacattgataatgttgatgggtctctatttgttaattcggctaatctttgagcttgctctttccaatgtttttgaactttttcatgatacttcattgccctttcttcgcgcgttgcttcaaatggtttgtattcttgtaaacgtcgttggcgatttggatcttttgttctcataaagtatcaattaaaataacgtaaaaacggtttataagaactaataatgaaaaagtcgatttttgaatgaaaaacgataatattatcgttcaaaatcgtaatgaagaaaacaaaaacgatttcgttcttatctgcatgtttctgcttatttatttccttaaaattagataaattactcgaattatttccaagcaaatgttaacatttaagtaattattcataataattcattatcaatttcaatcagatatcaaaaaatttgataacaaaaaaagtcaaaaagcggtcgtttagaagccgcaaactgttggacgctttgtggagaggatcttcttttgtgaagcgtgagctggacggatttgtctcttaaggattgggaacttaacgctagggttaaggaacatacgaaggttgtgatgaacaacatcttcatctttgatttcgctaacacgaatgattgagatgttcttagcttgaacgttatgagttccagccatttcctggtagaggcggagaacagctccttctgttgttgtgtcacggaattccttataaatgttgttgattgaatttgtagcacgataagttaaccaaattccatagttcttgacgcgttcaggttcaggttcaatgacgtgcttaactgcaaggatttcaccatgtgctttcttgagacgagcaattcgacgagcaacaccccagaattttgatttagcaataacttcgtcaggagcaaaaacttgaacgcggatagcagctgggtttggaacagcttcagttgggagagggcgagcaattacctcgtaattcttgagcatctccaaaaaaggaagggccataccgacatgttagttgaaataaaaaccaccacagagagaacgtttgcctctctcaattttttaaagatatacgatcaaattctttttaatttgtttattatgcttcttgaatttcgtaatgtgctatataatcattgaaataacgaaagagttgtgcccaccaagacatttcgtctgagacactccaatattcaatatattttatgcccggacacatactttcgatttcttttggatcatatgttccccacttaaaacgtgccgacgttttagatacagtatcatgcttatcactatgtgcaacagcaaatggtgtcataagctccactacaaatgatgcgcctgggaatttattcttgagatattccaatatctgaacattttcttcacgtgtgaagtacattacggtcccttcacacaacaagatcacttttcttccatttgctttcacatcatcacaccatgattgatcaaatatattttttggaatcgcatgatgtctttctgtgtcattaataaacttacttctaaaatctatgacttcaggtaaatcaagatcataccagtcaagttgaccattatctaatcgaaagaatctggtatcaagtccacaaccaagattcacaacaacgcaatttggattttcatttataagcttttttaggcatcgatcaattagaattgttcttgattgacagccagccatagacattgcaccttcgaactttgagaaatcatagtcaatttgattcttaatctccaaagctaatggatctgtaaaccttatttcattttgaggcttttcttgctcgagtgccctcgctagaagaggtataagtaaggtctcaggaacaccagttaattcacacttcgacataagtgaaatgaagtaagaattctgttacatcaaagttgatttgtgtactttactcatatcactttcgatcgctactatggttctatgttacaaaatatacatgtatattaaatataaaaggatattagaaatatggaaattattatacttgctaaaagcacagaagaagaaatagaactatatttttacgcaaagcaaatctcataattaattgtcatcaatcatttaaaaagatgtaattaataaaaatttacatgatacaatttgcttcatattagaattttatagaaacacttttaatatttacaaattctaaatatgaaaatataagctgctatcgattacgaggaattttttaaataaaaaaataactgtaaaacaatgtctattcttttaaacataataaaatcagttcatgcaaattgataaaattaaattcatcaaaaaaacattcatttctaatgtggtcttttatttaacaattaatattgatttttattatattctggttaagattgagttgctgttggatgcattttttctctgttctgccaaaagttatcttcttttggtggcaaaaaatttgggcaaaacagcatcaaagaagtggaatcgaaaaaatcattgcccttaaaatcgagcttgatttcgtgtacagacttagtagcaaataagtcttctacacatgacgaatttggttgcttgagcattctgactttttcttcatatgattcaaaggaatttccgacaatgatgagatgttgtagctgagattcatcccagttagcaaggagtaagttatgatatagaaaacgaggacaatgtggcatgtaaaatgcagtatttggagaaaactttataaatccctctaaatcttcctcttcacattcaaaccccattctcgtaagtatagaacgacaactttcacataaaacaggatcaaaatatgtgatgttctggatgttgcattttgtagaaagttttaaaataaatgaagtttgaagcctagcagcagcgcttttacatggatctcctatacctaggcaacgaattgaatttattccctttttgttgaattcatcacataatacatcaaatgctggaaattgatttacttctattttgttaatttcatcctcaagattttcaggtgggattgttaaataaacaataggtattggttttgatattctctttcttctccttgacattcttgaccaaaagaacgttaaaaagaaacatcgaaacttgcttgaaaaaagaaaatataacattatttttagttacgttcaccacgaattctttgtgcaagttgaacatcacgttccataatagtaacacgatttgcatgaattgcacaaagatttgtatcttcaaagagacctacaagataagcttcagaagcttcttgaagagctgcaattgctgatgattggaaacgaagatcaccacggaatccagatgcgatttcacgaacaagacgttggaatggaagcttcctaattaaaagatctgtactcttttgatatttacggatttcacgaagagcaactgtacctggtctgaaacgatgttgcttcttagcaccctgtgaatcaacaacaggtgttgacttacgagctgccttagcaccgagtgatttacgtggagtcttaccaccagtagatttacgagcagtttgctttgtacgagccatgaattttataaaaatgagttaaaagattttaccgccaaattgattcaaaacgcgcgggcttttttagatacaaaatgtcattttagatcacattaaattcaaactaatttcaattcgaaaaacggtttacatacaataacttttttgaataatattatttactaataagcactcgtaatcattttaaagtaataaccattgtctaccaagaggttgctaataccaaatatactttgaaattccacagaattaaaattaaaataatttttatatattatgggtttgtaaaatgatacatttcatataagtcactccttgcatgacaaaatgctaatgcagtatcgacagatattttgaaaattggcgctggttcatggaatcttgagcccatcacactcactagtgctctctgtgccggtgaatacactgcagatgttgagtgttctcttggcaacataaaaagaccagaattatttacaatgccatcacttatcgataatgtattattatctggtctgacatgaaatgcaaaccaccagtgacgtttaacatcgagggcgaatatgtgcataaacctttggctagattcgcctccaacgaggaaaatatactcatcaccagaaattagtgtggcatgtggtaagtttgcagaaggctctgtaccagtgcatgggaaaggctcaaaatggcatgtagtaggatcaaatgtactcattggcgttcccgatgatccgaagatgaagtacttcccttggtaaaaacaaaaggctggagccgctataccagtctgagaggtcgaagctttctgccaaacaccttcggtgatgtcgatgcgatatagaccattgtgaattcgaccatcgtaaccagcccagagaaagagatatctgtctgaggcaaaaagagctgggtttgtacgagctgcaggaagagttcctgtaactggaatttcatgaactgaaccgtcatctaaatttatgtaatgaagatcggaaaagaattgaccattggcagtgcctccaaaaataaccatgtttcgacccattaaacacgcagaacaatattgtcgtggctcatgaagttgtctattgataattcgccatttcatagatccgagatttaacgcccaacaatcattgaggcaaacactgtttgggtctgaaccatatgcaataacaatagaatctgtaactggatcataaacatgacattggcctattcgaggcgtaggtgatattccgttggataaatgcattgaccattttccataataagctgtgttcattaattgtgttggtctatcttgaatcaaatcgggtttaaaactggatgaataattggcttctgtacgttgagatgtgataggagtatattgaagtgtatcaaacatttttgcgtaggtttgtttatttgcttgacttgtttcgtttcccatccttgttcaactgaagtattttgagaagatagtcggtcaggtaaaccgacaccagtagcggaaaaagtcaatttctgaagaaagagaacaaagttaacgcaaatttgagaagagcgatatctatcgggcgttgtaaaataacggaacaacataaaatgtttttgctgaaaaaaagtatttgattggattctagaaaacacaatgtttttgttttaattaagatactgctattgtttctaatttagtttcaaaaaactaacattttcaggaacaagtatatattatcaatacaacaacattatcattgatgcttaagacatgtagaaagcaggcccttggtattaaaatgcttttttattattagattaaggaaatgctcttataataccaaactcaaaatgcttatctttgtgaactgagatgaggccctcttgaatgtgtttgctttaacgagtgtataatcatgtatattcaaaataaattttgaatgaaataaaattggctgtgtttctcatgataacagaacaaattgaataggcaactccttaggagtttcttttgatgtaagtaataagaatgtcaacttttagtaataattcgtattttaaaatttgagagctcctgagttttaaccagaaaaaacgaaagacatcatgtaatgtcatgcttccaaagtttatgtatattctttacagtgagtgtttctagatccatctcctaattgaatttaaaaaacagatttaggcataagaaataaaaccaaaatgatagctaacacttggactatagaatcattttgttattttttgtgcataactcgagttataaggttttcgagcttttgccacagctcacataaaacggggtaccctgacgatggaaaaatttgtcttttattcctgaataagtggtggtggaagtcgttcaacaatctcttgtctctgttcagcagtgtaaatttcgaacattcctgttgaagctctagcacaagcgacttcaatgttattttcacttaatttctcctgaataacttgtctaagagttgacaatgcgaggtcttctgcttctttaagtgtgaggccatcatggtatgattcacgaaggatggcttcagcaccttcgctacctccaccaatggcacgagctcgacatttagtatatgtaccacttggatcagtgtgataaagatatggctttccatcttctactccagaaacaaggagagctgtaccaaatggacgtgacatttgtccttcgcgtttctttttccttccttcaccaaatgaaagtgctaaatcgcaaacagattcagttactgcatggataccaattggttcaccgaatgaaaagcgatgattttgagctgcaacacgcatgtgatcaaccattgttctaccatctgctgtaagaccggccataacaacgccaatgtgatcatcaatagcatagactttttcgactgatgatgggattaagagtggtgatgaaagtctcttttcaacagcaaatacaacaccttctggacaaagaattgcgattgctgatgaaccaagtttgacagcttcgtttgcatactcgacttgaagaagacgaccatctgggctaaatgtatttacattgcggtcatactcagatgagctttggaacattttttaagaataaaaaacagtcaatttttcaattaagtttgttcgaacaaccaactcaaaacgaccgttaattgacaagaagaaaaatttcttttggaatttcctttaaaaaaataaaattcacatatgctactcacgaaaataggttaaacaaaaaaaatgttgtgtgtgtgtttaggaattcctagctaattagcttacttggagaagcttgatatccaagctgggatgaagcttgcacaaacttgtgaaaggatcatcgatgctgctggttggaagtttgagaagatgagatgggaacctatgaggagaaggaagcaatagaatgcattattgtagaaaagtgtgaagaaaactccttctgaagccttgacttgaacttgtgcagtcttcttgcttttcatttgtacgcttctttgttttgtaacccattcagcaacttgagcataagcaactgtaagtccaacgactccaatagcataggcaacaataatgtagacgatttgttctttgatatcaactccacctacagcgacatagagaataactccaattaaactgaaaattaatccaaatggaaggaacttaagactctttgaaaagcctcttggttgacgctttgatctaagttcattgtataattcgtcttggtcttccgtatttcggtttgctccggggctttgctttcttggcatctttgcgagtggctcaactatgtcacttttataaccgatattatttaaacgttcgaaaaccactgtttttatttttatggatgaaaaagcacaaaggaactttataatcggatcactcattggagctgtagccgtattcctatctggaatgctggttctcctttattgtatttgtatccatattcaacacgacgatctatccgatattgaggcgaatgatgtttctaattctgatactgaaattgatgatgagcttccagaggaaatttaattttagtgctcaaacacgatcatatttttcaaacttgcattgaaatcaggaaaacgagttaacgaagaaacaaaaattctgggtttgttaatcaattttgtccatggagtaatcatatgttttttatgtaataataaaatataaattttatatttttggagttttcttcaagaaaaacgtttaaattaatggagaaatcttttgcaaaatcatcaagacttatcgattcatttttccttgaatttttatctagttcaaaatgcaatctagatttcctcaagcttaaagaatttcttcaaaataatcaatcaatagataatttttttgatagttttcttattacagaaccttcaaaatctagatctcctagaaagatgttgccacaatctcctgtagtttcatcaaagtctaagagtccaattcccaaatcatatgataattcaatttcattcagtaaaacaataacaaacataattcctcctttctacaaacaagaaattacaaataaaattgattttaattccatatattctaaaaatcaaattattactttagaaatgtttactcaaattctttcagatttaagtcttccatctttttttgccaagccaatgatggaagcgttatgtccttctattctagaaacccaaaattatgaaatagtttattcctcttttctacaatttgcaattccaaaacttgaaaacgcaaatcttcatgaacaaatttttaaaatattattaaacaataacgatcgtccatatcttattccttctgatttttcaccctatatttcatcgttaattaattcgcataaatcactaaaatttcttgatcgtgattcacacttacattctgcatatgaaaattgcattatctcgcgtatattttattgtcttgatccagaggttcgcgaaacgatcacatttcaaaggtttacaaattccaatttttgtgaatgtctatgtatcgttgacacaacagaagatatatccgatgtcttagatttttttagttatgaacatttttatgtactttatacattatttattgacattgatattcaagataatggatttctaacaattgaacaactttcatcatatgattatcatcgaatttcattaccactttgccaaagaattatacaatttttacctggttcgaaagacatgaataaaatcacatttaatgaattcatatattttgtaattgctgttgaagataagacaacagaaacagcgttaaggctatggtttcatacatgtgacttagatgatgatggaattctttctatttatgaaataaagcaattatataaaatacaaaaagaaaaaatgatcgaaaatgatatggacccgataagttttgattacatatattcacaaattatagatttgatcgggtgttgtgagaatggaataacaatgaaaatgttgaggaatagtggaaaatgggaaacattttttaatatacttgtcgactttaagcagttcactgaatgggaattctgtgatccaatgtatgaagataatatgagtgcgggttctgatggaatgaaaagatgggacaagttctgtgatgaagaatatattaaactttcatgttagtaaaaaaagtattgttttgatataaaactttatctattatttttctaatatttataatatattatgaaacactacgtaaaacatttcatatggttgtttgatttctcaaaaaaattaaagaaatgataggatcaaatattatcgaaatttgtgatggtgcatgaaatgaatattctcatcttcagaaccaatttcaattgttaatattgtatttgcaggtgttatccattcatatatagatgcatatataggaagtataacaattggcacattgaatacatacaaaggaattcaggaatgcatatcaataacaccttcacaagcatcaacagaattaattttcataattttgtacttttatacatacatcaaaaattattattttatactttagaccaaatgaaaaattattttcatgttgtatcgaaattcagtaatgattgtttgactctgtgcttcaagtaattgaaatgacgatatatgtttccaaaagtgccgaactaacatatgaaaatagatatgatgaaaatgaatatgaagtttgataaatatccaatttcatcataagaacaaaagacacattaataatatttgattatcatatcatataataaaaaatgattttctttttttaatgaatatagacagaccgcaaaagaatgccagtcataaacaaacctcctttttattatttttagatagtgtacaatgatatggtcaaatggtatgaacagctacaactccattaagaaaggaggaataaatattaataatcaaaattttttatttttttatttactgtttattataatattttaaaatttattaatattttttgataattatttcaaaaatttggtcttacacttgttgaagcagctcaagaaggatctattgacatagtaaaacaacttcttgaacaaggaaaagatgttaatactagaggtattaatttttattgtttatgatttattttaatattttcagatttcaaaattttattcggaaattaattaaaacatttaaaacagcacttatttgtgccacactttttagaaaaatagatatcgttcaattacttctagaacaagaaggaattgacattaattcaaaagatattcatttatttaacttaatgtttattttaattatgtattatttcataatagtatttggaaattatttaaaatataagatacaacttattgttgcatctaaaaataactttatagatatcgttcaattacttcttcaacaaaaaggaattgatattaatgtcaaaaatatttatttattctattcaatgtttgtgttattcatttaatatttcactcaagctttgcgctttgctctttaatccttactgttaaggaaaagcgatactcgcaaattccttaaaaggaatcaattgatcttagtttgcttactgcacgttggagcgcattaaattgatatctcataaaaacacattttattatttaaataataagcagaagaaaaaattataaaaatttatttataacaatatttattcagttacaagatctttcagtgatgataacatttcatggattgcgttgttgttattgtctagttctaattggagagtttcatcttgtttttccaattcttcattttcatgttgaagattttcaagaactttgcgaagttttataatttcttgttccttagaccgaagaattatatttcgttcgatttcttcgggatctcgttcttcaaaatcaaaagctgacatatcaacttcgaatttggttgaattttcaataagttcatcaagtctattaagcttttggattatattcttttcatttagtatttcttctaattcgtcaaaacaatttttttcgatatttggaattagtaattttgaaatgtttgtaattcgttctttaggaatagatgaaataaatttacccaattcttctggtgaaagaggtttgagagtttccttaagaaatttctgatatactgaataaagcctttctgcacgtgagtgcatttttgattacgtttatttttaaaaaagtgacaaatatatgcatatattgtatattttggcttaaacaaattgttttttacttaattcaagataagatagaattatctgctgaagcaacaattaaatattttgaaactaattataaatattcttttaacatacttcttgcgaaatttcgttttgtaatttgaaatttgtgattttttagtaagaaaacggaaaaatttacctcgttcttttatcgattctaagtattatgcaaaaaggaattgatgttaatgataaagatatttgtttgttttaatatagggggtgcaaacagttttgaccccacccatttgtttgaataaaaaagatatttgttacaaatatacttttatttaaagaagtggtcttcgtgattcttagtcacctactaaagtctttttatctatgataggaacatagttaaagctttctaaaagtggcaatttgaaatatacatataatttcatttccatactctcgaaattttccttaactattacaaagaattaaatatcgtactatcttaaatctaattactgatacagataagaacttcttttaaggcttttctcttaagatttttaaacaatactttttttaatgtgaacgatatgcacctttatctttttcatatgaatccaatttttgttactaattagtattttcaaaaaaattataacataatttgatttatggattaaatttgaatttaagatataatccatatatccatatcattttgtataatcgataaaataattgaacataattttttacattgaatattcttatatatcatcattgacactttattacgtgattttctatatatttttctaataaaatatttagaaaatttctattactaatcattaattaaatttgtattaaataaattttttataactttaataaaatcatagaaaattatttcggaattttcgaaccttttccatctattgttcacagatagcatatggggatcttttttcgacaatatttttttaatacaagcaattaagccaaattttatttacttatgttacataatacttctatttctgattcaattgattttatggataaaaataattgctcatcaagtattgcatgattttttaattttcttaactctaggcattttgcttccacctaaaatcattgtaaattaggttacctaaaaaatttctataatataatttagaacctgtaaaatagagactaaattcaaaaaaagcagtatttttttctttatattaattgataccctattctttgtagaaaattttatttgatgacatttttgagttcctgctttttattgggtttgaaaatcataaaagtgacaatcatgagtagaaaaaattcaatcatctaaatttcaacaagtaaactaaatttttaaaaaatattaaaatagacatcaagttcatttattatagtttttatttatatataatttatttttcttggtcaagaggatgttgagaaaagggggtcaggactttttgtaccctatacaatttccaaataatattatttggtccaattctttctcctcttccacatccccaagatttcaatatcaataagtttcagatttcagaaaaagatttataataaggttatccatccacaagaaaaaaatatcatttttaaaagaatttgattttttttaaccatctttatgtataaaccatactcaaaataataaattttaaccaaaaatatttatatatttaaatatacattttttattagcttaaatatagtctctagaatgtattctgcttcaattgaaagaatttaaacggtttcatatgattgtaaattaaaaagtgacaaaatgggaatcgtttcttcgattctttcttggttctcaagcaaaaaagaggtaaaagtattgattcttgggcttgactcagcagggaaaacaacaatattatacaggctttctctcggacaatatgtgcaacaagtagcaccaacagttgcattcaatcttgaaaaagttgaagtaggaaatcttactttacgtatttgggatatcggtggccagcaacaacttcgtccatattggcgcctttatttcaaagatattaatggaattgttttcgttgttgattctgcagacaaagaaagaattaacatttgtaacagtgagcttcatgctctgttaaaagaagaagaacttaaaggcattccattgatagttttagcaaataaacaagatcttgaagatgctatgaaaccagaagaagtaagccaaaaattagacttatcatcaatcaaagacagagattggactataatgccaacaagtgccttgaatggagatggcgtttctactgcatttgaatggctatcagaaaatatggaaggaaaataatttattaaaataaaaactttcaactttttatagtgtaattatgcacgaacgaaaacatattgacattttttgtactcataatcaattatttataaacatttttataaacattatttgatatttactgttcttttttagccaataaaatggggttgcgattataaataatcttttttattgttgttattatttgctatttttcattgtttcatggttttcacaactttactacaaaagtcaaaaaatttgaaatattttaattaaaatacatattttaataattattcttaataagttcagtggctatctgggaaaaatcatcactactattttcaacaaactgtaaaaattccaaaattttttcaattatttgagaattttcttcatcagttttttgcataagtattttcccagcgctttttacagctatttcttctatctcaagaaaacctgtctcagccacttcatacgccattatgatgacatttaatttataatcgaactcaaaatatttaagtccacaaatattcactaaagcaagaacaaaatacgcagcgctttccttagccgaatattgcgtatcatttaacaacgcgttacaaaaacaaattgcgttattataatcaaaattatcccactcaattaaatccctcatttttaaagctaaaagtttcattgcgactgaagttatatctttatctttacattctaccattaatatatgatgatacttttgggctaaatcaaaaacaatttgctcatttacaaaattcgaaatttcttgattacatttaataaactcagaaaacaattgtaaaacagaataaataattttcggatgttgatcaacatgaattaattcacttaaagtttcaataattccattttcaaaatatttaaatcgtaaatcatttcgattgtcccaaattttttgcaagtttttacatatgatatatataatatgtaaagtaggttcttcttctcgaattgtcgttatataaaattgtaatactatatcgataacattcggatgtattgttttccatttgcaaatgttaccaaaaaaattaaacgttcctttttcaatattttcattttcttcattacggatttctttacaaatctgaagcttggagcaataaatatcaaaaaacgattgatggccattgattggttgaagaaatagctgacaaacgccttcatgaagtgatgcaagttgacttagaactcgtacaatgaagtaaggaagattatatctgactttgtcagacataaactgggtgtattctaaaaagggataaaatgtttgtaatgattcagaccgaagaaaaaaattaattgtttcaggatatattgataaaagtaaatatataatttgaagtgacctgatttggcactcaaggctgcttcttagattattcgcaatggaaagaagtaattgaaataaggaagtttgataaacaatttcaagttttggcggcgtacgttctcttaaatattcatgaaacataaaaaggttgttttctaatgtgcttgaatcaatttcttcttgattattgagatttcgaatttgaccaattaatggaacccaactaacagtcgactttccttcttttgttaatagttcttcttgtgttttaaatcgtttttttcgtggagttttcttatataatgacaataaattcattttgtaatgcgacgccaaagaccgttaatataaccgaccgttaaatactggaaaagttttacacaaattgttcaagtaaaatgtggattgaactatcaattctgattatcattctagaatttttacttagtcaatatcttatgcgtaggcaaaggaaaacaattaaaaatgcaaaatctccacctgaaatttataaagatcaatttactgatgaagaatttcaaactgctaaaaattatgcactcgacaagataaacttttctattttaatggatgttgttgataccattgaaagcatcattgaagtttttattctttctaaattatggaaattaaccgctatttttgaaagtgagattattcattcactcatctttttagcgctttcctctgtattaagtaccatactttcaattccttctagttattattccaattttgttattgaacaaaaatatggctttaacaatctcacaatcaaactttggcttactgacaaggttaagagtcttatcatcaaccttattatcagctctattcttattccaataataattttcatctacaacaaggccggtgccaaatttgttcttgttgcccaaatcatcattgtcatactttcgcttgttcttaatgtcattgcgcccattcttatcattcctcttttcacagttcttacaccaatcgttgaaggcccaatttatgactccatttcgaaactttgtcaagaatccgaatttaacattggcaaaatatatgaagccgatgactcaaagcgttcatcacataccaacgcaatggtatttggactttttactaagaagattgcattagctgatacacttgttaaaaactcaacgcccgaaaagatcgctgctgttgttggacatgagattggccactcgaaacatcatcacatattgaaacaatttttgatatctcaagtaagtacatctttgatgttaacaacactttacttcgtaatgagcttggataagccttttgtggaattcggctttagtgataagcctttaattgctggtataataatcacgacgttaatcgcaacgccattcagcgatttgttggatttgcctttgaacatgctatcaagatatatggaaaggcaggcagacgaatttgctgctttgaaaggtttgcctttggatgaggctttgatagatttggtgaaggataataagtcaccaattgaacctgaccctttatacgccgctttcgtaagtagtcacccaactactgtggaaagagtgaaattcgtaagagaaatacaaaagaaattaaagaaaaaagattagatgtaaaataaaagtggcgtttaagctgacattacgatcattttttactcaaaaaaaaacatttgaatgaagtgtacgtttgtaacaaggcgccccaaaatgtttcttctcttattccaatgcgtaatttcgacatcaattcaattaaacaaagaaacaatagacgatgttttcaacaaatctcttccaattttcgtagaaatatgggatccatggtgccaacattgcaaacatttcaagccttcatgggaagctttaagtaatgatcctgagttatcagacaaagttatttttgcagatgttaattgcgttagtcaaaaatctatcgcaaaacaatttcctggttctggcacgcctagatttttttgggttgactcaaggacaaaaagcaaacgtcaatatgttggacccaacattgatttgttaatgcgtgatttcatattaaaacagcttcatccgacaatttaccaaattgatcaaaatagtattccaaatcttagcacatacgcaagtgtccaaccaatttttttctttaacatctcaaaggttgatgatacatcaattcatctttgcgaagaacttgtttctgagcattccaatctcgatgttaattttactgtttattatgatgatacaattcatcaccctactgtaacatggattgcgcgtgatggggtaaccaattctttcaatttagaatggaattatgaaaatcttcataatttcataatgattcattcgcttcattttttgactctttacacacaacttgttaattactatattgatgtattcaatcttactacatttgttttcttatttccaacgaataatgaaaatcacatcaagctcattaactctgcaaaggctgttgaatcatttgggttaacaactcgaactgattgtcagcgctataattatatttgcagatatacgagcagatggcctaaaaataatggcaatatcattcttatcaataaaaacatgaaaaagttttggacatatgataaggaaatagaaccgaaacaagtttttcaatgggcaaaagctgttttggatggggaaatcaaagcaaaagggccttataatatgataccaagacaattatgggatttcttatatgaaataagaggagttggtggatttagatattatattttattggttccgattggaatgtcttcgcttattgttttgatgtttttgttttcattattgtctcaaattaaattcaaaagaagaaatcataaccatatcgaatagacaatcattagatgcgattatggcattgttggatttgtggaaataataaaaataatataatttttaaaacttttatgtaaaagaaacatgtttaaaagatactgaatttatgttaatggaaatgatcaataataatattgttatagaaaaaatgagttgatattaaaaattaaaaaaatttagaagattttttgccaaacaccatttatttgaagaaatttaaaaaaagaattaacattttttcaaattctttgataataaacgaatgtaaacgaaaaacattttaatattaatagattatattatatttttactttgagagtattaaaattcctttgacttggagaaatttctcagtaaaaaacacactgaagctttcctcagtcaaaattttcacatagcagtgaaatcaatcttcagccattgaggctgaatgctttcagggaattataacgacgaaaatgatcccaatgatggaagcagaaatcaaaatctttatcctcacagaactacagcatatctgacaaaatacgaaaaagctagagtacttggaacaagagcacttcaaatttcacaaggtgctcctgtagaccctgatgttgaaggtgatttgaaagatcctcttctcattgctgaggttgaacttcgcaaaaaacttactccgttaattattcgtagatatttgccagatggaacttatgaggatgtagccgttcgaaacctattaacatttgaaaaatctacataacaaatacatgtcaataaaatcatttcgaaatttaaattattaggaattaacaaatttgttataaataaaatcgaaaactagttttctatactaatgtaggaaaaaaaagatttgacttagtgatacaagattgatatattaattgttcttattaattaaaaaaatgaatttaaaattaataaaaaaaatctttccgatacggggagtcgaaccccgctcccgtggatgaaaaccacatatcctaaccgatgaacgatatcggaagacgaaattaattttgtactataatagtagatgcatatttaaatacatcatttttgaaaatgtttttaaacaattttcaaaaattacaatcaatttactcgaatactaatagtttttacttattttgctgagcatacatctcgcgtatacttttgttttcattcattaagttatttaatgtatctgttagtgttgtaattgtttttttcagttcgatattctgcagaacaagttcttcaagtagaagttgtttttcctgaaattcaggcatcgcaaggattgtagacgtgggcctcatctttaacgacaaagtctgaatctcaaggtctttatcgcgtagttctctgtttgttgcatcaatctcgttttcaacgtcggcggtttttcttctcaattcttctttttcactttgcacttgtttaacttgcttttcgagatcgctgtcaagcgttggtgtgtctgggcttcggcctgtttccttcatgtaattaagttttttacgtatgctttggatttcctcattcagatttgtaatttcatcattttgagacttttgaagtttctcaatggagagttgatgctcgtgatgtctggactcaatagcggcgagttcatcttggatgggtttcttgattgctttgtatttttcgatgatttgatctctttgactcatgattgaatcaatagttgattgaatgtttgagcgcctttcaagaagttcctttcgagttgcatttgttttttggatttcttcttgtattgaagaaagttgtttttggtaatcttctaatttcttatttgcatgctcaagattttgtttgacactgtcaagatctttatcaagtgtttcttttttactatttagattttcttgctcggaacaaagcttattgattgttttttgctcatttgatgttttttgttggagtacgttaattttctgtgttaaatcttcgatgtacattggtatataacgagtggatctaaggaaagcaagcatgggattgaagcgttctttttggagttgaaggtctagttttatttgattatgtttttggaatcttgcttcaaatttattaattttttctctgagtttttcaagttcttcttccttgccttgaatttgctgtgtggttgcttcgattttaagagttagttcttcaattttgatttcttggttttctttttcttttgcatgcgatgcttcttcttgaagttttgaaatttcatcatggaggattttaattgaatcctcatgtctttgtcttccctcttttctttgattttctaatgattcgatttgttgaagaagctgtttgtattcttcattttctttgcttaattgttttatttcatctttcagttgaaaattcttttgtccttgctctaggatgtttgcttgaaaaacagcaaattcttcttctgtttgcatattccactgaccgtttataagcggttatgttttcaaaatataaaacgataaatcttgcattttttatagtattttacataacatttctcttttagcccagacaacttttttagttcaaaaagttgtttgacattcaaaaagtttcgtgttaggtcggtggcctgaccattggattgatggctgcaaagtatcaaatcgttctccttcgtcacggtgaatcccaatggaaccttgaaaacaagttcacaggatggtatgactgtgatctttctgctaaaggtgttgaagaagcaaagaatgctggtaaggttctcaaggaaaatggcttcgaatttgatattgctttcacatcagtacttaagcgtgccatccgcacactttggttaacactcgatggacttgatcaaatgtacatcccagttattcgttcatggagacttaacgaacgtcactatggtgctctccaaggtctcaacaaagcagaaacagctgaaaagtatggtgctgaacaagttctccaatggcgtcgtgcttatgctatcccaccaccagcccttgaaaagacatctgaatattatccaggaaatgacaagaagtacaaggaacttgatccatctgttcttccacttcacgaatcacttgctacaacaattgatcgtgttatgccattctggcatgaccaaattgttccagctatccgctctggaaagaaggttctcattgctgctcacggtaactcacttcgtgctcttgttaaatatctcgataacatgagtgaagatgacatcgttaatcttaacatcccaacaggtgttccccttgtctatgacttagatgaaaacctcaagccagttggccatcactaccttggtgatcaagctgcaattgaagctgctatcaacgcagttgctaaccaagctaacaagaagaaataaaaacttcaaccagattctattatcttgtttatatatatatatcacttttcatgaatgagatgattgatcaatataaaaaaaaataaataacaattaaaaaaaactcaaagccaaattagacttgcattaggcagaatgtatgcatgccattccatttgagaaatattaatatcacgtaaaatcaacttgattcagtaaatatatttttgaatggcttatttatttgacgttttttttcttgacaactcatatttttcacaaaaagtcattaccggtttatcaaagaatttggaaagaatagatatgaataaagaaaacgaggcaactcagcaaacgcaatctgctgaagttgttgacaacaatccagaaaataccactgacgtaaaaaaggaacaagaagtaacagaaaataatacaaaaaatgaagaagaaaaaaagtctgaaccttcaaagccacaagaatcttcgcactcaaattctaccatgtttattattataggtgcaattgctattttaattatcggaatcgttttatattttattttacgaaaggatcgagcaattccttttgaaaaaccaattcagtatgttttcaactctcaatttcgtaatgaacttgaaacatacgtcaatttagatcaccataaacaaattttagtattatatggagcagacggtgtcggaaaaaccaggggcctcaccacatttggtgaagagcttctttcggatgaccgtcttgtcattgattttgattttaggtcaatcagtcccattgcatctgagatcgactttgttcaatttcttcaacagtctgtcatcagctcattccgaaaccttgacaaacgtcagtctaagcttcctgatctccggaaatctctatcacttgttcgtgcattatcaaccattaatggaccaatttcggaaacagttccaaatgtttgcaaagattcattacttcaatcaagtttcgcatcaatttataccgttattaattccatttctgttaatcccgaaatctcagtacccgcattatttgaatctattaactctatttcaccactttcaccagttatatttattcatgatatcgaacgtcttaattccttcaacaactccatcatccgcaagttcctgccacttttctggaatgtttgtcaaaattttgcgcgcgatcgtaaaacggtttcgttaatcatagaaatttccgattcttcttatttagttgatcatgagtttttattcgaaagtgaatcatatcgaattgtccgtgtaggagatttaccacttgctgcacataagtcgacatttgttgataataaaatcttatcgccatctgaatatcaaagtatctccgaaaaaattggcgggcatggacaaagttatgcactgttatatgaatatatgcgtgaaggatattcaccgaattcagctatcaagaaattattgaaaaaggctaaaaacattataatcgatgtaatacaatttggagaaactaaaaacgaaaggaaaattagattaaacttaatcaagaaatcattgaagcaagtaattagtgtagagactgataagaaggaaattaaagaattacttaaatggaatgtgttggcattggaaaatagaacacattgctcaatctcgaataaaattatggaaaaggctgctgaagaagtaataaagaaaattcgtaagtaaataatttttattttatttttatttatgatttggaactttaattgtgtgcaatttcgattttctccctaatgttgtgtgataataagttttcgaaaaatgaatcatcttaaaaataatggatatttaaaacattcattttcaaaattgtgtccctccaaatttgttttaatttaccgaataagtagaagtcaatggggacaatatctggtgaatagggtggtgaggaagttggctcaattctaagttaaaaataaaacttttgttttcagtgaggtgcgtggttttgaataatcgaaatatatcgaatacttttttctcctattaggatataattttttttcaagtggttttaatatatgattaatgaaatattcagaattaaatttttgactgggaggtagaacatcaataatgaagaagcatcagggattccaagatatcgtgaacatgaattttggttcctaaattaaccttttcggaatattttcaactttttctcgagattgtgcataaataaatttatgaaagtaccttaaataaaaccaaaactcattacatgttataatgtggcgatatccttccttttggaattttaaaagtgcctctaacatttgtttggaatatacccttttctttttcatatcacttgtcagcatgagggggacccaccgtctataatattttttgttccctaaatgttcaattaaatgagttttgatagtaaatagatgatggccaaagaggtgtgctaatcattgaattgaaatatatggatcaatatcaagtcagtataaaattttttcggatatatcttcttataatggtctcctaggggactctataatctgaaggtcttttctcctctacgaatttcaggaattcaaaaatataccgtgttttagagagcgaagaaaacaatgctaaaaaaatttcataaatagtcacaaaattaaccaatcaaattactatgaagggcatgcccactactagtatggcacagaaccatatccttcaagctcacacgattttttccttagaaacaattatgaagaatttaaaatataacaaatcaggcaaaagtttcaaatattttttaaaattcctttatattaataatcattttattctttgtttattttaacaaaccaattaattgttccaaatctgattttcatgggaaagaaataaaaagctttacataatggatttatgttttacttttctaagagtaatttaactatttctgtatgaccatttgaagatgctttcataagtgctgtccaaaataatttaaattattttcaaatattattttgaaatataaattctaaatcaaacaaataaatatctttagcattaatatcaattccttcttgttcaagaagtaatttaactatttctgtatgaccatttctagatgctaaaataagtgctgttagaaataatttaaataatttccaaatattattttgaaatatcaaattattaaaataaatattaaataaaacaaataaatatctttagcattaatatcaattcctttttgttcaagaagtaattgtactatttctgtatgaccttttgaagatgcaatcataagagttgtttcaaatattttagataatttccaaatattattttgaaatagaaaattattaaaataaattttgtctttagcattaatatcaattccttcttgttcaagaagtaatttaactatttctgttctaccatattcagatgcccatataagtgctgtccaaaataatttaaacaatttccaaatattattttgaaatattccaaaattattaaaataaatattaaataaaacaaatgaatatctttagcattaatatcaattcctttttgttcaagaagtaatttaactatttctgttctaccatttctagatgcccacataagtggtgtataaaataatttaaataatttccaaaaattattttgaaatataaaattattaaaataaattttatctttagcattaatatcaattccttcttgttcaagaagtaattgtactatttctgtatgaccatttgaagatgctttcataagtgctgtccaaaataatttaaattattttcaaatattattttgaaatataaattctatataaaacaaataaatatctttagcattaatatcaattccttcttgttcaagaagtaatttaactatttctgtataaccatattcagatgcatatataagtgctgtttgaaattgctataatatatattaagtatataaaataaacatcaaacaataacaaaaaaatttaaataaaacaaataaacataaaatcataaaatttaacttcaaatgaaaaaaataaaaataaaatcattaaaatatatatgaaattatggaattaaatgttatgtaatcaaaatatatttcgaatattctaaataaatatgaaattattaaaataaatatgaaattattaaaataaatatgaaattattaaaataaattctagataaataaaagatactttaaaaatttaaaataaactataaaacattttaataaattttagataaataaaaggtactttaaatatttcaaataaattctcaattatagaagcaaatcttatattattataatgaatacaaaattctcaaaacaatttttaagtaatcaaaaggaaccttgaaatattggatcaaactacaaaattagattataaattccaaatttttgaatacaatatcttttgcattgatatcaatgtcatcttgttttagaagcattttaacaatatcaatttgaccatttgacactgcacaaataagtggtgtttgaaattaatggaatatatattaaatattcgaaatatattaaaagtttgtgaaatagatatcaaataagcgaaatcaatttcaaataatttgaataaatttcaaattatttaaatcaatatcaaattacaaatagaaatataaattattttgaaaaaatatcaaattattaaaacaaatactaagtaaatgaaattaataccaaatatctcaaataaatctcaaaaaattgaaataaatataaaataatttaaataaatacaaaataattgaaacaaatatcaaactactaaaaaaaatgctaaataattgaaacaaatctcaaactactaaaaaaaatgctaaataattgaagtaaatataaaataatttaaataaataccaaataattgaaataaatctcaaatgatttgaacaaatactaagtaaatgaaaaaaaacgctcattaagggaaataaatattaaaacctgagaataaattgtaaatgtagaaaacaaatccaaaaatatttgtataaatttcaaattattcatgcaaacattaaattattcatgcaaacattaaattatttatagaaatttcaaataaaataaaacaacataaaacttaacaaaaaaatttctcgttcatttacatcaattcctaattctttttgaataacttctaccatttctggattccctgattcaattgataatctaagatatgatcttttaatttgatgtttttctttgaagtatcggaacaaaaacatatttccgttttttacaaattcagtaacaattttatcactaatttccattccttctttctcaagtaagaatgcaaaaatttcataattatcaaatgatatacaaaactttccaatttcttctaaattgttgatttcttctaatttgttttcataaagataatgaaagatatcatttcgatgaaattcaattgctgtttcatatgcatctttaaatgatgaatgattctgttcgcataaatgaataagttcaatgtttccacctgcaactgcatatttacctgtgttttttacatttgcaccattcataagtaaatatttaaaacatttaactgaagaaaaaaatgctgcataatcaattaatgaaacattttcttcattaataaatgaacatctttcataaagtgaatttggaattgtttgattaaaatcgaatttattttgtgatgatatttcttgtagtttttctacttcatcatttcggattatttttgcgatttcatttggattaactccttcttcaattaatttcttatgtaattcccaatcattctttgatggttcttcagttttaaaatataaagtattcagatttttggcaatgtctggttcggttattttttgttctatcatctcataaagaagaaaatgtgattcttgtgtttccaatttgagtaaatattgattaaaaatatgaattattttttcatcttcttttattagtgctgataaatattgaatgtatacatttttatcgattatttttgatgcaaatgttgaatataataaccttgaaataagaaaattaaatgaatatggaaaatcatagtcaaacatattcatcactgagtgaacagttggttcaatgttttcttcattgatttctgttataagtttctccaatttttttacaagatccatcgagattatttatgagccgtctacactttttgtatggatttcaatgtatcatagaaaataaacgttggcagggtgcaccttccaagacttctgaactatacattgactgattaaaaagtgatcacaaagtgtgcgcccacctgcgctgcttgattatccgatttgtttagacagttaaaaaacaaagaaaaaatattatattgatttatctaaatatgataaaattgaatttgttatcactttctattagaatgtatttcgcatttttattcgttattttaattccttctttttctgaaaacatgaagatttcataattattaaattctatacattttttctcaaggaaaaaaaagattctgttatcaaaaatcatattgagaaactaaatatagtattaataacgtaataatgggcacattttatttccatatttactaatatcataataagtatgaaataaagttgattaaaatcttaaataattaaaacatcttcatttatttttatatttattatatgttcaaaatcattttttctaaatttaattgcaatattcggattatcaaaagtgttttcgaatttaataatatatattaaatatatttaaacggccattcgacattttgcaatttaaacggctgattttttttctatgatttatccgaataaccgaatttcatcaacttttttacatgagcgaagaaaaccaacagcaagcgcaaaacgaaggtatttccgctgaggaacgcagcctttttatgtgtcgaattcttgaagaagatcctgatgctcttgaattcagagaaagaacatatccctggacacattctcattccttaggcgttcttaaaaatgcgaacttcagcacatgtagatctcatcttaataggcacaaagtcttagaattagtttatcaacatcttcattcaattggaatgcatcatgttgcattcacgttaagcgaagagactaaactagaattccaacgtaaagaccaaaaaatggaaagaactgatcttagactcttagtttcaatgtctcttggtccaagagatgatctatgggataataccggtattgaatcaacaatccttgcaaaagaaccattcgaccacgacagcatttctgttcgttatgttgaaccggtttcagaaatagttaacacttatctcgatcctgaatcaaatgttggttacttagaaggatctgaacatcaattcgaagggataacgtactctcctctacgaaatcttattgttgcaattgttcgtggcgagccaatttctgttagtgaatctgatcgatcagaattcatattaacagtcaatagtttttgtcaaaatgaacatcttttccatcatttacgcgcactctacgagagtgatgaagttgattccaatcgcaaagataacataatgaattttataaatgactgggttcgtttctggggccttttcattggtagtaatacacttaaacaaatcactcactttcttcaaaaggtcaaaacaccaatttccgaaaaattattatctgacattccatcactttcctttggccatccatatcctaatgattctcctccaccagagccatttattgaagatcctaccaaaattctaaatcccaattttattcttacagatgccgatccttgtgaagttgcgcgtcaaatctctctttatacccaccatatttactctgccatccatcttcgagagttctatagcgccatcaccacgcgaacactttcacttgacaccaaaacgataaacgaactttttgaattcgggagacgtttaaagctcatcatcgccagcaccattcttaacgacaagtattccagtaattgcatcaagcaatttgagatcatggtgaatgtagcgaagatgcttttagagatgaacaatttcgaagcgttatcatggtttatctctgcatttgaaatgaattgcattgaaaaccttaaacgctcagtggataaattaccagaaggattaagcgagacacttaaaaaccttgaagagaattatagttggaaacttcggagtaaaacatatgaagaaaaattgaagaaatgtttcgatgaaaagttgccgacaataccaaacatgcgctatgagttatcaatagttacacaatccgcttataaaggagatgacttcgtcaacaatcgaattaattgggcgaaaagaaaagaggcatcgaaatacttgtcgaagtacataaggttccaaaacataaagtacaacttccatagaatagcacaaatacaaaatctgctgacgagaaaatgtaagagctcaaagaaggaaatcgaagaaatgagcttacacttggagtgatcaaaatgctttatttttgagtaaatcacagtgggaatctttgtaaatgatacaaagttgttgagattaattttatgaatgcacttgatcaagtgtaatgtgttggagaatgaaataataataataaagttaaagaattgatttgtttttgcagagaagattgcgatcatgaaacaatttatttgctgaaaacatttgttcaagcgaaataagatgttttaatttgtatttgtttttgcagagaagattgcgatcatgaaacaatttatttgctgaaaacatttgttcaagcgaaataagatgatttaacttgtatttgtttttgcagagaagattgcgatcatgaaacaatttatttgctgaaaacatttgttcaagcgaaataagatgatttaacttgtacttgtttttgcagcaacattcgtgttaggggaaattgttatcatgtgccgaaaattgtttttgagaaatatttgctggggttaaaattattaaaacatttgatgtttttgaccaaaaatatgaatatacaaaaaatagtttatatgcaaaaagaaatattttatttgctaacactatatgatatttagttttgctttcccatctgtagcataatcattgataatttattgttttcatcatgtgcttctcgaattttttgttcaagttcacgctgtgcatttattgcatttgtgtaatcaaataatactttttcagacgtatagtcatatgatatatttacaagatttgaagcatttgggttaaattcagatttgtttgaagatatagtttgcaaatcgcattgcttttgtaagaagagttccgtttgtgccattttttcagcttgcttttgaaatgctgggtttccaattgtcagataatattgttgtaattcaggagtattaataacattagagctgtcactcatttcaattgcatgtgacttttcatatcttgctaataaataatttgcgaattgtggatttcgattgttcttcatattgtcacttttacataaaattcagtttttatcgttctaaacgaggaagttcatttctgagataaaccattcaatcgaaaattagcgccaaaaaatcagattttccgccaaaaaaatgtttcatcctcagctaaagatatgtagtgatgaatcagacattaaagataaatttattccatcaaaatattggatatcggattcagttaaatttgatgaaagaagaattaatttttatattcaaacaattcaaccaaacattaaaagaacaaccatttacggtgagcctagaactcttcatattggaagtgtaaatgaagttgttgatgctttcggaagtaaaattttttatgttacaccagatgtcttaaaaaatgcagttgacttaaagttaagacatttccaggtatcatcaaaatgtcctcaatgtgtttctctttcattaatttcagattcaatttctgcatcaggttattcatcaaaagagttatcttcaatatattgtattgtcactcttcttggtgggaaattctttaacgttaaagaagcatatcaaacaaatatctttatcaccaataatccaattcttccacctcttatatcagcgtttgctgatcaaatcccaatagttaacaagaaatggcttgaaacatgcttcgagaaacttgagaaagttccttttgataacttctatttaccacgtttctcttctctcgaatttgtttctagtgatcttccctcaaatcaaacaaagcttctcaaaagacttgtacaagaaaagtgcgggaaatggtcgaatacgctgaatgattcgacaacggcattagttgcaactcggttatcaatgacacctaagataaagttagctctttcacttgggattccaattattaaaccacaatggatcattgaacaatcaaaatgttggacgccaattgaatcttatgttcttaacttttggtgtgtgaaagaaatgaaatctagtttgttttctggcatctcatttggtttaaatattagttgcgaagaaattgatagtttaattgaagctgttcaagcaaattcaggagaattcacaaatgacccaaagatgtttgttgttccacatttttatgaaataccaaatactgatcaagtgaaatatgtaacaacaacttgggtttggagttgtatatcagaacaaaaattgattccagacactcagtctattgtttaccatccattccagttttcattttcaaatccagatttaaatggtattgttgtagcaatgtataatattgacgaacagaaaagatatgaactatcagaaggattaagactacttggtatatctgttcattttacagtatcaaaatcttcaaattttatcgtggcagaaaaattggatgatgaattagaagcacttggatcaaaatataacattccaattgtctctgtttcttgggtctataaattacttgaaaataattgtttaccacaaacagatatgtttctattaactaataagtatgacaatctgatcgatgctttggcgaagaagattcacgataatgcattttctcttaagtcacaactaactgatgcaggtgactattttgataatttggaatattatagagaaaaaaattcttcgccaattgctgttgcttacgatgtttcagttaaagatcctgttgacttttctttcaactttgatgaggatcctcttctaaacgcaatcgtaaaacttgaaaagtgacaaggcattcaaaaagttgattcatgtcacttttcttcttctcaaggacggaagcatgcataagcatttcatgtgaatattttggtgattttgatatcattttggatttaaattgtatttaaaataaagataaattgttttcttttgttattttttttttttctctctctattgaaatagaattttatgacttaatatcatttaaatttggaaaactttgttgtcttcgcaaaagagatcatacaaatgttacatttctttaagtttacgtggaatcattcaaaaatgtaatacataattattattttagtcaatgtaacaaaaaaccaaccagtcagtcatatacattatcaaaacatgaaaaatgttctagaaactgtaatttagttctaattacagcaaaatcgattttctgcagctcgagcgtttgttcaactcattttcacttcaccttccgaatttaagtagtttacatattattgacagcggcttttcggatcgaaaattgaaagagctttggcctcaacaaatgttaccgtttctccgcgagttggagctcaagttcatctcgtaccttaactatattgttaacttcgtcacaggtattatacgtgaccaaatcgacaagttgactggtaaaggccgtaagccaccagaaccaggatatgttccagtattaggtgatttccaagatttctttgtgcgccgtttctaccaccgtattaccgattgttttgcccgtgttgttacgtctaatgcaggtgcttttatggacattaaaatgccaaaaatcttagatataccagatcaaactctagtttttacaggcgaaactaagcgtgttatgaacctaggctcatataattatcttggttttggtgatcctgatgaatattgtacaccaattgtcaaagaacaacttcgtcgttatggcccatcaacttgcagcactcttgtcgattttggtatgaccacagttcatcgtgatcttgaaaagaccacagcagaatttcttggaaccgaagatgccatttgttatggtatgggttgggccaccaatgccaccaccattgcagttcttgttggaaaaggcgatcttgttatctccgatgcacttaatcataattccatcatcacaggagttcgttcctctggtgccacagttcgtatattccgtcataatgagatggatcatcttgaaaagactcttcgtcgtgccataattcaaggacaaccacgaacacatcgcccatggaatcgtattcttgtcattgttgaaggtatttattcgatggaaggagaaactgtcccacttgacaagcttgttgaactccgtcgtaagtatcattttgcgatttggttagatgaagctcatagcattggttgtatgggcgacacagggcgcggtgtttgtgagcactatcatgttgaccccaaggagatcgatatccttatgggcaccttcaccaagagctttggcgcagctggcggttacattgctggctcaaagaagttaattgactatcttcgtttgcattcgtttgggaacgtttatgccgatgcgatgcccgctccagttgcacagcaagcatgttctgtgttgaaagtcctcatgcataacccagaaggaaaaaggcgtatcaaggcattacatgagaacgcgatttggtttagagaagagctgaagaaaagagattataatgtattaggtgaaacaggctcgccagttgtgccggtgatgatgccaccattcgctatattcacaagtgtgtcacgagaatgcttagaaaggggtttgggcctcgtcgtggtctgcttcccggcgtgcgacatccttcagggaagaataaggatttgcttgaacgcaattcacacaagagaagagctacaaaaggctatagatataatggaggaggtatgcaaggattaccccgtgaagatacactaaagcgcaaatctttccatattattatgttttacgtttagttgtgtgatgaggtaaaatggtaataaaatgaaaaaaaccaataaaattttatgtgatgaaatttcggtaaaaatgttgaagatataaatggaatacaaaatgtataatgaattcggtgtttaatgttgaagatataaatggaatacaaaatgtataatgaatttggtgtttaatattgaagatatgaatggaatacaaaatgtataatgaatttggtgtttaatattgaagatataaatggaatacaaaatgtataatgaatttggtgtataatgttgaagatataaatggaatacaaaatgtataatgaatttggtgtataatgttgaagatataaatggaatacaaaatgtataatgaattttgtttaagaaacaactcgtcaccaattaatatgtaaaaaacagaatctttgattaagcattggtttatcttatttgagctattcagtttcatagcttcttcacactgaatgattttcatcactaatcgaatttaaaacagaaaaatatttaactctaattttattttctatttaaatttatacattattttcttcttcatcagaacttatcaaatgtttctcgttcatttcgacattttctgagttagtgaagcttttttctgatgcgttttggtccattgcttcgctgttgaggtttttctctttgtatgggagcaatgtgtacattacaattgaaatcggaataaatataaagccgacgaggtaaagccactgagccttctgtccaaaccacaatatggaaatcagaagtgagaaaaagttggacgatagaagagatatattcatttcggttgcattcgaaaattgcatcacaagaggaatacatgtgtaatatacagcaaggagaatcgagtagctaaatatcataacaaaagacttagcttgccaatcgtaattttggattttcttatgttcgaatatcccggataaagtcccggataaaggtgtagagatgatggagaaacgacagagataaagagaaacaggagcagagtaaacaagactttcttgaagaacatttgcaattgaatatgaaattgctgaacataatgcaagaagatttccgacccagcgtgagttaccaacaccatcagcgacaaaaacaagagtagcacctgcaaaaccaatgaaaatggaaatgatttgccaaatggaatatctgtgttttaaacagaaataagataatggagtaacccaaaaaataacagtggtaccaaggagcatggctgatgataatgatgtggtattgtaagcagtaatggaaagagtatctccggctaaattaaatattgaaacaaaaaaatatttaaaccatgatatttcgctttttttaaatgaccaaatatgagcgataaaaaggaaaaaataacatattaaaagttgtagaaacggaagagtagatccattgaattgtgataataaggtattaataacgttaattccacataataatatggaacataactgccatagaattagaactgcccatttgttttcaaccaaaaagcgtgctactttgttttggctgacctcaatcataaaattttacgttcgttggaaatgaatacaattaaacgtatcggaaaattttgaatagaaatttaccaaaattgaacgatcagtttcaatacaatcttttgggaaccagtctgtaaataaacggccgcaaagttcctatgttccaaacaaattttacattatttcagtattttctttaagcaaataaacacacatattaaagccactcatttggtaattcaaaaagatttaatataaatcacttttattatattaatataataatacaaacacccgaacaaactataactgctctattgacgaccagttcccttttgttgccttagccattttgatttcaattttctttgaatcagtgtggattgaacattgttttgtattgatttctttaaaaagatttgaatgtatattgatttgaggaattgtatcaattagtacatcaacattttttggtgaatatttgacttttatctgtgattcagaaatatcttttgcataaataacaagtgtaatgtgcgtcaatgattgataaaattcgtgcttgactgtgttaacaatgggggatgatatttttgtttcatagcgaataattcgacgggataattcatcagaagtagctatgcaaacaatacatcgttgaatccatctcttagtttccatagatggctgaattcgatcacatttttcaaatgctagtttggctgtatcaaattcattcatttgatataatgcgcgcccttttaatttaagaatttcagggagatcccatcccttcttttctgcagatatgagaagttctaatgcttgtgtaggatttccagttccaattagacaacgagcttttgcacataataatcttggttcaaggggatagcaaattctttgaagaatttccaaagcttccgtgtattttctttgttcagtataatataaaattgaagattcttgaatagtccattttgctttcggttgacccaattccattttttgtaattaactgatacagttaattttttatgtcaaatttttttggctaaatattatataacacttataaaacgtatctacatatttagatacaaggaacgagttgaacatttttcgttatatgtctctccaacgcttgcattattcataagatgtaaaagattattattcaaaagatgttcaacaaacaaatgatctcaaattttctgcatgtgttcatataaaacaaaaaacatcaaaattttaacaaaaaataacaaattgttataaaaaaatattatggatgtgggatatcaatcccagaatcaataaaagggttgatgattcttgatttaggatgtggtacagacgagatttttttagtaacatcagctctaacagagaaagaagatcatcttattgatattgatatgacaccagaacaaccaaaaattgcgaatgattaacttgattatcattattttcaattcccaaattcatcaaaaatcgaatttaaagaaggttttgttgaagaatattggaattttagatacaacaatttaaatatttaattagaattgtgttattaatttaattaccaataaaataaaagtatttgaagaacttcatttagtattaaaagaatgaggagaagtttatatatcggatatcttttcaagcaaaccacttaatgaagaagcacgacgaaataaaatgttatttggtgaatgtattggaaacgttttatatttaaccgaatttgttagtatcatgaataaaacagattttcagatataaccagttgaaattcgggttcttgaaattgatccttatacaagattttattctattacatttcgtgcatttaaaataatatatttgaacatgatgttggaatttatcaaataggaattgatgataatgaagaagaatttcaatttgatttagtgtacaattttattcgaagtcaaccaaatccaatttcatctaaattaaaagaaattattcaaaaatcactttttttgtaattattttacatttgataaagatgagaatattaaatatcaaagtgaattaattccagatgtattaaatgaatgtttattgaagaaaggaagtgaatgatgtgattcatcatgttgttgaaatagtaacagcaaatgaaataaaaatttatcaataaaaacaaaattgaaatttttctttaccttgtgacatgctaggatacataaacagtcgaaaattgtattttaatttaaaaaaaaaaataaaatgaattttttctcaatggatattaaagcaaaagtatttccgaatttaataatatattgacccattcaaacattcatcagtttaaattttttcatgttttgtaagaagaaaagtttaaaatgcacaaaatactttgtaacaaatattttcaataattttttaatagaataaaaatatatgtcaaattcttggataatttatatataaaaaaattttgattaaaatatatcatagctctatttttatattttatcaatttaaaatatgatagaccatgaaataacttacattaatatgcataattaattattcttaaggtgtcattagattaataaaaaaacattaacaaaagaatcttcgaatatataatcaaatgtatgtataatattaaatgatattaaaaaattttactccacttgtagctaagggttcatttatagtaccaagtattaatattactacttctgacttccccaatagggtagaaatttaaatgaaaatgcacattttaaagaattatagaatttaaagcttaacaaattgtttagattatattttagatcatttttcattcaaaaacattcaaataaagtttgttggaggcgatgcagatccatgttatagaaaaagatttgataatattaaaagtttatggaattgtaaatattcatatgatgtttaccattgtttaaaaagattacataaaaatattattaataatggacctctttatttacaaccctgcgattttcaatgtataaattgtatcaataagacaacactacaaaaaattgatacaatacctgcaaatattctataaatttaaattacttttttctcatatattaattgagccaatatatgttattgatattgatgaacggtttgaagaaattggcgaaaagatggagaaaaaagataaattataaatgccacacaactaaatgttagtggaagatgtggaaaaagcatcattgggtgatacagtgcatcagcaaagcctgataaaaagtaaagctaatatgaaaaaattccagtaacattttgatatttgtaattactagttttcgtataggctgtgaaaagtacatttatcttttcaagtttttggcaaaatatcttttctttttaagatgttatagctatgttgaggtgtctgacgaatgtttttatttgttatactttttcaatttatatatttgaaataaaacataaatattttaatataaagatggaataacagaaaaattttaatgtaaaaagataaaaaattttattattctggttaaatttagagcataaattaattttatcagaaaatgccgagtcttatatgttttctctacattgacaaacaccgtgtgcgattgccccttaccctaaaaagttttcggtttactagtatataaatattggaaagtgtgacattaaatagataatattaacaaatgctcgttagaataaaaaaccattatatagttaatgttaacttttatgaataattaatagaaaatgaatggtttcaatattttataaaatatttttagcattaatatcaattccttcttgttcaagaagtaatttaactatttctgtatgactatttctagatgctaaaataagtgctgttagaaataatttaaataattttcaaatattattttgaaatatggaattattaaaataaattctaaataaaacaaataattatctttagcattaatatcaattccttcttgttcaagaagtaatttaactatttctgtatgaccatttttagatgcccatataagtgctgtccaaaataatttaaataatttccaaatattattttgaaatattaaattattaaaataaattataaataaaacaaataattatctttagcattaatatcaattccttcttgttcaagaagtaatttaactatttctgtataacctttttcagatgctaacataagtgctgtccaaaataatttaaataatttccaaatattattttgaaatatcaaattatcttaataaatattaaataaaacaaataattatctttagcattaatatcaattccttcttgttcaagaagtaatttaactatttctgtataacctttttcagatgctaacataagtgctgtccaaaataatttaaataatttccaaatatatttttgaaatattaaattattaaaataaattataaataaaacaaataattatctttagcattaatatcaattccttcttgttcaagaagtaatttaactatttctgtatgactatttctagatgctaaaataagtgctgttagaaataatttaaataatttccaaatattattttgaaatataaaattattaaaataaattttgtctttagcattaatatcaattccttcttgttcaagaagtaatttaactatttctgtataacctttttcagatgctaaaataagtgctgttagaaataatttaaataatttccaaatattattttgaaatataaaattattaaaataaattttgtctttagcattaatatcaattccttcttgttcaagaagtaatttaactatttctgtataacctttttcagatgctaacataagtgctgtccaaaataatttaaataatttccaaatattattttgaaatattaaattatcttaataaatattaaataaaacaaataattatctttagcattaatatcaattccttcttgttcaagaagtaatttaactatttctgtataacctttttcagatgcccatataagtgctgtccaaaataatttaaataatttccaaatattattttgaaatatcaaattatcttaataaatattaaataaaacaaataattatctttagcattaatatcaattccttcttgttcaagaagtaatttaactatttctgtataaccatttttagatgcccatataagtgctgttagaaataatttaaataatttccaaatattattttgaaatataaaattattaaaataaatgtcaaataaaacaaagaaatatttttagcattaatatcaatttccttttgttttaaaacgtattcaacaagttcaatatttcttgatcctgctgaaaataccaatatatcatgcggaattgaatgctctttaagaaaatattcaactaaaaaaatgtttccaatatttgctgcttcattaataatatcattattgattttcattccttctttaagtaaaaatgaaaatatttcataattaaaatatgaaacacatttttctcctaatttttttaatttattaaaatcttcaattttattttcataaagatatttaaagatatcatttcgatgaaattctattgctgcttcatatgcatcttcaaatgatgaatgattttgttcacataaatgaatgatttcttcattcccacctgcaattgcatatttacctgtgttttctacttttgcattgttcataagcaaatatttaaaacatttaactgatctaaaaaatgctgcataatcaattaatgtaacattataatcattaacaaatgaacatctttcataaagtgatggttttattctttgattaaaatcaaaattttcttgcgatgttatttcttgaagtttttctatttcatcatttagaattattttcgcaatttcatttggattatgcccttttttaattagtttcttatgtaattcccaatcattctttgatagttcttcataatttacagaatcatgtcccctgaaatagattgctaattcttctttagacatataatgcgcaaaataagcacactggttgttttttacaatgttcggttcaagaaaattatgttcaatcatagcttcaagaagataagatgattcatttgtatacttattgataagaaatcgaccaaatatatcaaatatattggatttgattttattaatttcttcaaatgttcttatttcttttataatattaaaaaataattcaacattattatttttaattacaaaggaattatatatcatttgaataatcattaaatcataagataaaggatggatttcatcaaatttgttgattattaaacttaaagatctagagaaattttcttcgttcatcctaaaaattgcttgatttattgatagatgtgtttcccagtcgcaatgttcatttggcctcatgcggaaaatattaatattaacggatatatcaattcaaattcgttcaaataatttgaatgaaaatttgaaagtataaactagtgaaaaagttaaattcgccagccaaagaactcgaaaccgattgaagattcgctaatatgtatagacgataaaaatatttcccttgatcattcaacagcaaaaactagtaaaatactcattaaatttctctagctattatagcggacaaaaatacccaataacagctcaaaataatagattaagatcttgaaatcaaattattaataatgaatctaatgaatatatgaataaaaccataatattcgaaatacatttaaattagaaaaaaatggatttttgataatttgattatttatttagatttatgataataactaataattcatcatttttaaatttctaagcacacctttaagtattattgtacttcagcgtttcttgctccctgtaaaattggatttttatgatcatttttcaacattcacaagttccaaaaaataaaaaacaggagtttcacatggtaccatgtgcattttaactagaaagaattatatgagttcattaattttatgtgaacacaaaaaatgatttttgaaacacatttttttacatcaaaaacaaaatataattacgtatttatttgctctaatcattgtaataagatttatttgaaacaaaaaaattccaatatattaaaacaaattttgatcgaatttttgaaaattcaatcacaacatgttttgtgtaacacaacacaaaatttgcactagataacaataagaactaatattagaaaaaaaaaaattcaatgaatatataatcgaaatttatttggaggatcaaaattagattaattaaacaagaaataattatgaaagaatattttatatattattatttgtttagtgattaattagtttttttaatttttaggttcttgttctttttatttttgtttctttttgtttctttgttttctcgagtatcaattttgccaatgttatctaaagatggaccacatatcttaagaaggccaaacgtgatcacaaagactgcaattgcaacaaagatttgttgatactttgaataccatggcttatatgaatatgtttgaattcttgttaataataattctttaaaagtcctgttactgaatgaatataatgagatgtgtattgtggcaagattgataatatttacagaatatcgaaaagattcattgaagattccaaacgcaccaacaaaatttttgtatgtttcaatgaatgtatattctataataggaatatcttctgggtcagtaaaaatgagacttccttcttgctcaccagttacaataatttcaaatgatccaacatattcatgtgtctcattttgctctgtttcattaattggaaaatcacctctataaattttagtttcaagtttttctgatgttgactctgataaattgaaaaaataatatgatggtttttggttaattccttcaatatcagaaccgaatacctctacattccattcccccattattattcgtttaatttcaaaagaaatggtgaatgagaaaagggtagcgaatagaaccattattgaagcaccctaatacagaccgttaaaaataatagcgcacccctctgtaactaatcatttttttttgatgagcactgttgatcaaacaatgccaagaaaatatcaaaactcctcatgaacaatttaagattacaggttgtgttgaaggtgatccggctgaaagtagaattagcaaattaaagtttatattgaaagcaccagaggaagattgcagaaaagctctggaaactgctgaaaacaatattaattatgcaacagttcttcttttagaaagagatatgaatgattcaaatgaaccaaaataaaagattaaaatcagtgaaaaaatacaaagggagttttgtgggaaactgaacctctttgagatttctcaagttttactcatgtgcgaaaataatgaagatgaagctatcaaaatacttcgtactatggtatgattatatttaaatatataaacattctttcattttttggtatagatatctttttgctgagtgcacaatttctttgaagtattttcaaaaaaaagtactccaactgggagttgaaccactaaatccaccaaatttttattaaaatgaactctgaaacaataattccggcttattcaagcttatatgaatgggaatttgaacaagatgatgaaagggcttacataaagttcaaatgtccaaataattttgatccaaatcttcttcaatttgaattttcagaagataatacagcagttgctgtaacaatagaaggtgtactaatacctgttttaaaaggtataatatataagccaattactgaatatgaaatttcgagatcttcccaaaaagttattctttatttaattaaagttgaaaacgaggaatggctgtttcctgtttgtggtccttatcctgattccaatgatatcgatccaaaaagtgcctttctcctatcacaatcaaatattgaaccaaaagaatcacaccaatttctaaacatatctgcttcctatcatttcctacctgcgctacgttatcttattagtcaactagaagaaaatcccaatcaaaatgatctcatcaaaaacactataatttctctttatcgaattgctattgatgattacgatgatcccctttcctcatttaattatgctaaatacctaattaaccaaggttttgaaaacaaattcatatttgacattcttcaatttgcatctgaatcatcaataccaaatgtcgttactcttcaagcgcaactcctttccaagttctccgggattccatttgaatgcaaaagagatcaacttgctgttcaatttctccaaaaagcgattgaagaaaatgaaaatgattctgttgcattacatttgattgcaatgcattactgttttggatgtggcgtgaaaaaggatatcaaattagctgaaaaatatcaagaaatggcattgaaaataaaccccgatgttgaaccacttaaagaccaaaaacaaggcgtaaacaagttaattattgtatcagcaattgctataactgccgttgttggtttcactatttttaagcatttcaaaaaaaaatcataaataaatgttatttatgcagattcgtgatgacggattttccgttttttcgttttacataagataaactgtcgaaaacctttttatatctgattacatattgatctagtcttccagataaaaatgaatatgttcattgtattttgaacccagctaaagaaaggtatttttataatattcagtattaaaaccccttaagaacaaacataattttgattgaagttagtcatatttaaacgaccgttaaataaaattaatttagcaaattatgcgtttaatttaatgatttatttaccaatgaaagatttctttgtcctctcttaaatattgcaaacacttctgatgtgcataacctttcccagggatatagacaactccgatgaaagattcttctccatttagccctttcccattttcaaatgtacctccgcatgagacgcatgttgctgattgattctgtggtgttatcggaacatattgtattggctcttctttgttttgtattggttcatcttcatcaatgcttgtaacaagcataaattgcggacttggagtttcccaatcaacacttgtacgcatccaacttcggcaaagacgttgttcttcgtctgatagtgaaggttgaatgattattggtggttgcatgaattgtggtggtggtggttgcattggaattggtggttcaatctgaggttcataaactacaggagtttccataagcggagctggcgcaactgattcaagtttaccttgaaatagttcgcgaatgcttgatattattttttcattgaacatatttttttcatcccaaacatcaactaaactgctcaatttcccaattaaaaaagcgtctttagatcggagtgaggattggaaaagcttcaaaagcttttcctcaaaaagcattctataaccttgatgacagtcttttgaaattgcatcaataagatagtaaagtgggagaggaggctgaataatttcacgtgtttcagttcctttgagtactttaatataatgtggattcaaaattctgtttactatttcatttacaaatgcttgtttaaagcgttcaaaatcatcagcaaaccaacagagcgtatcaacgttaacgaggtttgcctcataatatgtatctaatctgtctgtaaatagctttgcagcttcttctttgttcattgaaaaagaagaccgttaaatcaaatatatccactttttgatacatcatatattcaattaaaatagttttgttgttatatttttatacaaaatgaattgtcattcaatgatcatttttagaatggtttttgttttaagtcttaacaagcctaagtttttttttgtttttaaatcctgaattgattaaatagaaaaatataatccgcaacataaattgttcaattttttgttaataacaacaattaaagaatgggcgacaagtacgtttatctttttgcatttttgacaaaatgaaaatatctttccttttaaagatattatttatgatattattgctgtcgtggctaattaaattggtccaattggcctaaaaaaaataaccaattttttagtgcaaaaatacaaacgttctcatgtaaaaaaagtcacaaccacttttcaggcacccaaaaaattaacgttcccatgttgaaaaaaaacgtttttttaacatatcgagaacgtttacttaatcacgaatggagaaaacccagtacaaagtatactttgctggcgcattgtttagtcataaagatctaacaggaaatgcactgcttgcaagctacattgaaaggttgtcattagaaaagtataaaatctttctaccgcaaaatcgcgagccaaacacaaatcgtagaccagaaatacgtgatcaagaccttcttttactttttaattgtgatgtaggactttttaattttgattcacctgaacttgattcaggcactgttatggaatttgcatatgctaaaatggctgatattccatcagtacagctacgaacagatttcaggaattctggtgatcaaacaggtggtgaaccatggaatttaatgtgttcaaattatccaagaactaacacacttttgataaatggtatgcttgaataccaccaggcatttgtttctacttctattgagtcaacaattgaagcctattataccaatctcgcaaaaaaggttattgaaaagcttaacgatgtaatttcttttaattcccttttccaaaaagacaagcaaaaagctataagtttgtattcttgggcccgtacaacaattggagaaggaatgaaaaaacttttttccgacgatgacatacataatttggttgaatctaagttcaaaaaaggactaatataggaaaatgtaaacatttgtaatattaaattttactcataaatgttcactcagattcttctttcttgtactttaagctcttaattcacacagatgttattttattagggattcaaacttggtcaatcaaaatcaacaattttttttactgtttgaaggaaagcgacttaatcgtataaagtattgaaaaaactctcaaaatttgcgttgaatttaacggtctcttgcttcaatctcaagatggaaaaaaccaaaatcaacacaagaaaattatcaactctcttacaagcaactaaaaaaagacttgactctgaagagttcatgagagattttgaatctaagtttcgtgaagaccaatttaaaaaacttcaagaagagaatatttccaaaattttaacacaaaagaaatactttaccctactttattttcttaattgcgctattatcaagagctcggaattaccagaaaatgcgattgaatctttattcaatgcagaaaatagccccaatgccacagttgaagatgtattcaaagatagagctcatgatttagttactgttgataatatttgcaatattcttggagcagttcaattaaagtgtatagatatttttactttctccattttgccatcatatgtgaactatttctggaccaactttggcaacagagggttttgtaattattttcttagtatagaaaatcaaaaaatcagatttctctattatcgagcagcattcttttcgcccctatttgttttatacatatacagcacgttttgtccatttctttctccagttttatcttccggtaaattcgaaggtgatattactgaatttcgagcatcaattttaaatctttgtaaaagtagagccgatatttttcctttatacattaaagacgttcttttaggcgaagcgatgcacagtggtgacatgagtgggtgtcttcgtgagtcattaattgattatgcgcttcttccatctggttgtcgggcttcatttcttcaagtccttggttttgttgaaccttatcaaattcccaatcctactttttatcgattccttaataccttatttaataacgactttattggtgagctttgccaatgtttttgtgacattgaagattcgtatatcgacttcatcagtggggccgatagagacgaagttccgtcacttttccagccgaccgtattgtcaaattatgacaaaatggcacttttgaattataggagcccgtttaattacaaaggcgaaataagtttccaaaccgtttattgggagaaaaaacttccgcctctaagagattcattacgaaggtcatcttctactcaaaaccttgtccaagaaatcaaaggcttcttatcacaaattgattttgttccactttccacaaacaatgttgatcttctgagatatctcaaattattagccgacaaaggaccaattgaaagcaagaaagcaagggttgcatctgcccaacgtatttacaattccatccattcacgctcagagttatgggttgaagatgtattcgacaaaatggcagaagatgataaaaccgaactcatcaaacttagtgcgttttcacccatgaaggctcagcttgataaattagacattcaagttgattctgttgttgaacgactttattttaccacatacataacactttataccaaaactatcaacaaatattatgacaacagacaacaaattacacttgagcaagctatcgaatcccctaaagcacttaaatccgaatatgaatcactcaccaaatatgtatatgagaataacaaatttgtaccacgtcaatccgaagttaacaaaactgacgtcaacaaaaaacttattccagacaaacccgtcagaattgacgggataaaatattatgaaattgcatgtcacatctatattacacgcgactttacatacgatcgatttaaatctttacttccagaattcacgagacttgatgagaaaatctttgaaaccatttcctctaaaacgagtgattattatattgaacaacaattaggctcaatgaaagccaaacatcgcgatttccttaagagttatttgaatgatgacaacgcgtatttttatattgacgatgcattccaaagatgtgacgcgtatggatttggcgatcgattagtatatgcaataaataatatgtttattgactgtaagaacgcatttccaaatgaagtgttcggcggcgaccaaaaagagccaattgttggcgctttctttctttgctattgcccgagagaattgttgacaactttcgcattctataaatacttttattatgacttcttttataaatcgaaagattcaactgttacacaagtgtacgggcaacagaaaatgcttctgcaaaacattttgagtgaggaggaatggaatagtttacctgaatcgctgaaggattagtagtatttttaattaaaaccattttttgcgtaataaataaataaataaatttaagaaatcgttttaatgagtttagtataaaaatttgaatgaaactttaaatatatttctttatttgatatgtacaaaagacatttattaaattgacttttttgctaaaaaaaaatatatttaatcatctaaaagttttgtagctttaagagtatttttaatttcgaaaaaaatttttatatagttttacgataataatttacatcttctttttcttttattatatgaaaaaccaaatccaaaaaacccgaatatttgattgcataaatcaaaaatacttttcatttttatgatttcatatattaattagaaactggactattatgatgatgaatattaatcacatgttgcaatggaattaagaattttcagatcttttatatcaatatcatgaaagataacttgtctaactaaataaataaatagactgaatgtccttgagatgatattatacacatatatacataaatatctatttagtatggatgcttgttagctatttgatattgtttaggatataatctttataataaaaaatgattaaataaagttaaatagtaattgaaactttgtaacattttgccataaacaacaaactcttaaaaataaaaagaatttattatttccttagggcatattacattgcattcagagaaattgttcaattgaacacatacatgtcctcaaaaacatgaatttcttaaaaaggaggcaacaaaatagaagcgattgcaacactgagaaatgtgatatgaatgttatcaaaaagttggtggtatgggctttttgaattgaaagattcaagttcttcaggtataaaattttggaaatcattttataaatgtcaacagggacaaaaagaaagcgtgaaaaatttcttcctgaggaagaccaaaaactgagggaactggtagcacttcatggagattcatcatgggatatagtttctaagaatatgaaaaatcgaaatcaaaggcaatgtagagaaagatggaaacattatctatcaggttcaagaccaaaagcaccatggacaaatgaggaagatgaattgttatatcagaagatgaccgaattaggtccaaaatggacaaaaatagcaaaattttttgatggaagaactgatatccaagttaaaacaagatggatgcaacgatttgcaatgttcagtgacttacatataaagaaaaaaaggcataatcctcaacaaaactatcaatcgaaaaatattcaaaatcaatcacaaattcagacaattaattttaactcaaattcaagtacaaatatttcacaaaattcggttcagaatcatatggttcctaatcaagaaatggatctttttaatcaaaatcaacaattatttgaatatcaatcttttgataattccttttctagttttgatccactatgttttttctaattataaagagaaaataggattcaataaagataaaataaaggttaaactattttagaaagagattttcttcataaaaaaagttagattacggttaaaaacaaaaactcattcaaaaaaatctgctgttgtcctcaaaattgtttggacatttttttatgaccattcaataaaatttgactattgattaaataatcgttattttggatttatacaaaaataacttcattcattaatatatactgtaagcactttaacattaccttacccgatgaaagtatgaatttaatgaagtggttcataataatttcagtatcaattttcagaaatttcataaatgagaatgttatataccagaagatacatagaaacatcttgtgcccatacaaaatgaatctgaattaattttattcttgccaatttatcaaaattagtttgatcatttcaaatgatcaataacaaaaacatgatttcaagtcacatcatcatttataattcaggtgttatgaaaaaatatttttttttatgcacaaatctaaaataatgagaatttttttgcattttttcttttgtgatctacagcgaccgttaatcaaaataaccccgatggcaaaaaccccactcgggcaagcaatagattttcttcaagaaataagtgatacacttccatcagatgagtcagggagttattcagatagtgagagtgaaaaaatcgaaaaagatgattcatcggatgatatacttgatcaaatcaataaaatgcaacaagaaaaaaagcacgtcgaagaagcaccaaaaacagaagagctacctgaaatcttgcccgttattatagccccaacaataccaattgatatcgtttcagatttacaatcacaagatgaaaacacacaaaacaacgatacacaggaagaagtaaatgataattccgaacctctagaagaaaatgctaatcaagattcacttctatcaggcacccaacatcttctttctggcatattaatgataccaacagatattaacacggttgataatgatgatccattctctttttatgatggtttatcatccaaagagccaagttcaattccaatttttaaaatttcgcaaaatacaaacgcaaaaagtacatttaatttcgatgaaaactcgtctaacgcaagttttccaataaataacatcgaagaagaagaagaaacagaaacaaaaactgaatttgttccaaaagaatttccaaacacactcagtgaattttcctcatttatttgttgtggcaaaacttcgatttttctttttgactatggaaattttctactaacattttttgcgcatgatcgacataagaaatatcaaacatttgactttgatgtttctcctccttcgcgaaaagattattcaatattttgtttatcagatactaaaattggaatccttggaggtagtggggcaacaaacggcattgatttatgggttttttcacatagtccaataccaaaatgggaaaatgctcaattattaggaacaaattttccagttcttaaaggacatgcaacagattgtttaactcgaaacaatatttcatatttgtatacatttggaggattaaaatttaacagttatatgaagggattacttattgtattctattcaaaaggattttgttcataccgggagtttattccaaaaggaccgaatccacttccaaggacaaaacacacctttactatgtttggtggtaaaatgtacttatttggtggaatttcagaatcttcatcattacttgatgatttttggattcttgatacatcaatcaatggacctcttaatcctgtttggcagctatattcaggagaaactccatctgcgcgtcattcccatttctcttatgttcttaatgaaaacctttacatcgccggcggttatgacatcaacggcaacaaattgaatgacatttggcggtttgatggagaaagctggtttttatcaggagcttatgataccactaaagaagtatttccatccaaagttgggctaatttcatttagtcccacatatgaagttcaacctgaaatacatcgaagtaatgctcttgcatctaaattcattcaatacaagaaagaaaatcataagtcacttaaaaaggttcgcttttactcatcacggattcgctatgagcaagaagagatccaaaagatccgatcaattcttgatcgattaaagaaaggcaaattacccaattctatgtccaaagagatcatttctgtatttgatggcggtattgaccttggtaacgcacaaaagatcctctttgaagaggccaattatacattaaaacaaatcaaatcgaaactctcatcacggaataataccaacgtagaatacacatttgacgacattaacgcccaaatcaaccaaaaaagaagcattatcaatataaccaatcaatgggaaagtcgatgtcaaaatgacgatttgcaattatccaaaaagtttgccaaagaattactgaaacatcaaatccagcgcccaccgaagccactctccacactatttatcgaagatcttgaaactgtattaaatgactttgagaaagacgaaagacacaaaaatttattttcacatttttattacataaatcaacaattacaatatgaacgtaatgaaaaagaaataaaacatttgaaagagaaaatcgaacatcatcaaaacaaactgtttaactttaacaaaaagatatgtaacgacgtgaaacttataaaccaaatccaaaaagatatcgaaataatgaagaagaagaacaaagagtggaaagatatgtacaatgagatcgaacttgattacgaaatatttaaagcgtttaatgaatataatgcggatccaaaagaactggaaaataattacgaaaaaattagaaatgaaaatgatgtaataagaaataatataaaagagttaataaaagatataaaaagtaaaagtgataaattggatgaactaaaagatattatacaatgcttaagatcgtcctttaggaagaaggcagacgacgaaaaaaaggttttggtgtcaaagatgcagagaattgcggaggaaattttcgaaagctcaaatcggaaataagatgtttatatgtgtgaaataaagtacgttttgtatgtgacttttgaaaacaaattattgtgtgtcatcaaaagcagatgtggcgatttatgaggcggtgattctgtaaaaagttttcattgcacaatttacaaatataatcataatgcgtataaaatgaattatgttatagagggcggtgattccttgaagtgtttctgtaaaaagttttcatagcacaatttacaaatataatcaaaatgcgtataaaatgaattatgttattgagggtgatgattccttgaagtgtttctgtaaaatgttttcattgcacagtttacaaatataatcaaaatgcgtataaaatgaattatgttattgagggtgatgattccttgaagtgtttctgtaaaatgttttcattgcacagtttacaaatataataaaaaagacgttaattaattcctatcattgatttttatattaaaagaaatactcaaattcaaaaacaacgattcgttggccttatgctaataatttttgcatttttgggaaagcataccgatttaatcacactctctttaaaccattttcattgcttaaagaaaaattattgaagtttagagcagaattatccaagacatttggtaactttttgacgcagctcatagaaaaaatacaattggaaggagagagaagaagaaatttttattcgaattgaagaaaaaattaaaaacttcgaaacactttttgctaatgctaacagcgatgacccagagataaaaaatcaagtagacaaagaaataactcaaatgattaataagaaaccgattgattgtcttaaagcattatctttcatggtaaaaaatgatagcttttcaatcaacacaaaatgttgttcggtagttactatctctaggattttaaatgaagatcataaatttgaaatcgaaactaatcttgttaatgacatcaaagaaattattacgcaggaaactcaaagcactaatttaaatcttcaaaaaaattcatgcaaggcatatgcacaaatatttgctgttagaaaagagacttgtttaaaatcaattcaaaccatctccgataatatccttaacgccaacaaaccaaatgttactctttcatatttaataatttttataaaaattcttaaagcaaattttccaaaaattccttatggaaagaaacccgatgttcctttggaattacttccattgtgtcgcaagatttttagctcaattcttcttcttcttttttctccgctaaatgatattacaatcacacatgaagttattttattccattaaagccatcgggaattgcttttttaggtgatgaacttttttccaataatagtgaacaaaaaattggattaattcttcgaatacttttaccgtcatttgaattgcccgactcaaatataaaatcattatgtgtttatacaatatacttcatgtttgccgagttaaaagagaaaatgttgtttttgaagacattttttattttttgttcgacctaatttcgggcaccccaaataagagtgaacttcacttcaacgttgaaatcttatcgttaatttcagttatgttcgaaattttttcaagcaatcaaaatgcattcaaggtattacacagtcttcgtaagaaattaaaaaatcttctcaatatttataaaataaaaacatatcttcagcaagatattgattatgcaaatcaattttatatttctttattaatgtgttataaagcttatgcaaagaatttctatgcaactttatttggaagttccaaaagagaatataaaaaggaaaggaaacaaataatacaatttatagaattaacaaaacatatattactcctaaaaaatgaaaatatcactgataatttattcgcaacttatattaatactttattacaatatgctaagtggtgttcaacgtataataatgtggtaataaactccattccatttcaccatattttatcatttgggaaaacaagggaatttcgtttgaaatgtaaggctgatgaagctttatgttgtatgcaatctaaataacttttgttttttaaataataatattataatttttaaattatttgttttgatgtatttaatatctgacaattatattcgtgtactaaaatagctaaattatttcttgagtaagaagaaattgatgtcaatgctgaaaatattttattttgtttaaaatttaaatttattgaatttttatttcaagtttttttttgctaaccattcaaattattattcttactataacacagtgttacttaactatgcatcttggtaaaataacaaagaaatactaaaaaagctttgtaagaaaaatcaacaaccttcataatatatatatattaaataaagtattgtaaggtttttcattaaaagtatgttttgattatgattttgtaaaaacaccaattatagtgtgatgctaaaaagtgtttcatatttattttgtgtttaaacttttttctttattacaaaatacccaaacagtatagaaaaaattgaaattaatgcaaagaaaatataaataaattcattcattaatttttctaagattggccataacatacatactaaagaagttaacgtccaagataaggaaatagaaatgcatatagccatatccctaatataatcatcaaagatttccccagcataagcaaatggaattggacctgtacctattccatatgtaaattgttccaaaaatattccaaaaataaataatattcctgataatgaaaatttttgttggataaatattaagacaaatgaaattgattgtcctaatgttgatgtcatccaacatattttatatccaagtttatcaataaaaaatgatgaaagtattgttgatattacttgcacgatattagctaataaagcaatgatttttgcatttgttttaattctggattcaataattaatgtttctaatttggacataattggattgattccagaaaactgaagaaaaaacattaagaaaaaaactattatcatttcctttttacattcaattatgtctttgaattttgatattttatgcattggtttgatttttacaggaataaaaaatgcaccaaaaaataaaattattgaaggaatagaacataaaacagaactttctttataattaaagaaaaatcctaaaaaagttgtaagtacaaaaccaatgcaacatcctatctgattcatatatccaaaaaatccttttttatctttaggtgcaacttcagataaaaaagaaggaataattgctgaaaagaaacctaatgaaattccattaattgctctcataatatatagtaaatattttgaaggtgaaaatgcaattcctataaatgatgaaaatgcaataaatgaagcaattattattgcattgttttttcctaaaatattgataataatattaacaaacaatgagctaaatatagctgatataaaacaaacaactatgaataatgtaacttcgtctgatgaaaaatcgtatttattttttatttcttcaatatttggagatgtgaatgataacgataatcccaatgaaacacaacccattgttagaattaatccattaataataggtatttgtatctttggaaaactcaaaagaaaatgaatacaaaacatcgctaaataaaatatatttgaatcttcttacatatcataaacaacatccaaaaaaaattttcatcgtttattataaaaaacatgaattttgaatgaaaatcataaaataagatgaattaaatcaaatcaataaaaatagtttgtatcagtattttttattaagatacaaaagcaagttcgctttaaaggattttttggagttttgtgcaggatcgaaaaagtgatgtgaaacataatcaaaaagtgacagaaagaaaacaaaatggaaaatgtgcagttttcaatcccacttcttgttgtatctgctggcgaggtaagcgatgattgtgctaacacaatgaaaaaattatgtcaaagtcattttgaacttgaatgtaaaagcattaaaaacatttcagatttgtacacagcaaatagtttaaagcctccacaagtacttcgagtacatccaatattatgtagttccatcaatgaatatactatgcttcaaaaaattttcaaaaatgaaaaatgtcatatgtttctacaatcatttacaactcttgtttttattgactacaaaatccgaaaaaatattactgaaatacagaaccaatttttaaaactttggcaaaacatttctacgataaattttgttatttatcattcttctgatactcttgtcaatgatcattctgatattcaatgtctctgttttgaaacatttaccacatcaatagccgttccatatatccaagaatttctttctcgaataatctcaacttcttttgtcaacaacatcaaatccaaaacatcagactctaaagatcccaacctaattataaaatgcaaagcagagcttactggtatatcatgtaatcctaaagaatctatgagatttatcaagaaaggaattgagcaaaccgccgattcgcccgtttatttgggcactttttatgaacttgcttcactcattgaaagaaataacaaaggtttatgcaaaaagtgtaagatccctttaaatgtctctttgccatccgcctttaagattattcctccttctttatcggactttagttcattgcggaaggttaataaatgtttaatcattgccatgaattattatcataaggcagaaatccatgaaaaagttgtaaattgtggaatgcaactcatcataaatggatttaaagatgtaattcaaccaacaacgcaatacataatcgacaattcgaaagatgaatatatttatttatatgcattttcattaataaaatgtataactaagatcgaaatgacaaaaaaagcggcattaatagcgtcacaattttccaaattctttccaccggatataaatgtacaactaatcacattctcattagttacgatattatcagaagcgacttcttcatgtatagttcagttaagagatctttgtattccaatgttaactaatctgttaagtcagaaacaaaaggtacccatgacaatattatctagcgctatctcgaagattttaagttacattgggccttcattaacgcgtaaaaaccaaaaaattcttttcgatgaactcaccacatcaaagtgcatcaaaattaacctcccgattacggtttgtcaaatgacgttccaaactttaccgtacaccattataaaggataccggtggtaagtcagaaaatgtattcttatattcgtatttaccaggtaaaaagaaaagagaaagcgatataactattccagtagggcaatctaattcaataagtttccaagtttttaatcctttctctgttgcacttaacgctgattcaattcaattatgttcaaatgataaaaatgttatatgccatccatgtaaaagattgttccttcctaattcgaaaacattaatttattgtcatttccaaccaacaaaagtttctgatttcaaatttgatgcaatttcattgaatttgttcggcgcaaatcaaataattgaaataccaagtgaaatggtgttcagatcggtcgacagggtgccccacttcattcttcaaacagacctccccatttcttccaacttatcgttgtacgatggcgaagtttacgagttcactttttggataacaaactccgggagtaccccaataaccgatttagccgtcgaatttcagcagcctgaaactgctgtcgttacaactcctccaactttacctttattgccaaatgaaaaaactgaaataaaatgtaagttcacatcagataaaggagacgaatatatgggagttcgtattacttcttcgagtgaaggaagtgaatacaaatgttctcaaaatattaggcaatatttagataacgtagatggacttgcaatcgaacgcattttccttgctaacccaccagtcgctgatctttctgatccatcaatgagtattcgcgttggatttgaaattcgaaatctttctcattgttcattccaatacaagactaacatcacagaagaagtcactgaaggtcttattggccctcatgaacctcttctaatgattgccacatattcattatcagatcttcaaactaatgatatagatgccaacaagagccgcatcatagccatgacccgacaaaaagaacaaaaattaggcagaagtctttcctccaaagaacgtattaaagttgccaaaagtgtatcgatcatgcaacgactcgaatcgaaatggttcttcgagtgggcagtctcatcgcgacgagtagggatgcttgttacccgttctacgcatgtagatgaagaacttttccttcgcatcgaaagtcatcaaacacgaacgaatgttacatggcttgaaaacggggaaacagtcaacagccttcactgcaatcacatatatgagcttaagattgagtttgagaatgagtctgtgaacaaatgtgcacttgagtttgttgaagatatctctgttttatgggaaggagaacttcagcagacgtgtgaaagtggtaaatcgatatatatctttgtgctttgctttggatcgattggccgttttaaggcattagtgacaaatgctgtgggcaacgtcgagagaagatcaatgttctctgtggacgttggcgagtgaattatttcatagtaaatataaattgtatctgttcaaacacattttaacgacagtattataacatttacataaatcaattttcgattcccatgtcccggagcttacgctgtgctcgcttattcccttgtgcggctgacattttgaagtatttgatcgcatcgcttttgttgttgtcgacgattatcaataattgcgcatataaacattgccctgtagcattacctgcttcggcagataactttgcgtagtacttagcctcgtttaaatccttctgtaaaccagtattattacttgacattaatatggcataattacattgtgcatccgcataacctttgtccgctgccaacttatagtattttgcagcttcaaccaaattcttggggactccttcccctgactgtaacataattgcatagttatattgacctaaggtgtaacccaacgatgcagctttttgataacattcggcggctaacgtggggttttggggcatcccgcggcccgtttgcgccatcacgccaagtgaacacaacgcctctggggagccctgatcagccgccattttgtagtacgtagccgctaaccgcgggttaacgttcattccaataccgttctctgcgtaataagcaaaaaacaattgtgagttaagatggcctttgtctgcagctagcttcaaatattggagcgcaagttgctcatctttgggaatcccatttccattatgtaataaaaccgataaatgatataatgcttcaatcgatccattatcagcagctaacttataaaaataagcagccttttgaagatcgagtttaacgcccattcctttttcgagtaaaagtccgcatctatattgtgcatcagcattatttgctttgttaagatatattgcagcatatctaagtgtgttttgtgaagcatttggcttgtccattaaatagacaccaaccttataagcagcttctgcatcgcctgcatccgcttgatttttaaggtcttcaatagttaatgttttttcattgttttcttgactgttctgacgccgtaaactatttaatctgtctatcgccttttggtacccccctttcgcagcggttgaataatattgttgagctttttgaatgtctttttgcggttgcccgattccgttttctatcattaaaccacattcataagcagcttcaacacttccatgcttcatggctgtttcatagtattgcaacgctttttcagggcaaaccttctctgctattttgccagctaataacgcagcgttttggtttccaagatttgctgccttttcataatatgtaagcgcttcttgcaaatttccattcttcgaataaattctgccaagagccagagctgcctcaatgtggttctgttcggaagccaatttatagaaataaattgccttatcaatattctgcttaacaccttttccaaactcaagaatgtcgccacacttatattgcgcttccttattcccagcatccgcagctttcttatagtaataagcggcctgcgtctcattcgcagttactccttttccatcttcatagaatttggcagagagcattaaagcgtccaaatgaccgctacgagccgcagtcactatataccgcgcggcttttcgatcgtctccagctttgataagtttgacaccatatttgtacattgcattgatatctcctctttttgccatttgtttcaacgatggcttgtggtgttgcttttggggctgctgctgagtctgactttgttgttgctgttgttgatatgaattattatttgaataatttgtttgttgaaaattgttgttgaatgactgttgttgtgattctacttgggatagaagctctgctgagggctgtggttgcatagtttgaagaatccgagattgatattgtttgtatcgtggaatgttagttccaatgatgattgtgtgggtgttggcgagtttgaagacaatgtcatcgaatgtcgggcgatctgcagggttctggctccaacattcgcaaatcagattcgaaaaaaattgcggaacatttcctgagatttcaggtcgttcgttgttaaggattgcgtttcctatttgaagtggattaagtttgccgtcaaatggaaggcgatctgtgagcatttggtaaagtatcattccatatgcaaaaacgtcgactttgtttgtgtattgagtttcaagaaagagttcgggggccatccatagtggtgtgccaccaactattgattgtaaagcttctgagttctgtatttttgataatccaaaatctgcaattcgtggctcatagttttcgtctaaaagaatattggccggcttaaggtcacggtgaattccattgcatcgatgaatacacatcatccctgcagcaacaccaaacattacaatcgacttttgtgtggaaccccaacctcttggagcacgaccatttcgttctgccataaggatatccaaaagtgttccgtttttcatgtattctgtagcgattgttggtgtatccatgctatcaacggctggtactgaatatccttttaatccaattattgcagggtgttgaatgtaagccattgcttctacttcacgtacaaattgttttttattgatttcatcaagaaagtttgacttgagtattttcaatgcaacaatttcatttgtacttttcttttttgcaatatatacccgggcagaagtcccagatcctatacattggcctatttcatattcagatatgggtgtaaaaaattgatttatattcacatttcgattcatttcgatattgtcactttttactcaaaaacttgaattgaaataacttcttttgttcaaatggagctcaaaaaaacttttcgccacaatgtaaaacaagttcttatccatacaaaagaagtagttcttcaccttataaaaaccaaaaatttcaaaagtgttgatattttttaccaaatgttttttaattgtacctttatttaacaaaataatcatcagcctgaagaagtcagacttgcgtaacccacaaaaaaccgttttttgaaaaaatggtattgaattttcaacggccgttaagcttaacggatatctcttcaagtgtacgtttgtaatttcctatgtccatcgttttctcggtcgatatttccctaaataaaattgaattttccaatataaatgcaccttcagtttgtatatcagcaacaatctcaaaaggtatgcctgaaattctttggacttcccaaggtaaaattgatgaaaattcatcattgaatataaacaaaactaagcgaataatgtttacaacaaatatatttgatgtcgctaggactttccccgttgctataaatcttatgatgactaaagataaagttccaatttcaacttgtacatatgaattcaaatcattaataggaaattcattaaaaatgtgtggttctggttctattgtacatcttaattccatgtttaaaaattatcaaaaagaaataattgcaaaactttctttcgatacaaaagttatttattacccaggaacagaacatttacaaaatgttgaaataatagtatctcgtccacttagtaaaattttggaaaaggaaaatatttttgagccaacaattcaatctgttaaaaatgcaaagcaaaataaatatgctaacaatcaaacgaatacagaaactaaaattgatattaaaaaaagtcagaaacaatcacaaaaaaatactggaaaacaattcaattcttttggttattcaaacagttcatcatttacagattcatatgataataaagaaatatcaaattcatatactaagacaagaaaagaaattgcaattgatgatgattttactgaagttgactctaaaattccctcaaagaaaagttcttcaattagctcattctctaatcgaaaaaataactcaaagagttcaattttaattgaagacaatttcactaatattattagtaaatcaaaaagagttacaacagacgatttcattgacacaccaagcaaaacaaatgaaacaatatctattgatgatgattttactgatattgattctaaatatgataaagcaaaaacaaattcatcaagtaaaagcattaataagcaaagtaaaacaaatgaaacaatatctattgatgatgattttactgatattgattctaaatatgataaagcaaaaacaaattcatcaagtaaaagcattaataagcaaagtaaaacaaatgaaacaatatctattgatgatgattttactgatattgattctaaatatgataaagcaaaaacaaattcatcaagtaaaagcattaataagcaaagtaaaacaaatgaaacaatatctattgatgatgattttactgatattgattctaaatatgataaaacaaataagaattcttctagtgatgaattcattaaatcacaaagcaaatcaaagaacacaatttcgattgacgattttagtgaaactaattcagtcaataaatcgaaaatcgatgatgattttgttgaagttatgaaaagctcgcaaacaaaaagccgaagtagttctactgtagatgacgagttttctgatgtcgaagatttcacagaagataccaaaagttatggcgaagtgaacagtgatgaattagatgaagttgattccgactttgtttccataatggagtcagattaacatacaaataaatttgtatatatacgtttgtatttattcatgaataaaaaatcatttcgaaaaaaacttacaattagtatgattgaattcgtatgatatactaaattgtgcaatttaatttaattttaaatattttttatttcataagataataataattttcaatcaactacatatcagcatcaaggattaacaattctttcataaaaatataagtcttatgattaatttagaaaaatagatagatagattcatcatcgagcaaaacataaactaccacgttcacctttctgtaaaagcatttgatattattagagaattataatttgaccttatttattgaaatgaagtaatttttggtgttggtgaatattaaagtagatttaattttggcaatatgttgtagctttttcatgaaattaatgagacatttaaataagttctaaaacgatactttttttgccaatgattgcatccgttttcgtcataacatctcttcaaaactggtattgaattaaaacttctatccctttcaattttcatacgttatttgggtgttttttatccttttgatagtggtgtagaattgtgactgatgacgcgaataaaaatcatctattcaaattaattatttgagtggaagggatgtgatttttcatatgtttacaaaattaccgttgaaattcaataggaggttggccgttactttgatagatctaaacacttttaaagatgtttcccatcttgcttgcattggtaacatctgctcgcattctagaagaacaatgtgatgtaagatgctggattaataagttaaacattactattgatgaaatttatacaacttttgcaacacaaattttattcgttaatctagaatttgatgtctttgtccgtaacttgatcataaataatattaaccttcaaaccatttctgcggaattttatccagatccaaacaagattgaaacaggcatattacttacattatcactttcagcgtacgctagtgcaacggtaaatcttgtgcagacagcaccaactcatacaattgacgtatctggaagttttgcagctgatgtaactgcatcacaaattcaaatcggattacaattcgaaaaagatgaaaatgggcttatcaaaacagttgctgaaattcctgatacttgcgttgttaatttagattttagtaatgttcaacttaccattgatctcggtttctcatttgatgtaggtagtcttgctagtaaacttatcgatgcatttaagggccaaatcagcgacttaatttgtgataatgtcccggagctcattggaaccgaaatgacaaagttgtttgataccataaatcaaatcatcaggccagcaattaccgaaggcaccaagccaatagaaataccaatcggagatgggatgtatgatcttcgtcgctcaccattaattaatgctgtacgttttcttttaaccaagttgattggtacacaaggtccacttaaccttaacagtcttgtcaatcgttttacgaatgagaccggtgcattcaacctctctgatcttattggctttttcggtgtcgaaatgccgtttgccttttccattcccatcgctgacttaggtgctgttcttggtctatctattgacgaacttggattttcaggcatgaacacgtggaatgcatttacatttttcgaaccattgaatgaatatgtctttgactcatatactggtatggactcattaggtttaaatttaagctttaccattaatgtaactttcgaaaatagtactataattgacacgcaaggtgtttcattaagtgaagttgctgatctcaaattattattaacggagaaccatatggaaatacaattacaaattgcatcgccagaaggcgctggtgttaactttactaatacacaaagtataaacattgattgtttaaagacacttgtagactctggaacaggtgccaaatacttaagtttccaaactagtatttcaaatattaatttagaagcatctaaaggagacttagaattagatattcgaacaacgattaataatattataacattattcattgagaattatcgatcggcaattccaccattacttaattcattaattaatacatatgcattaaatttcgttaacacagaattaaataatttcttaaatggttcttcatgtgatgcaaatttaactgatcctccatatgaagaatttgttttatggactacaatgacagctataggcgttggcttagctatcatagtcatagtatttgtagtaattgttgtcttagaaaaatgtggaccgaattctaagaaagaattatcattaagttctgatgtccattcatcaccaagtaatgaagaatcggatagtcaacattcctcaccaagtaatgatgaaaatgctccattagaatcgaacaatgttaaagttaaagaaagtaacaaagataaaaacgcagcaatcaaagctattgatacggtcattacaaatatccgttcattagaaggtaatgccggcattaatgagcccacaagtttattattaactccaaaacttccacttgtcgtacgatttttaatgccatttttagtgttaatgaatgtagcgttattcatatcatctaacacaggtattggtgcatcagtcttaatcaagatgacagttggtgagaaaatagtatcattaccgtcaatgtttgattttggtttaattaactctatcattgaaatgtgggatgcaggagcatatgcattaggcgttttaattgctattatgtcatgtgcatggccatataccaaattagtattaatgttattaatctgggtattacctacgaagataatgagtaaaagacgtagagaaagtgcattgaaagtactcgatgcattaggtaaatggtcattattggactcatatgttatgatcttaatgttagttgcattccatttctcattagaaatacctaaagcagatgaaaatgcggaactcgatggtgcaatggtcgttaacttatgggtatatccagcgtatggatttgttacattaatgattggtactgttgtttcattagcattatcacatataatgttagcgttagttcgttatgttgataaatctatggaagaaaaagaagaagatgaaaagaagataccattatttaagtccactgataatcgaattacacaaattgttgttacggtaatgttagtaatagttttagcgtttgttatagttggtgttatattgaagtcattttcatttaattttgtaggtttattaggttgggcatttacattaataccaatacctaattataatgaatattcagtaattgatttatcagtacaaattccagattgtgcagaagatccaaattcatttggcgtccgctttacacaaatattatgtttcattgtaactattgtaatgccaatcattcatgttatttgtttgttattgttatggttattaccattaaaacgtaaattccaaagaactctttataaggcttgcgaagttatgtacgcgtggagttgtttggatgtgtttgtgattagtgttatcgctgctattttggaaattagtcaattcgctggttttatggttggagataaatgcgaaatgattgacccgattgtacaacaattcttttctgaagaagaatacattaaaggtcatgaaaattgtttctctgtaattacagtactattggatggttgttatatattattcgttgctgctattttacataacgtcgcaactgttgtcattaatatccttgcaagaaaatatttggaaaatgataacgtagtaaataatgatgaagatgaagaagatattttaaagaagaaaatggaaagtaaaatgaatgacgagttaaatatagaggaaaattccgctggatcagaaaatattaataacgtgaatttggaagaggcgttggaaaataatatagaagaagaaaacactcaaatgcaagaaaatctgttataaatcttttgttttaggtttatttgcgaatatacttaaataaataaacatctttcataaactataaatttgtctttatacaacatattctgtcaacaaatttgtcttcttttggttttcgtgcttctgtaacttcagctgattatatgctgattcgaaacggcgtaaactgaggtttaacagtactgaaattgataacacaagttggttgctttagaactgtcacaacgtcacatttcgacgcatatatctgtgctacagacttcgtaatgcttgtgattatcttcaaatcttttcaatgtcgttgtgtggcacttttcccaatgcattcaaatattaaacgtaaaaccgtttgtgaaacgtgaggccgtttaaatttacaaacggttattgataaagaaagttatgaatgttaatccagaattatcaaaggaacagttcttattcgagatgcaaataagagggatactaaggaaagatatttggatgcttttcgatggggatattaacaaaagtaaaaaacaaattccaataaaaaaagattctgaaaaaccaaaaataaactatagctttagcagatgtgacgatgatttagatgatattaatagtgataagttctcaaaggttttcaattttatacaagattttcaagactttttacaacattgcgaagcaaaagacaacagagatagagggaatcctttcattgatggcagccttatagttgcttcctaaccaattaaatttgtttatttgttattcttttttctattaacaaattataattactcatttagtcaaagcgtagttaacaatttaatatcaaaataaaatacaatttaatatttagtttttataaaaaacgtatgaattttaacgatgaatgaaatgtgaaaatgatcattttcatatcatttcgcaaaatatgatcaaaggactccttcacttgaagttattttattaagcacggtttaataagctagtgttgaaatgataagtaaatattttatatatataattaatatgattatcttctcgaaaatcttttgcaaatggatcttcttcaatatgtaaaatattattacatgtttcaaatttatttaaatcttcgatttcgtcttgattaaaactattcgtaatatcactattttcttgatattttcgtttataatatattataataaaaataattacaacaaagagaattaatacaataactacaacacaaataattatgatcatcatattatcgttatttccatttatattttgttcatttgaattaatatgtataaaaattggtataatatttatataatgaataatattgaataatactatattcataatatatatgttgtgtatatgaaataataaatgttgaattatataaagaatatattaaagtatttgatataaaagaattatttatagtatagtttcagtaattttataataagttaaaactatagaatatgttaatgaaatattttttgcatcatattgtggacttgtaatagtatttggcttagaaaatgtatttgattgtgtaaatgaatttgacttagaatatgtgtatgattgtgtaaatgttattgttgatattggacatgatgcaattggcccttgatgaacattgaaattataaaatgtatcactttcataatcatttaaacattgaacggttgatgttgatgaaccagtaaaaacttcaatattaaacattggttcttccgcaccattgtaaaataaacatttgagtgatgtacacatataaaatgcataatcactaatatttttgatatttaggatcctaaataaagtgtatccatattttggcatctttcaaatgcatgtgaattaatgttttcgattgaatctggaattgtaatattaataaatcttcattaaatgcatattcttcaatggtttttaatgatttaccacctaaaaattgtgttatcttatcattcccttgaaatacgtctaatttaatagtatgtatactatctaatataaaatattcatccgtttttgatcatggatatgaaataagttctgtttgattacaattataaataactccatctttatcatgattactataatatcgattactttcattaacaataatcgattgtaataatggcatatttaagaatgcatattctccaatcatagttattaaatttggaatataaatagttttcattttaatacaagattcaaatgctctttcaccaatcattgtgaggttatctccaaatatagatgttattaatgatgtacaattataaaatgcactttcaccaattggtgtattgtttcaatattcttaaaattaatcattgttaatcctgatctaacaaatacatcgagaaaaaatatatatttgaatgagttttttttacaaacatatactaaatattatattcgcaattattcattttgttaatctaagccaaatgatttggttaaacttggctctcttaagtatgaaggcgattgtcttggtgagaatgcatatctcactgagagaggtacagttggacttctcggcgtaccattatatgttttccttacgcctttcctatgtaatcgactaatttgttttgataattcttctgttttttggaatatcgaatttaacattttttgatttctttctaattgatctgtcgccgctaataacttgttcgaaagcatgtcttgcattcctgagatatctcctgaggctattatctcatcgattttcatcaaatattgattataatcattttcagataagttcaaaaatagacctgatagagcagaagtaatcggactttgttcaagtgatataaagtgttcatgtaaacttgcgatttttgcatttatttcgaataatttcctttccatttcattaattcgtttttcattttctggttttctgaagtttatatttatcggctctgctgtaaagtttttaatttgatttcgaagtttttggtttatcataacttcttttgttaagccaacctgtgctgaacaaagttcttgacgaagcctctctgattcttgtttaatgttttgaatcgttttgaaataatgaaataaatcatcattgttcatacaatttgttaaggaacgaagttgttgaagaactccattggaattttcaagttcctttgttaatgattgtaattcttcttgtgaatgttggacacttcgagaaagttgtgcattatcatttgtcgattgttggaagttctctgaaagaattcgataattttcttctaattggtaaactttagattgaagaaaagcgatttgttcatcacttgcctttgtgttttgatcaataattgtttgatcagaatggatttctttgaatgattgactgagacgtgttatttctgaaatgtacttttcgcggctattttgtaattctgcttttaatttctcattttctgattttgaaaaagataattcaagttcacagttttgaagcttagaaataagttgttctaagctaagctgctctgaatctatgactgttcttgtgcttgcttgaatttgactttcaaggtcatcatttagatttttgagttccttaatttgtttctcataagcatcaattttatcatttagttttttgatggcgctttgtagttcttcatttttttgggtagaaaagttaatttgtattttgaattgatcattgtctgcttgaagctgattaatttgtctgatatactcggatatttcatgttcactgctttttaaattggcagcttcttcatttgctaaaaaagaagatggactatctgcaacagaatgatttgaagaagcttccaattgaataattttttcattcaaatcaaatatttcgttgttaagattcccaataatctctatcagttggcttttcttgaacttatttaaattgtctgcttctgtatccattttggcggtctattgaaccaaaagtgacaaaagtaaacgtaccaaattttttttttatgaaaaatattgatcaaaaaaattatttaaattatcttatagaacttgaaaatataataaattatttaaacgaagaaaattttgaaaattctgttgaaaaaattattgatttttttgatcaagatttccctcatacctttatacatgtaatttctcaattaatattttcatcctttatatcccaaaatagtgatgccactgttcttttgcaatttttaaatcagattcaaaccaaaaaagatacactaatcaaaaaggattacacaacaaaagaaattcttacgatgttaaatttttcatataagccacaagaatcttattatcttataaataaaatgatagagaatggaatggttgatcctagttttgtaaaatctcaaaatactttatactttgcacattataaaacagatgaagaaattattaattgtataaatgaaaaacttccattccataaatatttctctaaaaattatgaaaacctttcaaaaaatgattgggaacttcataaaaagttaattgaagaaggacataatccaaatgaaattacaaaaataattcgaaatgatgaaatcgaaaaacttcaagaaatagcaacacaagaaaattttgattttaatcaaacaattgaaacatcactttatgaaagatgttcttttattaatcattatgatgttacattaatggattatgcagcatttttttcttctattaaatgttttaaatatttacttatgaatggcgcaaatgtagaaaatacaggaaaatatgcagttgcaggtggaaatcttgaaattattcatttatgtgaacaaaatcattcatcgtttgatgattcatatgaaattgcaattgagtttcatcgaaatgatattttcaaatatctttatgaaaataatatttatcaatttaaagattcaacaattgtaggaaagaaatgtattatcttttttgactatagccttttatcatttttagaaaaagaaggattaaaaacaaatgaaattcttattcatgaagcagcaaaaattggtaatatatatctcgttaaatattttcttgatggatatgatcatattccaaatgatattttatattattccataatttcaagaaatgttgaacttgttaaatattttatcgagcaaaagaatattgatgttaacacaaaaaatacttattttttaacatataatttggaattattttatatgatttgaaacaccaataatttctatatctttaattgaaaacattgaaattatgaaatatattcttcaaaataaaaatattatgattaacgaaaaagatctttaatcattatatttaaagtttttataatctttttaaattttagtaataacatatggaatttatattttttttatttagaactgcacttatttgtgcttctataaaaggtaatatagaaattactaaattacttattgaatataaaggcattgatgtaaacatttctgatgttcatttatattttcttatatttaaatcaataaattgaaattcgaataaattgtttgggaattaattaaattattttatacttcattaattcatgcatcttttcatggatatagtgatatagttaaattgcttcttgagcaaaaaggaattaatattaatgttaaagatatttattttttttaatgaaagtttgttattttgtttttatattttaaaataaatattaaaaattatttataatatttaaaactgcacttttatgggcatctgaatatggtcatttagaaactgttaaattacttcttgagcaaaaaggaattgatatcaatgccaaagatgtgtatttattttgattggagtttaaatcaatatttcactgtttcaaagtaataattggaatttatataaatcatttgatacaccaattattgaagcatctagatatgggtttcctgatatagttgcattacttcttgaacaaaaggaaattaatattaattataaaggtgttatttcattttatttacaatttatttgaatgagtttggatttcaaaataatatttggaaattatgaataaaatttagaacagctttaatttttgcagccgaaaatggcaatatcgaaattgttaagatgcttcttaaccaaaaggatattaaaattaatgaaaaagatatttatatactgttttataaaatttctattaattatttgaaataaaatcttattatttcgaattttttcaaataatttaagacagcgcttatatgtgcatcagaaaataatcatatagaaatagttaaattacttctcgaacaaaaaggaattaatattaatgcaaaagatacttatttgttttatatgaaatttattttaataatttaaactctcaaaataatatttggaatttatttaaaatatttaatacagcacttatgcatgcatctatccggaatcatataaaaatagttaaattacttcttgaacaaaaaggaattaatattgatataaaagatattgatttgattaattttggatatattttattaatttcaaatctcaaaatagagcgtggaaattatgtgaaatatttaatacagcacttatgttggcagaagtaaatggctacgataaaattgttaaattacttaaaaataaataacattattaagaaaatcaccaattctttgctaataaaaatgataagcttgaaaatgtaaattttttacactggtattttattgctgttagattcacaaatctgcaataaccaggaagttgttttacatagaaaaaaaaattcttcatttctaaagttatagtcaacgactactaattacttcataaggaataaaataagaaggaaataatataactttcatgaaactaacagtgtaataatgaattattaatatcgacaaatattttgaagcatttaatttaatatgaaaatctaaaaaagaaaaataaaaacaaattttttttagcaaagtttcgctatttcctcagcaattttcttgcctttaacatatttaatcttaaacgcaagttgattaagttctttatattcctcattgcttaagaattttttacaattccgaagttccgaaacagcgcttttgtaacaactcatgtttttggatggcacatactcgtccatgctttccatttcgtcagactcaaatattttctttaacgcgttatataatccgtggttcattaagttttggccataaaaaaattccgaaattttcatagatttcattgatgagtcaccaagctcattaaatttgataccataaaaatcaaaatattcaagcatgtctttgaacgttccatcgggatggcgctctatgaacgttgccattgtaagcgaggattcaccagataaatggatattgccaagtgatggatcaggaaaaactggatttccattggtggttaccaacacatatacatttggtataggtttgaggccacttgagaatgcattgactgatgtaaaaaagaaaagatgcctgaaacgattatttgatgacatttgttgaatggttttctcaagatctataaaataaagatagtcgtctgggagtgtgagacaatatatggagtaataaccagtgtagaaaatatatacattatcagactcatttgataaaagtgcaggcccattggaggtgtctccgagtaagacattataaatgttttgagatgtgacgtttttgcctctgtagggaatgttttcagaacctggatatatatttatagaatgatttagattatgaaaaacttgtcctgggtacatgttcttgggtgagagggcgatatcatcatagttcatcaaaatgattttgtttttatcaaatccatttttgataagaagatgatattgatagaaagcatctgctgaatgacggtactcatcccacccttttgtgcctgtcagtatcactgcccagttatcacatgaaactgccaatacgaaaatagagatcaagttcattggcattaaatcaggccaaattttcattcaaaaagtggcataccccagaaagataacaatatcaagtgcttaaaattacataaaaattcttttttatgtatctgttttatttcattcggaagaatacaagagttcttatatgttgacaagcaatattttttaactatagtttcttcagttaaattcgataaacatttctccataacttttctgtgctgttagtagaaatgatcaggaagctgttttccacagaaaaaaattatcttcattctaaaattcctatactttgcccaagaatttttagacactaacagtaattggaaataatatgatttattttgttttgatatatttgatcaatttctttttcaagcttattgatatctaaataaaaagattctctataattatagataaatttatctttaatctaagttgttaatagttttaatatttttttttatatttcttttttaacatatcctttgttgtttatcattgattaacaaataaaattttattataaattaaagtgttttagttttcttattagtagtagccaagtctggcacatcaatctaaatatttgtgctttgtcaaattatacaagacttcctcctcataagtttctcgagcaagctgacatcaatcggttaatacttatacacaaaaattccttttgattatatcaaatgctttcttaagaagaatctaaaaatgagtttactgtttatttagaaaaaaattattaaaaaaaaataataatcgctttaattgcaacatccttttttcttttgatcatttggttctggaacttgtgctagcccttcagctttgctttctttaacttcaacaccggcgtaattgtcttgattaaattttttccctaaataattatgaatttcttgaagccctgttccttttaaagctgatgctaaaaacaatgggtacgatttccctttacaccacgtttctatttcttctagagtttctgataactgttcggatggaacaagatcaattttatttgcaacaactataacggatgaatcacttcctgaattagaaagaaagttttcaatataatgctttgctttctcgaatgtttgtaattctgaaacatcaaaaactgcaacagcagcatttgaatctcgataatacattgggccaagtgattcaaaacgctcttgtcctgcagtatcccaatagtttaagataatacttggggcatttggtggcatatatgctatcgaatatattgacatattaattgtatgtggaatagaattgatatcaaaacttggtccttccttaagacgctttaggatagatgttttgcctacatttgctgttcctattaaaacaattttgtactgggatgcgggcataaaatgattacaaaggaaaaagttggttggacggtttggtgtttcaccggcgcatattttgaattgaagatgatcaccctcttttttcgtcgtgccgatagcattgtgtttaaaggaaaatgaattaatttaaaaaaattattgggaagttaccttaaagcaaaagaaaagattaatacatgctaagaaatattttatacatttaaatttaaactatgttatgccttttgagagtgtcttcctgaagatatctaaggataacgtttatattgacagggaaatcgttacattgatattagaaatgatttttggcttggaatataggcgaaagattctttaaattttgatattaaaaaatgttcacgcgaaacaattatttacgcgtattaagaaaataatataaatatgttttgtctgctaataatatgataatgtttttgtaaaatagaattgtaaaatttgataatatagaatattctatggtttaatggagtaaaatcgccaatagttgattggaataatttaagaagtgtgtgcaacatctactatggtaatattaaattatccgactgtaatgtttggaaatcttttcgttgaatccagaacaattgaatgccttccaatacttgtatttacacaagcaaataataaattaatacagatgatatattatatgatttgttggaataaatgtaaaaatttatcaataacattaaaataaataattatatttgtgaattgaattcattttctttaaaatctttcgcaaatggatcttcttcaatatgtgacattccaatccctatcgataatatattcgtgtttccttcttctgtatattcttcttcttcttcatatttcatttttcgtatttgatttctttttattattacaacaagtaatgttataacaatcagaataattatgataatacaaacaattacaataattattaattcgttattatcgttattgttatcttcattcatatttttattcgaataatatattgaataaaaattggaataatattcataataagtcgaataaatgataattgtataattataataaataatttctgtataaatatatcgatattctgattcagtatttgtaatggaatatgatttaatatatattgcataatatgataatgtttttgtaaatgttaatgaatatgttaaagtataagtattcgtgaatgttaaatctgaatcaatatatgtaaatgtatttgatttagtaaatttgttcgatttagagattttatttgatttagaatttgtaaatgaatttgattgtgtgtaagtgttactttgtggaaatgatttagaatttgtaaatgtatttgattgtgtataagtgttactttgagtaaatatattggaatatgtatttgaactagaaaatgtttgtgttggccatggaagacactcgtcattcgttgtccctttcgttacatttaaatatgcaaatgtgtcacttgaatatgtttctttagtcataactgtcgtggctaaaactttatcaaatggatcgtgaaatcgattttctggtatcgttggtggtgtttctccataataataaatacattgaagtgatgaacataatctaaatgcataaatatcaattgttcgaactttttcaccaataaatatcgtttcaagatatggacataattcaaatgaatatccttcaatagaagtgatagaaattggaatatgaaatgttcgtgttgaatttccaatcggatatgaaattaatttcgttatatttttatcatataaaactccatcattataataattacaaaaatataaattttcagttgaaactttaataaattgaagattttcacatttatgaaatggatttacgcctatcgttgaaatagaacttggaatattaatatattttaattgattacaactttgaaacataagaggtccaattatcgttaatccttcttcaaaaatgactgtttcaagattttcacataagagaaatacactatctccaattgttataactgatttaggtatcgtgatattgattaatgaattgcatgaactaaatgcaacttcagatatcgttcttaaatttgatcctaattttatgatttttaatttattacacgaaacaaatgcaccattagatattatttccaaatttgatcccaattcaatgttttctaaattaatacaataaaaaaatgcttcttctaaaattgttttaactgaatctccaatttgtgctgatgataattcagtccattcataaaatgctttttctttaatttcttcaacttctttaattataacatgtttggttatatttttataatcttctgtaaattcactcgtttgagtgattgtaagtgtttgtgttgtatcatcatatgtttgaaatgtactaacaaaaaaagattaaaattaaaaatgaaatatttcctttatttttattagaaaaaattattgattttaaaattgaaaaataaaattgtaaatattaataaaatagaatattctgatttttcaatatttaaaataaattctataatataaacaatgaacttaaagatatttaaagaatgatagaatattttgttgtataaatctttatttagtgctttgatatgaaagaataattttattgaattacgaaaactcttctcttcttttatggaaaaatatttgattttgttttgtggatgaatatttattaatttgttacaaaattgaaaatgattttgatgttttactttaatcattaattgcttattccaaatcgtttgataatcaattgtattcatagcaaacacaattatcacgatttgaagaatatctttgcttcgcatcaatttttatccaaagttgttgacttttttctcttctgaaaagctggaacaaattgttgatgaacatgtcacttttctattgaccaaaatgaaaactgccaaccatactttccatttctctttactaatttataaaactttatgaagaatatgaagaaagtttcatcgtatatttattgtcaatcttttgcacatttgtgtaggtttaatttgttcctgatatatatttttcaaaaccaaacacaatttttttaggtatatttttaataaatactcaaaattgactcattttgatttaattgatatctttaaataaggaatattggagtaaatgtttcatgcaaatttattcgacatgtgatgtggaaagcaataaaatttcctatcgttgtctaaaaaaatatttcaattattgtcatttcaaagcggctttttacgatttcaatactttgtcaaaagccgagacgacgataagtattcaatttatggtttgcaccttaaccccttcttgcacaaaatacagttatattatggatgctgtatgtatttcgaagcaggagcaaccaagaagattcaatatagttctaatatcttcaagattacttacattgcttacctttagttgctgcattatctcctgtttccattttatacaagaaaaaaaaaattttaaacatcaatatcaaaaaatgccaacatttgctttccaacagaacaccagtttaaattatatgtcaaatcaaaagataaataacaaaatgtcaaaaatctcatttctttattctttacatattcaaaaattaaggaaattattcgatatttttagaagcctgatttcatgtaatttatataaaccaaagaatatctttaagaagttaaaaaatttaagtaacgaatttcaaaaatattctttgactcattcccatatccagatgaaactcaaacctttgtattttttaatggataaatcggattattattatttaaattttttcaagctcaaacttttttcacgtgttttttgtaataaaaataaaatattctcaagtaacacgttgtttatattcattattctttcaattttttatttaacgaataactttactgtatatcattttaataaaaaagttcataataaaaataaaggaaatatttcatttttaattttaatcttttttgttagtacatttcaaacatatgatgatacaacacaaacatttacaatcactcaaacgagtgaatttacagaagattacaaaaatataaccaaacatgttataattaaagaagttgaagaaattaaagaaaaagcattttatgaatggactgaattatcatcagcacaaattggagattcagttaaaacaattttagaagaagcattttgttcatgttataatttagaaaccattgaattgggatcaaatttggaaaaaatatctaatagtgcatttagttcatgttctaaattaggaaatattaaattaggatcaaatttaagaacgatatctgaaactgcatttagttcatgcaattcattaatcaatatcacgataccgaaatcagttataacaattggagataatgtatttctcttatgtgaaaatcttgaaacagtcatttttgaagaaggattaacgataattggacctcttatgtttcaaagttgtaatcaattaaaatatattaatattccaagttctatttcaacgataggcgtaaatccatttcataaatgtgaaaatcttcaatttattaaagtttcaactgaaaatttatatttttgtaattattataatgatggagttttatatgataaaaatataacgaaattaatttcatatccgattggaaattcaacacgaacatttcatattccaatttctatcacttctattgaaggatattcatttgaattatgtccatatcttgaaacgatatttattggtgaaaaagttcgaacaattgatatttatgcatttagattatgttcatcacttcaatgtatttattattatggagaaacaccaccaacgataccagaaaatcgatttcacgatccatttgataaagttttagccacgacagttatgactaaagaaacatattcaagtgacacatttgcatatttaaatgtaacgaaagggacaacgaatgacgagtgtcttccatggccaacacaaacattttctcagtcaaacacattttctaaatcaaattcatttacgcaaagtaatacattttctcattcaaacacatttactgaatcgaatacatattccaatacattttctaaatcaaattcgttcactcaaagtaacacttatacacaatcaaatacattttctaaaataaatttgttcactcaaagtaacacttatacacaatcaaatacattttctaaatcaaatacattcactcaatcaaacacatattcgaatacattttctaattctaattcatttacacaaagtgacacattcactcagtcaaattcatttactaattctctgccgaatgatgtaacattttcgcattcttttgtattgatgaattcatattctgttacgcaaactgtttctttttacacaatacatattattcaatctctatataattcatatcaaacaaacatcatttcatatgagtacacagttatttattacacttctctttatcaacattattctgatttctatataatgtttacacctaatcatgaaaataacgaatctctgagcaccaatgcattaattggaattatctgtggtgcagttgtcgctgttctacttataataggaattatttgtttcgtaattaaacatcaaaaactttctaaaacgaaaacacattcgaatcaagaagaacaaaagacatcagttgatatgaaatttgaggattttaatcaaaatataggagaaaatattctggaggataatgaccaatggatttgattaatgttttatataaaaatgttttgtgtttaaattatatttttcgttttatttgcatcaatttatgtgtataaacattttttagactttgagtatatttatacataatgtaattcgaaataatttcataaaatcaacaagaaaaaaaaattttatcaaaattccaatttaaaaaaaaataaaatagatcatttttcaagatactattttgtttcttcaaaataatccaatttggagtacatattccaagattacactctattagacaaccaaaatgttgaatgttcgatacaactttttatataaaggctaatatttacccaaatataattttttttcgtttaattatctacgcattcaattttcggtaaatcattcaaatttaaagttttaattcaaaatttgattaaagtattttttgttagaaaaaattgaattaacagtgatcaaaatgttgcaatcacttatttcttatgcgatgctcaatgtatagaaaacctcgagattactaacataccaacaatttatcaaagcaacttttcaaactatagttcaacaattatcaatctcataattgaaaatggtgtttacaccatatcagattccgcattttatgaatgggctgtgctaaaaaatgttactcttggagattctcttcgttcaattggagcttttgccttctatgcatgcaaagctttagcatgtattacctttggaaaaaacttatcacaaataggtgatgaatgctttcgctattgtaattccatgttctcgattgatttgccagactctcttgttactcttggaaaaaaatcatttttttcttgtagcttggaggcagttaagcttagtcaaaatctgaaaagtattcccgaataataggaaatagtctaacaacaatcagtcatatatggcttattattgtaacgaattaaaaaatatcgtaactcctgattcaattactaaaataggatattacgcattttgttattgctcgagtttggaaacagttattcttggaaaaaatttaaatgaaatcaatgtttttgcattcaaagattgcagtaatctcaaatgtgtttattttcttggtgatacttcgccaacatcatatgcatcaaatgctttcgaagggactcaggtacaatatgttatgatattagattcatatcagagtgaaaaattttgtacacttgaaatatcaaaagggagtaatcgaagggtgttctccatggccatcgccttcattcacggcgtaaaaaaattttctaaatctaattcatttactaagtcaaacacatttactgaatcaaaaacatttacaggatctaatatatttactgaatctaatacatttacaaaatcaaatacattcacaaatagttttactaaatcaagtacatttactgtttcaaataaatttaatacaagtgcagatgcatctgaaggatcaaaatctaattctgcggctattggcgttagtgtttctgttgtagcttttgttgttgtagcggtgatcgttgtcttgttgatttatattcattataaaaaacataataacgctgtaatagaagatttatctacaatgagtaatgataatgttttatatgaagaattatatgataaaaataaatactgagagcaaattattattttttacagcagaaaaattttataaaattctatttgttaatttttttattttttgtaaagcattggtaatttggttattttcacaattttatgatattaaatgatatagtttatgatttacatatgtaaaatcgatataataaagttaaagtcatgtcctcaaatatattttccactgttatatgtaaattaatgttgttttaattttatttaaaaaagttaagttattcaagtttaagattattaagtgtttcaattgtttgatgatatatattaaaagttttaataatatatttaaatatttatataaaaatgttgtttgatttgactatgtttgatattcaaatataattttcattaattgtttgatccaaatccattcttcatcattcataatttcatccatatgtaaaattattattgaatttatttggttgttgtatatttttataattaatatagttgattaattatatgatttgttggaataaatgtaaaaatttatcaataacattaaaataaataattatatttgtgaattgaattcattttctttaaaatctttcgcaaatggatcttcttcaatatgtgacattccaatccctatcgataatatattcgtgtttccttcttctgtatattcttcttcttcttcttgtttcatttttcgtatttgatttctttttaatattacaacaagtaatgttataacaatcagaataattatgataatacaaacaattacaataattattaattcgttattatcgttattgttatcttcattcatattttcattagaataatatattgaataaaaattggaataatattcataataagtcgaataaatgataattgtataattataataaataatttctgtataaatatatcgatattctgattcagtatttgtaatggaatatgatttgataaatgttaaataatatgataatgtttttgtaaatgttaatgaatatgttaaagtataagtatacgtgaatgttaaatctgaatcaatatatgtaaatgtatttgatttagtaaatttgttcgatttagagattttatttgatttagaatttgtaaatgaatttgattgtgtataagtgttactctgagaaaacgaatttgtatttgaaaatgtatttgattgtatataagtgttactttgagtaaatatattagaatatgtatttgaactagaaaatgtttgtgttggccatggaagacactcgtcattcgttgtccctttcgttacatttaaatatgcaaatgtgtcacttgaatatgtttctttagtcataactgtcgtggctaaaactttatcaaatggatcgtgaaatcgattttctggtatcgttggtggtgtttctccataataataaatacattgaagtgatgaacataatctaaatgcataaatatcaattgttcgaactttttcaccaataaatatcgtttcaagatatggacataattcaaatgaatatccttcaatagaagtgatagaaattggaatatgaaatgttcgtgttgaatttccaatcggatatgaaattaatttcgttatatttttatcatataaaattccatcattataataattacaaaaatataaattttcatttgaaactttaataaattgaagattttcacatttattaaatggatttacacctatcgttgaaatagaacttggaatattaatatattttaattgattacaactttgaaacataagaggtccaattatcgttaatccttcttcaaaaatgactgtttcaagattttcacatgagataaatacattatttccaaatgttataactgatttcggtatcgtgatattgattaatgaattgcataaaccaaatgcagtatcagatatcgttctcaattttgatcctaattttatgatttttaatttattacacgaaacaaatgcaccattagatattatttccaaatttgatcccaattcaatgttttctaaattataacatgaacaaaatgcttcatctaaaattgttttgactgaatctccaatttgtgctgatgataattcattccattcataaaatgctttttctttaatttcttcaacttctttaattataacatgtttggttatatttttataatcatctgtaaattcactcgtttgagtgattgtaagtgtttgtgttgtatcatcatatgtttgaaatgtactaacaaaaaagattaaaattaaaaatgaaatatttcctttatttttattagaaaaattattgattttaaaattgaaaaataaaattgtaaatattaataaaatagaatattctgatttttcaatatttaaaataaattctataatataaacaatgaacttaaagatatttaaagaatgatagaatattttgttgtataaatctttatttagtgctttgatatgaaagaataattttattgaattacgaaaactcttctcttcttttatggaaaaatatttgattttgttttgtggatgaatatttattaatttgttacaaaattgaaaatgattttgatgttttactttaatcattaattgcttattccaaattgtttgataatcaattgtattcatagcaaacacaattatcacgatttgaagaatatctttgcttcgcatcaatttttatccaaagttgttgacttttttctcttctgaaaaactggaacaaattgttgttgaatatgtcacttttctattgaccaaaatgaaaactgccaaccatactttccatttctctttactcattgtgcagatttaatttgttcctgatatatatttttcaaaaccaaacacaatttttttaggtatatttttgataaatactcaaaattgactcattttgatttaattgatatctttaaattttaaacaattttttatttatttttcgtttttcatgatacaaattaatccatttctaaatttctaattgttccattaaaattcgtgatatttccttttctattgaatcaatttgacttattcctaacatatgtctaatcgcttgttcttgttttaataaacgttgtaattcttgtgctcctttagttacacaaattttataattttcttcatttaatttattattcggatcaaacatataactaaagttcttcgcaaaaaatgaataaattttccttttttcgtttgcaaaattcgttttcatttcatcaagttccatttggaatttagctgttgttgataattgaatcgctctcattttagaacttgtgatttgtatttcgcgtttagtttcttcttttaaaaggttcatttttgcttctaatttttgattctcctttgaaagatttgcattaatttcaattatttctttgtttttaaggttactttcatttaatgaatttgttgtattttgcaataaatctcttaattcattgttttgctctttaaatttatcgacaatttgttgatacttttcttctttcattatattttcatcttttatttgtttttcatttaattttttatatttattgatttgttcttctaatgatttaatctttttagcattatcacttttgattttacttaaacattctgatgtatatttccatttttgtaattcgatttcaagtttattttgttgttgattacattcatcaatttgttttccttttaattgcatttgtttattataatcattttgtaataattcgatttgtttacgtaaatttgaattatcttcttcaatttctgatatttgtgatatatattttgtttgcatttgtgaattttgttgctgtaattgttgtgatttcttttttaattcgaaattttctttttcaattctatttaatctttcttggtaatcttggactaaaatattttgctgttcattttcaagcaaagaatttgaatttgactttttaatctttttagctttaatttgtaatttttcattatttttcttaagtgtttcgatttcatttaatttattttctatcatagaaattaaatctgggaaattattaactttaaatttatcttcaattgttttgatatcattattaagtttttggttatttgtagttaatttaattttagactcaattaaattagaaattttattaattaaattcgcttcaaatgttggatcattcaaaaatgcttcttttgttattgttatatcttgtaaaattgttgataaagtatttaataaactttcgattttttgaagaattttttctttttcatctaaattcattctgtttaactttttaatatcattgatttgttgattataatattttccaattatttccattatctgtttcggatttatttccttttcttcatttgaaattgaagcaattaaattccgaagttctttaggaaattcactacataaagcagaagctattggatttggagttataactttttcatattccatttgtgaaattgtttttctttgcgtttcaatttctttttgttgtttctttaatactgatttttgttggaaacaaatatcttcaaaacatttaagtgaatttcctaatttttgtattgcttcgattaaaaatgatctttctttcattgttttagaaagttcttcagcttgcttattaaatgaagattcgagtaattcaattgatttttgatatttggatattttatgttgatcttcagaaatagttaaattatattgatcgtttgttatttttgaagacttgatttgtgataaataatttttttctttttcattttctttttcgatttcaagtttcaaaatttcgttttcatttcgtaattgtaaattatcatttttaagttttttattttcttgatttttctccttaattcttgttttatatttgttgtgcttgtttaataattcttcgtttaaagagttattatttgcttgtaatgtgtttaaagttaattttaattcatttaatttttgcttatataaatttatttcatcgttgttttgtttgttattcttttcattaagaatttggtcatttgcttgttcaagcttatcttgaagatctttaacatgttctttttcagtttcatacatacgctcaattgctgaaagttgcttttggtattcttgttgattttgaaattgggttttttcggtagattcttgaagatgtgaaagatgatctaaatattctaaatttttggcttttaattctgttatttctttttcgttttcttgttttgtttgtttaagatcgttatacttttgtttaagattaagaaatttttgcttaagttttttaaagcctgttttgtatttgtctgtttcttgtggagttggtgatgtaggttcaggtgcttcttttttctttgctttttggagaaatgaaattagagaatttgcattattaaaaggaaattgaaaatgttcttgtgcttttaacaagatgttgttgattgaattctgtagttctttgcattcatttttttgatttgaaattattttattgttttgatcaatttgattttgatattccgaaatttgctttgtgtattcatcatttttactttcaattttttgcttgaatttttctttttcttcgcgaatttgtgtctgtagatcctttttttctttttctgaagatctttttaattcttccagcaaatgtatattaaattcaagcctatcgtggagctcatctcgttcactagaaactttccttagatctgctgaaagttttgtatttttttgacaaattgattcaagttgatcgtgaattatcattgtatcttcataatactgctttcttagttcatcaatttcatcattggacctttcttcttttctcggagatgaggaaatatttaaaatatcccttggttctccatttgcagtcgaatccatttatggcgctattttggctgtttttcacaaagtatgttcagaatacaataataggtttcttaacgtccaatgtgtctccaaatgataaacaacggttattttattccaaagtcactaaataaactgccacctttttttggtgattttaagtttgatcattttgattatattgaatatacaacatatttaattcattttgattttcgtattttacaatttcgaagaatttttgcaatgcttaagcatataatatatcaaattttcaaattattattttgttttcaaacaaattttaatcaacaaatcagagctcaagtttgtatttaatattaaattcatataaatttatattagtaatgaatcaatttactaatacattgttcataattttttttttatttttcataactataataaacaaaacgattataaattcgtcaagataccaatttccctcaaaccaaattaccatggtgcatctgaataagatacaatttaaatcaattatattaataatctaatttacctatttaataaattttatgttacgaatataaaagatagcaaaagcgtctttcatataagtaaaccaaagtttattcttctgatgtaatttgagaatccttgttgtagcaaccacctcaatggaaacgataaaactttttgtaagacgattcactcgaaacaaatcgttgcaacgatgattattaatgtacaaaaagttaaaattttcggggttgtcgaacgtttgaaatcaaagtttcacagttgtgttttaaaaattttgtttagttcacagttgctgtaagttcagaaatttgatataaacctcttttccataagaaatattttgtgagggcaaaaatgtaaagtggtcaaaatcaaatgcttcgttcaaactagtttttcggactaactccatttttttagctttgcttgcatgatctttctacattttctcattttgccaataagatctgttgttttttatgataaagaaacaggatgtgaagatataccaatcattcttccaacagttacatcatcaaaaccttggatccaatatgcaggcgaacagtttgttgacttgtttaacaaaaccacaggttgtacattaaaatggtatgatgaaaaggtcttcaatggaaccattcctgacaaatccatatttctttatgattctgaagtatcccgtaactattttaagcaaagcatttccgatgaaacaagagacttttttgaaatcgcagttatcgataataaattatttatcaaaggaggtactcgtggaactttatatggtattttcgatttatttgaacgctatttcaatgtccgtttctatgcctcatggatgacagttgcacaaaaagttgataaatttgaattatcagattcattaaaatattctgatgaaggtaaaacctatttccgcgaatacctcttttcagaaacctattttatcaatggtgattatgctaatcgtattcgtgcaaatgctggtcaaacagcagttggcgataaacatggaaaaaagctttcacaaggaactgagaaatatgttacacaagttttacgagaagcaggacttacacttgaaacgcatcctgaatgttgggctcttctttcggatggaagtcgtttttggaaagcgatttgttggtctaatgaacaaagctttatagcacttcgagattatttcatgtcagtggcaagtcaaactaatccaccatattatattgatattgaacaagatgatagtggggaatattgtcattgtgaatcatgtttaaagaagatagaacaatatggtacattagcaggaatttatgttgaagttggtaatcgaattcttgaatatgcatcagaaaaatatccaaatcaattgttacgaataattgcatatttgtgttctagagctccacctacgaacggtataactccacataagaatttacatgtacgatttgcaccattagaattagattattcacatcctatagatacagaatcacatgaacaaaatcaacttgcgaaaaccgattttgataattggaaaacacttactcctaatgtaatggtatgggaatattcatcaaatattaatcaacgactttgggtatatccaatgtttggagctattttaggtaatattaattattatcaaaacaaagggattgttggttatatggcagttgatgaaattccatggtatcgtgaaaatggaattatcacaccatattatcatcaattcatggttgaatataaactttatttattatccaaaaatgcatggaataataatcgaaatcaaacagaactatctaaagatttcttaacaggttattatggacgaagagcatcgccttatattaatcaatttctagaagaaatccaagaaatagcagacaagaatacacaattaacattttgttatagtactgcatcatggttctttactgagaaagatttaattcattataaatggttatgggataaagcatatgaagaatgtcaaaaagatacatatgatgaacgttatgtatataatgtattaacgtcaatgatatctgtttatgataatttattttataaaattagaacaagaacacataattatatatgggatgataatattagtgctattagaccacaattagaagaatatgaatcatctacaatttctttattaaaagaattttgtattgataataaatataattatccaagaagacatgaatgtactaatgatattgatcatcattataatgaatatatacctctttggcaaagctcaaataagggacaaatcatttctacttcttctttaattgtaatgacttctgatagtttatctggtagatgtggattattgaaatataataattataattatttagatggtgatttaggaggtattgatacttatcatttagaaggtcctaatgttaatactataccaaatccttctttatatgatattaaatctcaaacatctacttcaatcacttataatttaactaatacacaacgtgaaatcattaaaacttattccgtttcaggtaacgttttaacatttacttcatcatatgaatcaattgatggtacaactgttaatagacctgtttatacttttgtaattaaagcggaaaatgatacatccaaaattgcttggaaacttaattctaatgaatggaaatctaaagcaattgcagatgatatggattgggatttctttggtgaaggtgaacaatccgaagttaaaggcggtacattattaattggtgattgtgattctaatagaggacttcaaattacttttccttcattagattttgagttttgtacttttatagttaacaagactacaaaatctataaagatattattatcagtaccttcaactacatctaaagttacagcatcattccaaataacaccaataacaatttctggctatgaagaaccaattaaacctaagaatagatcaaaatataaaacttatagaatctcagaattaattattccatggtcattagcttctcatcgaacactttcatgggataataattcacaacaaggacgagcacttaaattctcattagtaccacaagctcaattatatttatataaatcagtaattcaattatatgctccattaaatacagtatataatatatctttccatgctagatgtgatttatcggaaggtgataatttaactaaacaagtttcttggttcggttacacaagtaatggtaatgtttattatcagagtaaatataaaaatacacctccgccagtaaataattcaaatgattacttcgaaattagatatcagaatttaatcactttcgatgataatttctctcatttcttcatgggatctcgcgaatgttgtaagaacctttacttggattatatggacttcgtacaaatggaagaagcaaaagaaacacctgagaaagtttacaaagaagaaatacttgagccgtgggatttcgtttatgaacaagcggaaccatcaaataatattaatggtgatagtaatggtttaagtggtggagaaattgctggaattgcaattgggtgtgtagcttttgtactaattgtagttggtattgtaatatttgtggtgaagaaaaataaaggaaagcaatcaagtgatgtttctaattaaatgtttttttataaaaaaaaataaaatttatcaattacttaaagtttttggttgttcaatgatttgtttttcgttttgcgattttgtggggaaaataaagaaaaaaggtaaaaatggtttctttctgaaaaaaaccactgcttttccattttttgtagtctaaaaattgtatagttttcaattaagaaatgatttttatgctaatattcgtgtgagtgtagagttagtccaaagaaaataaattattttttcaaaattgagagaataaagccacttttagtaaactggtaaacgatataactgcaggggataagaattttaaccgatcttttcgattgaattttgaatggattagaaaaaaaattggtagtgcaaattgagaaaggcagcttttgggtcaatttttttcaaatttaaaatcaatttattcgattatataattaaaaaaaaatgttactgtcgaatatatagattacattaataattatacaattaatttattatcaaaaacgaaaaatatttattagatgttgaaatttccttagtttaagcacatgaaaagtgcatgattttgcggtttatgctgaattttgaactgcattaattcaataggagtcgaaattgctcagaaaattgaaagctctgaaattcatatcttataatgaattccatttggctccaggttgaatcttcaaatgaaaatgaaacagagaattactttggcgttttcaattcagacccacgatcaattggaaaattacttaaaagaccatctaatccagattttggatatcaaatagactcattccagacctcaagttctgaggaagattttcaactctcttcttcatctagttataattaatttttctttatccttttttatttcatctagttgtgaagaaatcggacctgctacattttatttctgatattctatttgttaatattattaaataaaatgaactagttttaaaaacttacttttaacctttacgtcttcacacatacgtgctatttttaagttttttaaattaatctatttcaaatctaattttattttttatttttttctctacttattctactacgactggaaaatgtactaattcagaagtacttttggaaacaaaaatgtcttaaattaagacattttctgaaatatttgaatttctgtttggcgccaatttcaaaataacgtttatttaagagggcagtttttcagttacaaaatattttgaccgtttagttttatatactttacgtaacttcgtatgccaatttttgtaactgctgtcagaaatacgttgattattttttcaaagaaaaaaacgctgaagaaaaaaaaacggtttattggtatttgacagaccgtcataataataaagaccagaaactgattataatattgaatgagtaggtctggacaatcattcaaaattgaataatattattcgtttagatttttgaacggcgattatttcgtttgaatgaaaacaacaaagctgatagcaattgaatagtattcaatttttattattgtttcatgacttccgaagaatgtgtctctcgacaaggttatgcatataaacctggaggagttttcaagacatggaaaaagagatggtttgtgctcgaaggatctgaacttaaatatcgaaagaaccctggtcacaaggatgtaaaaataatcaatatgaaagaagtagaagaaatcatattagatcaaactaataaacgtaagaatgtaattttgattcgaaccaatcaaaagaaacattatcttcaattcaagacacttaaagaagcagaagattgggttaaagaattagcacttgccaaacaaggcaaaaagaaaatacatattaacatcggggactttacagtacttaaggtcattggacgtggttcatttggtaaagttcaattagttaaacacaaaagtgatggacaactttatgcattaaaatcgttatccaaaagagttttagctaagtatgatttaataggccgaactctcaccgaacgaaacacattaattaaagcaaatcatccatttttaacgtcagccagatactcatttcaatcagccacaaagttatttttagccttagaatatgttcctggcggcgaattattcacacgtctttataaagaacggaaattttctgaagatcaagtcaaattatatgtcgcgcaattagtgttagcaataggttatcttcattccatcggcgttgttcatcgagatattaagttagagaacatattagtcgacgaagatggatatctcaaagttacagattttggatttgctaaagaaaaaatgtataaagaagaatcgacaacaacatcgttctgtggtacaccagattacattgcgccagaaatgatattgtccaaaccatataacaaatctgtggattggtggtcactgggcattttgacttacgaaatgttatacggccggccgccgttctatagctctaacacagatgcgatgtttagatcgattctttatgatccaatcgatttccctttaggcggatcacttgaagtaattgatttcatatcgaagttactcgaaagagatccgctgaaaagacttggatcaggcccaaatgaaatcgaagacttaaagaaacatccgttctttgagggcatcgattggaaaggcttgttgctgaaaacaattccaatgcaatggaagcctcaattaaatggaatcgtcgacacttcgcagttcgataaacagttcactgatgaatgcccagcaatatcatatgaaaatccagaactaatttcttcagaaactcagcaaatgttacagggatttacaatggaaaacacaaatgtcatcgatagcttgtgatttgcgttgtattttttcatttcccatgtaaatgatttagtgaaaatatttttgaaattttctacaataaaaagaattacaaaaaaatatttgtagttcaatgacaaaattagttaacgatcacttctaaaatgttaacatctttcgcattttaggaggacaccatttctctttaagaatcgtataaaaatattttgaatttgaatgcaacaagattcaaaacactgccaagtttcattagaactggatatgttcactttgtatacgattaacatagctgttaatcttaaaaatgaaatattgaattcaatttgatagaataaaagatcaaccaaaagacataatgggaattgtcatcaaggataagttggcaacaaatgattacatatatttgtagttaattctacaacgaaaatagcttggaaagcgccactttttgtacctttgtttacaaaaactgacaacccaaacaaattcagttaattatgtaaaaagtggtgtttatttatttatgaatttttgtgccaatttatgggcttaaaatcactttcctcctgaacttaattcagcaccctaagtatcattaacatggttatgtttgttttcattcttgaagaagattcggagtacgttaattaacggttgtggtccatcctctcggaaaatgggtaaagctcaacaaaagggcaaggcctcaaagaaaataaagcaggatactttcctcaagaaggagtggcgtcatgtattcgtcccaggcttcttttcaaagcgtgatatcggattcacagtttcacacaaatgtgctcgtggtaagacaccagcagactaccttaacaaccgcgttttcgaactttcccatggtgatcttgttgatgaacaatcacacgcatatcgtctcttcagctggaaatctgttgatgttcaaaacaacgatgttttaactgttttcgctggaatgaggttaacaaacgataagctctcttcacttcttcgtaagtatcgcacactcatcaatgctcaagttgatgttcgtacagcagatggatacattcttcgtgcttttagcattggcttcaccaagaaattaaatccaaacaagaaagcatgctatgctcaacaatccaagaagcgtgaaatcagagatgcttgcattgccattatgaaggagacaattgaaaagtccacaatcccagaattgtgccaaacaattgtcaacgaaacaattgaaaaggctattgtcgaaaaatgcaagactatcatgcaagtcgataatgtctatgtaacaaagatcaaagtcatcaaggcaccaacattcactggtgatgaacttaagaagctccaccaaggtcgtgcagtcactaaagcagctgaagttgcacgtccagtcgaagaagaagctaaggccgaagaaaccaaataaacattgcaatttgcaaatgcttttggatatgaggaaatgtttgtgtttatttcaatcataatttttaaaaaattgttctgtagaattccaatataattttttttcattgcattttagaaatttaatttaacataaatttcaatgaacaagtataggggagacggaaatgttttatcataaatatgatccctttttatttctttgataaaaataatatatatgaaactacaaaagatcgtaagaatgatgatatattttttgagatcagagatattttatatagcaagaaaatgctaaaataaaccaatgatattgtcatttttttaaacgtatttcatttttatgcaactcgaacaaagagcagtaatctttttccttaaaagaaaaggccttaaactcagccaaattaaacaggaattggatgatgtttatcaccaagatgcacttgacattaattcagtgaaatattggattcatcaatttaagttagggagatttgagataacaaatataaaaagtcctagaagaccagttctagattttattgatacaaaaattatggctgcactgaaaatggagccatttcattctacatacatattaagtgaaactttgtctattccgagattcactataaatgatcaccttaaaaaactaggcttccatagctataatttaaaagtggttctctacgaattgatctgtgaaatgaaagcagtgagggttcaaaaagcaatcgaacttcttgatatttcgaaaacaaataagaggaagggtttttgtgaaatcattcctggggatgaatccatatttttcttatcatatgatcaccagcatatgtggtctctatcaaaagagaatttagctgaaataattgatactaaaatatatacaaaaaaatatatggtaactatcttttggaatatcgataaatttttcatagttgatttaatgaaagagggtgaaaaatttaactcaaagtattttatcaataaaataattagcccattaaaagaaattgtatacgtacaaggtaaaaacccaaagaaaattattatactttacactttgataatgcactcccccacacctcaaatgcttctacctagaaagataacttattcatgatgaatgaaataaacatttcatatattatagtacaatgaaattagaaacacatacatcacatacacaacaaacagtacaaactcaaagttaaagcagagctattttacaaaaaatgcagcttatgtaagttatacattaaaaataagtaaagaagaagctgagaacgcaaatgaaagtttgcaaggaagttacacaaattccttgtatacacaagtaaaatgttctataagttttcttgtattccgatatatagatctatatattgattttttattcaaagggtttaaacatttggaatgaattcaacgacaaaatcattttcaaacagaaattccccaatagtgaaatttcacagattttactgttgtgttctttgatgttaatctgttagtattattattttcaatttctttgaaagaactttcttttcttatttgtttcttattatgaacatagataaacatgatgacaaatgttgcaataccaaatggaaaattcaagagaatcactttaactttattaaatcaatttaatattcttttggatacttcaataatattaaaaagaaatcaaatacgaaaaatgaaatatgaagaagaagaagaatatatagaagaaggaaacacgaatatattatcgatagggattggaatgtcacaaattgaagaagatccgtttgcgaaagattttaaagaaaatgaattcaattcacaaatataattatttattttaacgttattgataaatttatacatttattccaacaaattatataatatatcaactatattaatttattatttgcttgtgtaaatacaagtattggaaggcattaattatagaaataaaatatattacttaaaacatttttaactgaatgacccatttaatgataacatgagctcaaagctttgagctgattaatcagctgattaatggccgttacgacggtttattgtgcggtttttggtcggcctttctgaatgggtcacacagcaggtcttcgttggggaacacgctatgttttcgctcgcaagttcaggaaacatggaatgccagctccatcacaacaacttcgtactttcagaattggtgatattgttgatgttcatgtaaattcagccgttatgaagggtatgccacaccgtctttacaatggccgtacaggaacagtttggaacgtttcaccacatgcagttggtcttttgatttatcgtcgtgttaataatcacattgcaccaaagcgcatatatgttcgtaccgaacacatccaacactcaaaatgcagagatgatttcaagaaccgtgttatccaaacacaaaaacttaagaaagaagccaaagaaaagggcatcaaacttgataaatcagctctcaagcgcctccctgctcaaccaaaggaagctcatgttgttaagccagaagttataaaggctgtttgcttcacaccattccgtgaaacttggtaaaacatattttaaatatttcatattaatgaatcttctaatggtcgttaattattttgcaaaatgcgttcttaagacttattttgtcaataaaaatgaaatttattaagttctcattcaactttacttcatttattgcataagtgaaatttcacttcacatttctatagggcaggaattaagaaactcgagtttctttaaaaaaaatcattattcatctttataaataaataacataacatgcaatgacatgttatgatgcatgatgtttaaataacttgttcttcttgttaagtttttattgaaatgtttcgttttacacatttttgttcgtttcacatggcaaattttaaaaaagttggaatagaaagtgccaaaatctggatggatatcatcaattccatctgttgttcatttgcaggcggcatactcataaattactcaattcatattaccatagttcgaatgcttttctttgtcggattcattttttattttgaattcattttatattcaaatcattcaataaatgtaataattattgcctcatcacttataacagctttaatatctttgatcaagttatttatatggcttatgagctttatttcaaatcatacaattgaagttaatcaatctacaattagtaattcccttattaaaccaaacaatatttcagatgacatatgggctttacgaggtgctttattaaaacaaatggaaaaatcaactttggatagttttgttaatgattgtatcgcatctggtgttgatactgaagctcttttaaattttattgatgaacttaacaaaggaaaatatagagatcccgttggtagggctcctgtcagaacaaaatcttttaaagcaatatctgtatttggcaaaattattcctcttccattttctcccaaaactttcaacatctttccatctgagtttagtttaaagtctgctatttttgcttctatttttgcatttatttcctctgtccttgtcatattattatctgatgaattcctttcccgagaaaagtggtggattggcattatttgcggttttagcttttactctatattgcaatggccaagtactgatccttatacaacatctgtaccagattgttggaattcatctacacgatgttttactatctctttaatttgtgctctttggaaaggagcgcttaaaataagaacactaatacctacattagtaattcctttttcttattggacaattgattgcaaccttttgtcttcatatgtgtgcacgttatgtcgaatcggtttattatttatgccgttttggataattttcggttttctggggcatcccgtgaccgttattgtatcgtttgtggaatcgttcaatcgatatgtctttggtcagaatggtgtttctggaatttcgcatatgattgtgcagttccttagaggtgccgttactgttttattgtcgtattttgtattaacacattttaatacaagatttaatttggcaattgcaattgcaatagctacttttctttcgaatcttgcaggatttaaaattaaacgaccattgttgttgtcagtggtttcattcatttcatcaattttaacaatctctttatttcacaatgcgtggggctttaccaaatggattgaactcatttggtttgttacagttgaaattttaattccaattttatcatgttgccacaagtacttttttttacatattaatttcatcccaaaacttgaaattgagcctttactaagatcaatttcttcttttgttatagcatctatgtttattacatcttgtttatgtgattatcaaatcaatactatatgtcttgcatttataatcactcatgcgatacataaatcacaaagtgaatcacatgtttttgctttcgctgttattctttcggttattacatttccatatgaatttggactgaaaaacaatgtcaataatcttgcactttcacttttgattgtagccaaattggaaacatttttgccaatgttagatctaacgtatcactcacgtgatccaacggatcttgatgatgaaatggatggggtttctgcattaattttaaatatattatattcattaattcaatcatttcatttcattgacttcttatttaaaatgccaacattgatttggtcatttttcaccggatcttcaggcttagctttctctggtgtaagttatcttctctgtccttcgtcaccaaggccattttactttttcaattggcctgttgaaaggaaagatttgagaactttactcaccaggggtgcctcggagcaccccattgagactcctgtttatttatcggtgtgtagtacccttcggaaaaattttgcgacgatgtgtaaacgaggggaattagggcttgttaatgctggtgatatttttctctttaagtcaaatgagttatcagcatttgttcatgtcatagcaattgaaccaaattgctataaaatccaatttcgaggcctagaatataacagtcaaacatcttgtcatagaggtgaagcacgtcgacttaatgaacttattaatagttatttattatttcctaatttccaagctgccaaagtcgccacacattttgttgttgatattcgtgcgatggatatcccattaccaatgtatgatatcaccaagacaaatctttcacgcggtgcattagttggcgcatcgcaaaaaactctgaaactttcgtttttatattccttatgttacatgatcactaagcacaaagagaacattagccgcgaagttatcaataatgaaatcactgatcaaatctttcttcaacatatgaataacttaattacattttcgaattcatatatcaacaaaatctttcaatatttttcatttccttatgtcgaagaagaacttgaactatataaagttttatggggaattatctccacgcatttattcaatgtaaatggctctttaaactattcgaacttaacaagctcatttaagaacgaattacatttaaatttacgcgatgagttttcatgggttaacaattcaacgaaagtattaaaacttattaaaaagataattcgatttggagtcggattaagttatatggcatcgtcgggaatgtttgactctgacagtgacaacaaagaaatctgcgaatacattaaagaattcgatgacgattatgttgtaacaacaatggactcgaagttgttctataatactttcatcgaatgtaaaaagaaaattattacaatcgaaaagattaaagacatatattacattatgaggttttcgttttgcgtcaaaaaatggaatgtatatcaaatgaaacacgagtggataagagcaatttggaataatgaaacaaccggtttgctgttctataaaattcgtgcaagtgaaagaatgtcgatacaacataattcgcgtttctttaataacacaatagtgcagtcgtgcgatttcccagtggggtaccccgcatatgttagtgaaataatggattcgttcacataaacatattgtaaataataaaaattataataatttcgaatcgtttactaatacgacaatttttagatgagaattaaataattaaaatttatcgaaaaataatgtttaatggattgaaaatagaccgtgaaaagacatttcccatcctcaatattactaaaaagaataaattatgttaaaaaaaaaaaaaaaaaaaactgcaattttgaatacaaaaataaaattaaaatgaaaaatgagctaaattgcttttacttagtaaattttggttcggtttgaaggaactctgcatcgtgaccagttttaagcggttcttttgattccttagtttgtatacatattatgaccaaaggttcagttcctgtattcttgtagcaacggctagctccagtaccaacacgaataacagatccttcttcaattgggaagacattatcgtcaacttgatattcaccttttcctttgatgactatatagacttcttcattttccttatgagaatggaagaatgaaagttgaactccagcaggaattgatgtatatgaaatttcagatcctgttaaatgaagggcttgttgcaagaaaacttttcctggaattggttgtccaaagccagtgaaaacatatttttcgatttcagatgctggaccaagattaacagcagtgtagttgcttccttcagatattgttttgatagacattacaaataaaatgaagtgataactcttccatcttgaatcagaaaatgtgatatgttttttcaaaagtttacgattggttgggcaatcgttttgaattaaaatttctatgcaagaagaaacgttgttttcctttgcttatgattctgttatcaataaataaatttatgtgggaagttgaaattatattttacaaataaataagaaggaaaaacacttgtatttaatgaatttaaaattattcattttcaatgtaatgctttaaaaatttttggttatgcaataaaaaattattagtgttgaagatataaaagaaaaaagatatttttcgtttaaacgtggtataacctggacttcctgcggccacgagccatttcgaacttacggccatgtgcacgaacctttggacgtgttttgctgttatcatcacctggtgcagcaccgaagtggcggcaagcttcacggcgcttacggtcaccttcgaggagaagacatttttcaccagtagggcgaagttgtgcaagttgatcgaatgtgataacttcaccaccagcagcgaggatacgagcgcgagctgtttctgagaatctgagagcagcgaccttcatttttggaacagtcaaaagacgttcatcattaacaattttagaaacaacaactgcgattgtgtcgtcttccttaccttgaagagcaacagcaagacgtgaaagtgagtatggacgacggttagtgttagaaaggcacatgcgatgggcaatcttcttgttgaaatcatttcctgtgcgttgggcaagataactataaagtctaaataacatgttcaattgaacattttttgactttggagtcttccttgatttgcgggaaacacggtgatctatatcaacacccattcggaaaaggatcggccaaagcggtttgtatcgatcagcgtaaaactttggagtgccccatattaacggttaccatattattaaccatgtttagtttaaagaaaaagaaagtgttttaagcaagaaacttgaaacacccttgctttttgtgttttaaagaatcttttaaaaaatagaaaaaaaattgattgatttttggaaaaagagaaaatcacttattgtttattccttgtacttcacttaatggccgaatttgaatgttatgctccttttgaaatgcgaggagctcttcttcctttgctttaatttttgcattgaaagtttggatgagctcttttaatgaggctctttgttgttcaagagctggcttggcttctccgattgtcatttgaaccaatacttcaccaacaagtctgtaacatttacgatcatcaggaagtttggcaattgattcaagaactctttcatgctgttgtaaatctaattcgaactgtatgtttttgctttgaagatcttttaattctgcgcgtagtttgttgaattgttcgctgatagacatttttggccacacataacttccaaacagagattgtgaaaatgaaactgtgttgaattattaattattaatgaaaaaataatcacatgttccatcaaaaaacaagaatcaaggatacgaggaacttagtcatcaaggcttgttgttaaaagcgttagttatgtttttggcattaaatcgatattcagtatcaattttctcatcaaattttaaaaacttaatacttgaaaagagcttttatcaccatgtttcaggatcatgaaaacgtgatgtttttattgatatcataatttttaattatatgttttttttctcattgtcaaatattttaaaaggtatgcctgtcctttatttttcctttaatattatttgttctttcaaataatatgaggacattaggaaaacatatcgaaagagagcaaattgtgaaaaatgatttttgtcatatcacataaattatattaaaaagtgaagtcagtaaaataaactgattgtaaaaaattgaagtatttttgatcggttttaatagaattacgttcaaaaagtgataccgatactaccgatttttttccaccagtttaaacgacagaaaacaaatttgtttgtttttaaaaaaaaatgcgaggaagggattctttgggtgtaaacgcgtgttcattcggaatgaaatgtgtaaaaaaggataagggtcaaaagtcttacgacactcaaagcaatttgcaaatgcaagagatttaacattgattcgactttttgactagaaacgtttctaggaagaaaattttttgagaacaaaattgttaaaatattcaattttgaaagatttagcgtaggttctcaattttttttgccaaagtaagaaagcttttaaaaaggcgttccgaggaattgaaatttgaccgattcacatctttctcaaatcgatttgacagtaagtttggtgaagaattctcgttcatataaactcattgaaatcctaacttctttaacatgttaagcgagcaatcactcgttgaacaaaaggcagaagcaatggataagaagtttgaaaggcttacgaaaaatattaaaaagcttacaaatgaaattaattcattacaacatattcataatcaatctgttatccattttttacaacttaaaaaagaaaatgaagctatcaggtatttgttcaagatggcaaaaacaatttattctaaattaacatctgatgaacaagaacaacaaccaattccaaaggtgacatttatcccagcacaaccccttccacctgaagtattttctattacaacaattccttatgaagttactccagaaaataccaaaattcatcttaaatatgctatcaagacaaattcagtcatatgctcggttgcctttgatggaagtgggaaatttattgctttcagtaactgcaagtccgtttttattgtcaatactgaacaagggacaattcatacatatttcaatatttttaccaatacttttaccaaagaagattatccgcgttctattcgtattagtcctgattccaattacttagctgttgccgatccccaaaacaacatcataattttttcaattctattaaacaaggttattgccagtctttcatgtcatgagaaccggatatcttcacttcttttttccaatgactcccgacgactttattctgggggttttgatgggaaagtttgtatctgggatttagttaccatgaaactcatcaaaacagtcatcaacgatcaagttggtacacctgggcaagcgaatccaaacatggttttagcattagccaaagatgccgatgatcaatttattgcagttggattcataaacggtagcgttgggatttccgacatggacttttcacagccactgacatgtttccgtgctcacgaagaatccaagtatcttcttgatgttgccatttctccatttgatggtattttagcaacatcatcgaaagataactccaccaaaatatggtcaattattggcgtggcgaaatgtaaacacgttttacatgagcacgaagatatggtattatctgtctgcttctctccgctgtcatcgatctgcttcacagggagtaaagatgagacatttaaaggttgggactataaaaagggcgaattgttgttctcgatgcgggcacataaaaacactatattcgagttggtacatcacccaacaaagaaaataatagcaacatgttcaggagatgcgcatgtttgcttgtgggaatatgatataccttaagcttatgtattgttgatttttattgtatgagaaaggatcttatggaaagaataaaacttaaacatttaaatattatttcatattaaataaatggaaagcaaaatgtagacacgtgtcggaaaaagcatatacatattttttattttaatattattatttatattctttaagacatttttttacattttcctcaaaatttttttattttaatgttataatagacattcttcaaaacatttttttacattttcctcaaaatttttttaattttaatattattatttatattctttaagacatttttttttacattttcctcaaaatttttttattttaatattataatagacattcttcaaaacatttttttacatattcctcaaaaattttttttattttaatattattatttatattcttcaaaacatttttttgacattttcctcaaaaattttttcaataaaaggtatttatattttgataatcgaatcgaacattaaacaaaagcatacaaaacttttaacgacaattcgtttcccaaggccattctcaaaaccattcggccgaaatttccattttataaaagaatttgtttcgagaataaaaataaaaaagtaacttttatttcaaatattttttttcgattttttctcttcgcacaattggtattgagttattacacctttcgaccatcaattcgggagtaatttgatatttctctacaacatttccataaccttccaatacattatctacaaattttccgatcaatttcggaagcgttggctttttctccggaataaattggtgaaaaacgaacaccaaaaactcatctttgtttgggaattgattatacttcagcacgtattgtatatatagaaaatggatatgaatttgctggtcgattggtccgaatattttttctgattgttccaaccacgttgtcgatttttgaggcaaattataatacggccgacaagtttttggacatatattcacaacagggatacgaaaatcatttaatccatatccccaatttatgccattaattttgttcttgaattcattcatgttaatttgattaatatctccaatttcaacaagtttcgcagcaactcttctttcatcaattgtaagctccgagaaaaatgaaggtaacaatgataacgctttcttaacttgttgttcatcaggatcatttccatcaattggaatatacttcggaacgtatttatatttcttatgatcaactttagaagtatcaatttcgatacatttatgtgcaagtaaaattattggcattaatttatcgaagtcatttttacgaattgcttctttaatatgtaaatatgtacgagctatttttaagaagtctttagcttcttgtggaatcggataaccaagttcagatataatactttgaagaattggaattgaagttacatttgattttatatgattcattgcttctttttcattaacaccaattacatttgaacataatgaacaccaacatgcaataccaattgggatatgagtaatgcaataataaggaacattagttaagaaaaatgtacctttatgatatctaaatcgaaatcgtaattgttcagtaagttgtggaataatttcttgaagatattcgatctttcgatctttgattaaataccagattaatgcataccataaatcaaagtaaccaactgatttaccagcaaataataaattggctaaagttttatcagtgtatttaatatgggtttcattttgtactaatgataaacaaccaattaattcacgacgtgttatgggtgatttttcaattggataacctgtttcttctgcttctttataagctcttaatgagatgggatgatcaagacaattgattatcttttcacaaatatgtggatatcgaattgcatttaatgggttgttaattattgtgttaattatgttcgaatcttctccttctaatattggtttatctggtttagaaattaataacacaatatcactttcatcctcatataaaattggacatgttattgtctcttgacttaattcaagtatttctaattcattcgtttgaatgttctcaataacatctgcacgacgaactcgatcagcattaaatttggaaccaagtgctgataatgaaaaaacagaatttaaattgccactggacattcgaattaaatgaaatagttttggtggccatgttatgttatcatatttttgatgatatgtcgcatttaattcttttgtaagtcgtatcatctctggtaaatttccttcccaaaaacttttctccattttatcaatatcgaagccttcgggaacttgtttcatttccataagtaagcgcttttgaagacgagtaatttcatctttaattgataaatctgatttacctaaagctgaagtaatagtcaacgaaaataattcttcaaacgatttttcaaattcttcaattgtcttaatcgatctgatttgttcaataaattcttgtgatgttttccctcctgaaataatatgtgaagactccgtttctccttttggatataagtaaacatcatatagattgcctcgaagaaatggagctataacagtcgcatccattttgtctgaacatgtttgaatgagataacaatcaacatgattaacatgaaagtcatgttctttgatataattgtcgagatctcgaactgaactttcaggaatttgtccatctgttattaaaattaaatctccagtaaactctttctcaacacaatattttgcaaccaatattggctctgtacagcccgatcctctcctctctttgttagtcttagctaattcttcttttgatgcgacttttaaaacatgactccagtaaataacatcataatttggatactttttgagtagcgattgtactgtatcatggtaaaaagtacaaccgcatgttgatccagagtagtcatatgcgaccaaaggcaaagacattttaaaatgaagtgaatggtgaagtgtacactttttcacatgtaaaaccgtatgaacaaataacaaccgaaattttaattcaaattttgtcatttcatgtgtgaaattgaatggtatttcagccaatacaacattataaaagtaaaataactttttcaacaaaaattgactcaatatattttcttatgacaccttgataatatttaagtataaacaatgaatatatacttaattttcgttgttaattatttgtttcatcattttttatcatttgttttttcattataatattatttcgaaaatcatacaatatttatttttatacatatcccaaaaaattaatgttaaaattaaaatttaatttaattatcatgaataaaaatatctaatttcccatgaattcattgcttccgaaacatttaatatttccataaaatattttatttactattttctttaattatttattttattactcctaaaaaacatttaatttcattgattcatttcttatttcatttccacaaaatattttatttactttatttattaattatttattttattactcctaaaaaacatttaattttattgattaatttcttccgaaacatttaatatttccacaaaatattttatttactattttctttaattatttattttattactcctaaaaatcaacaaaaattttcttaaaatacgaattcccagatctacagtacgggcacgttgtatttgacgtgaaccacgtgctcaagcattcgtggcagaaacccatgtgcccgcatggcatcacaatggagtccgcctttttctcggagcatatcagacaagactcgtcttcgctcaccgggtaaccctctgttatgttctccacgttaaatctgcatagcgggcacattcctttactttcgagcagttcctttgcgcattttccgcagtatactctatgtccacaagattggaagaagtaatttctcgggttaactttacacttcaaacattttgttgtgtcataatcattcaccagttcttcatatttcataccttcttcgactttatctttatcattagtaacgtcatcacatttaacacaatcgatgacattattcttaaagaaatataacgagttgttctcacatgaaaattgtttgggacaatcaatgatattattatcgaaaaagtttccgccgcctttccatttcatttggacaaaggcttccttcaaatgttcaacttgattattatgaccattaattattccgcctgcatatgctaaaaatgcactttgtccacaattacagaatttgttcttctcgaattcgcatttcgaattattaaatgattccgcacctgcaactttacaattggagatcaaattagagataataacacaatcattggtgtcagaaatggatatcccacattcgttgatgtccgataatatgttatctttcattgtgacactttgagcattacgaatacaaacaccacttcgcttaatgttcgtgatcgtgttttgttcaatgcggccttcactattattaagtattgcaactgatggaaagtcaacgttgttaaaggtgttggaaatgatcgtcgcttcagatgcttccgaaacatatatggaattgccggcaatgtcgtgaatgttgttgttaaagatttcgacattcgattgattggttaatgagatggatgaggacttaatggaatgaatatggttataagcaacaatagttttgtcagcatgtaatatactgattccattttgttcaacatcgtagatgtgtgattgaacaatgacagctcgagaatcaatgacaaagatggcgggataggtaatgccatgaaaggtacagttggaaacacggagaacagatcgaagaactacatgcattccattctcatgtgaattgtaaaatgtacaatcttcaaaaactgcataagaacaactaatgttaacaagtgtctcttcaagatcatgaacaatgagattacggaaattaactttggagttaaattcgataaaaattccgatggttttggtatctgtaacttcagtattgttgactttgacatcacgagaatatgttataacaaaagcagcacctgaatcactaccaccatttgtgatacgaacattgtctaactcaacattatttgcaaatcgtaatactaaagaaccttcgatttcgatgttgttaaatgtgacatcagcacttgtaacaagaattcgtgagcatttgatcttcgatcgaattttagaagtaatttttagcgctttttgaatagtaatttgcttcccagaaaaatcatataatggttcaactaactcgatctcatcaatcccagggaaaacacttgataattcaatgcttgtctgtgttaagttttgttgtgttttcattcaagggattttgttgccgaacaaaaaagtgtcataaatcacaaaattttggatatgaccaacttacaaaaaagacttcattatgtgaaacaaattttatatttgcttaggtagtatgaaaactaagacatagttcaatttattttaattaataattaatataaatttaaaaaaatcgatttttcttcatttgatgcgttggaataaagtattgaaaagtgatcaacgactcattgaaaaaagtgtaaaccttttaaaaaacaaaaaaaacgaaaatttgtggttcatgaacatggggatgatttggttttttaagaaaaacaaagcgtagtaactttaaacacaatttaggctgtatgcgatatttataaatatatgatatgtgaaaatatattttaaatcttctttgcattgattgcagttttataacaattttcttcaaactcgtcttgtgatataaacttccttatgtgcgttgctgttccaataagtcctgtttcatcaaaggcttcaatttcaaattcaacaagatctttacttgtttttttgactcttgcaacagcagtgacttttgcgcctaaagcggaaggccttttatgtgataaatctgttttataactaattgtagttcgttcatcaaatacttcctcaagagctttacatgctgcttgttccattagtcctagaagaacagatgtcgataagacatttacactccctgttttcattactgttgcaaggttatcatgtgtaacttttagaaatgcttttccgactgaagtttgcatttacagtaatagggcgccccaaaacaattgtacaataaaagtacttttggcgatttttcaaatactaaaaaattgatattaaaagaaaattcccaaaataccattgcattgatctctcgcttgtgataagtgaataaaggaaaagatatatataaaatttttaaacaaaaaattaattcataaatgaattcttattaagtaaaatttttactatcgaagataatttgatgtttttctaaaaaagatgtttcctttagttttttaagtaataattatcgccaaaagcttgatttataagataaaaaaaaggaaatccgatagaaaatttaagggttaaaatatcgtttttacctgaaaaactgtctatttagcattgaaatttccattcaaagtggtttcaattcaaaaaactattgaaagttttgcctgtccagcaatgccccatgatgatgtaatgtgatatgaaatggcacataaacccccacccttttattcaaaaagtaaacacttttcacatgtcaggaaacaaaactcctgttgtcctagatcttggaacaggtttccttaaagtcggtatgagcacgtcacagatccccgactttgttctcccaaacactgtcggtcgtccaatccttcgttcagatgaatcattttctcgtgctaagcttaaggaccaaatgatatgtgatgaaatcaatgatgtacgtcagtaccttgatctctcactcccagtggaacatggtgttgttaagaactgggatgatgaacaattagttcttgaatacatctggaagaacaaacttaagattaactgctctgaacatccagtccttgttactgaagcaccacttaatccactcgagaacagaaagaagatgatggaaattttcttcgaaaaatatgatttcccagcaatccaaatttcaccacaagctatccttgttctttacgcccaaggtttagttactggagttgttgttgactcaggtgatggtgttacacatattatgccaatttgtgagaactatcttcttccacatcttgttggtcgtatggatattgcaggtcgtgacatcactgaacatatggttaagcttcttacacttcgtggatatacattccataagacgtcagatttcgatgttgttcgtgaaatcaaagaaaagatgtgtttcatctcagcagatatcgaaatggatcgtcgtattgctaaggaaacaacaacatatgttgttccatacacattaccagatggacgtgtcatcaaagtttccggtgagcgttttgaagcaccagaagttctcttccagccataccaacttggtcttgaaaccccaggactttctgatctcattttcgaaactatcatgaaagctgatatcaacctccgcaaacaattcttccagtccattgttgtctctggtggtaccacaatgttccctggcctttctacacgtattgagaatgatcttaagaatttagtattaaagaatgtcctcaagaatgacagaaaacaactcaagagctacaagataaaggtagaagatccaccaaatcgccgttatttggtatatctcggtgcaactgtacttgctaatttgactgctgacaaatcaaattcatggatcagcaaagatgatttcaaacaaattggagctgacagagcagcaaagtattggcaaagcacggcctaaactaaacggtgtcaaatcattggctcaaatttgattttgtattttctttgtgtttgaaagaaattttcattttcgtttcatctttaatttaaaaacatgtgacaataatacaaaatgtttatttaaagaaagtgaaatttttaccaacgataggaacgaatcaaagaaaaatcatcggattcacattcaaactcaaaaccgtttcatcatttaccttctagaaagcaaaattatttcgaaatttcatgttgtttattgttagataaatctatacgtcatcttcctgttgtttctaaatttgcaaatttggtttagtggatctgtttacatatggaatccgttaaaacgatttgtaaatcattcaaaacatttcatttcgaattcttcactttttattaatccctttaggtcaattagtaagagcccaagtctttttcgcaacctgtttggtctgcttttggatgatatccgctgccgcacttaacgcaaactgttgaatgtttatctgatacagttcctggcgaacatttgtagcagaaattgattgaagaagcgccgttggctatgccatatgttcctgctgggcatgacttgcatttccacgctccaacctcatcattatatccgccagcagaacatggaatacaagcgcttgatcctccaaattggttgctacctactgtgcctagagggcacttcttgcatgttagcgaagatgtggcacctgtaatgttggaataagttcctgctgggcataacttgcacttccacgctccgatctcgtcattatatttgccagcagaacatggaatacaagcgcttgatcctccaaattggttgctacctactgtgcctagagggcacttcttgcatgttagcgaagatgtggcacctgtaatgttggaataagttcctgctgggcataacttgcatttccatgctccgatctcgtcattatatttgccagcagaacatggaatacaaacgcttgatcctccaaattggttgctacttactgtacctagagggcatttttttcacactaatgaagatgtggcacctgtaatgttggaataagttcctggtggacacttttgacatagcctcgatccttctttgtcgttatattggcctggaggacatttcatacatttcgttgatccatatccatcactaattgtaccttttggacacttaaaacaatttcctggatagcctgatggacagtatgtcccagggccacaacctggacagcttgagattgctaatccaacaaacccaagaaaagcacccattctgaaaattaaacaagaggatcggcattcattcaaaacctgtcagattgacaaaatcacggtccaccgttaattcaaatgcaaaagtgtcgttgatgtagggcaccccaataatcacttttgatagtctcattgaaaaaattgtaaataaaatttgttctcaattttgaaagggctttcaaaatagtttcatttttcatgttggtgatgcaaccaattcatcctattttaaatgttcattaagctaaatactaatgttaattgacactggcttgccagcgtttgtttgtgtatcaataattcttttggatacatcgcagcaaaaatatcaaaagaagtaaatttactgggacagaaggaaagttgaagccgagcttcaagtacaattagaaattcaacatccataaataatgccttttttgaaaattttgaatgtgaaagttatagagttctagaaccatgtgttgaacttcaaaaaatgtctgaactttcaattcgcatcatttatattaccattatttattatattataccaatggggataatgggatcatatccgttgccctttcaacattacattgcagaaacatccttcttatacatatagatgacataatacgcaaaaagccaaaaccacaaattagttgataatgatccaacttcattttctttggatttattaattatggtcacataacattcattctttgagttagttcttggaatcaatgtaaaaactgtttcaattttacccaaagttttgtaaatgatagtatattttcaatgcactttgttctagaccatgggtgtttttgaaatgtataaagaatggaaaccttttacatatgtttcccactttttgcatgtttatcctctgggtaaaaatttaataatttctcaaaataatttattttaattgttttgtatgagaaataattaattttcgtaatgttactacttcaaaaatgtaaaaaaaaaaaatatttaataagaaatcagaataatgtaatacatttgattatgttataatattaatatcaagttaaatttatatgttaatacatcattaatttattagttaacttattaaagttaattaaggtaataaattaacttaaaaataatactaatgaaagcaataatttatctaattcgaatttgtcaatcaatgataagcaaatcctttataaaatgttttattcataaaatatttaacaaaactatttttcgccattaaacttattttttacactccgacattacatgcgaagttccatttctttcctatatcttcgcatctgataagtgaagtcccttttggtcctcttacttcaattgttccatcgatgttcatcttttcgattctatattttgtctcgttaattttctccattgatattttaaccaccaattctccaatgatatcagatggaagtttagattctttttcaacttgattcgagttcagcgcaatgatatcattcccaactttaacaaaaaacgttttcaaaaatatatgtagaactgttcccttttggccattatattgctcatctgaatttagcactaaaacaatttcgccgatgttaactcttctgccatttgagtcaacagcattagtatcgtcgagcacaagtgattggacattctcaataggaatccgtaagccggctgtggttaatatgtatttttgcgtaacaacaccgtaacttccgccttgcgtatggacaagatcgccaacacgcggctcatatatgaagtcgttcgaaaagacttggatgacggacttgccgctttgtttgtgctttgtatgcttctttgcgttgttatcgccttcattcgccttcttttcggcacgatgcgatgcgctgttattgttattattattgttattagagttgtttgtcttttcagtgcgatttttcctgttatttccctcattggaattcaacttcttttcagtatgatgcgctgtgctgttggaatttgctttagtttctgtgcgatgagttgtaccgttgttgttattattattggaatttgctttagcttcgatatgatccgttgtgttattatttgcttcattttgaatcgtttttgaattattattaatttctttgttattgatattatttcctatgctatttctcgtataattattattttctgtgttggaattcatttgcatttcattgttaatttccttttcttccaaatgttgtcttaaatcattattttctccattttcaaaaacatgttttgtgttataggaaatgtttttcaattcaatgcagtacttcgagtaatcattaaattgttctattttttgttcaaacccgaagacgttgttctggaatatatttatttctttttgggtaaatttaagatttgtatttaaaagttctgagtacggcaaaaacttaatttggaatttcccgtaaaagcgtttgccgtcccattccttaacaggcaaataaacacctttttcgagttcgattagttcattcgtaatttgtgccccaatttcattgagtttggattcatcaaaaaaagtcaacggcgcacgataattcggcggtaatttgagatataattgtgattgagatttgagatgtaaattattaagtctgtcataatctatgttaggttgaaatttgactaaggctttgttgtcggcgggaaaacaatggacaatttgagctggtttgccgttattttcggcatcgatcattctgactaaacaccctggcttaagtgaaatagtaccattatacatattaggaaagtctctgtttggatccacaggtataattgtatattgaacttctgaaaatgaaatacaagatttaattattgattcatcatcacattcaatgaaaatacaatcggtataaaatggaatataataaaccgaagtgatttgctgacattcacgaaaatgggaaataattgatacaagaaagtcattaggattattaggtaaatggccaagctgcaatttatatgtattgggggctctattggccagtgataaattttgctcttggtgttttggaatattattattgccaaccgttaaaatattttttttctgcattggaaatctgttttgattgtttgaagttccaggtctcaatctatgtgagtttgtgggaaatagacccctagcagggatcattttaatggtgtgttgtgtttagatgtaaactatttaaatcaaaaatctaaacgtatttttggaaagacgaaaataaaaatatctttttacaaaatcattttttacaaaagaaaagaaaagacatgatacacaattaaaataattgttttgtttttgattcatttatcaggtaagtttaaaattctttggggattttaataaactctctaacttccaagttaagttcccttaataaacggtaaatccctcagaaaataattttttcaaatgaaccatgtggttgaaaacagaaatcaacacatatctgctaaatgtaattcatatctgggtttaaatgtattcacttgggctcatacatttttgaaaattaaaagaacttttaaaaaaaaaaataaatgcatttttcattaaaaattgaattatataaaaatattttattaataaatatctgttgttattttttatcattttattttgtttaacatattaaaatattcatttcaagcataaacgtgaatcgattcagaaaaaacaaaagaaagttaaatttggaaataacccaattccagagactataccatgcaaaaaatttgaaagattttccatatccgatgcataacagggtaccccttctagaggaagccgtttaaatcaattatgagcgatttggactcatccaatcttttgctggctttctgcgatgaaacaactctaagtgagctcgaggaaactattgataagattgaggatgttgaccaaaaaatcgaaaaattgaaatcatctatctctgaattaagtaaactttcagcatcattcgaagaacaaaaaaacaacttagctaaaataacggaattgctgattccacctgaacttaaacaaaaaacagaagatgttattgacaaaaaacttgaaagttattatgaaaaaatcaaagatgcatatacaaaacatatggaagatgcttctgagcttgaaaaaaagactttggcaaaactagattatgcatataaaacagaacttcaaattattgaaaatattaagaataatctctaagaccgttttgatgtttgcaatgccctttaaaattgatcacgacttttcaactaagttttaagaagacattcagaaaattgctaatgcaaatccagtactactgagaagtccaaagttttataacaatgtaaaataatgtcgaatatcgttttcttatagtttgaaataaaaatagagtaaaatgattatatttttttgatatcaatcaaaattgctttaaacacaagtgattggttacgcacaacataaggactttataagattaaaatataaagaaacaaaaacagtctttaagataatttaattattcttttttatataaacaataatatcttttactcatgggaaaattgtttacacagagtttataatcgctgcaactgtcggatcgctcattccagttggagatgttttcacatgttcataaagtctttcaacgctttcaattaatttgttatgccactcttcttcatgtgagtttggcttctttttaaattgctcatcaatccatgttcttaaatcgtttgcaatatatgcaaacattgaattttcaccattaaatttaatcgcattgtcgcaaattagatggatatctgcaacaaattcttctactgttttatatttgttatcatgaattttgttttttatggtattaagatccattggattcttaacaatttcgaaataattttcggcaccgtcacgaacagggtcaacgggcatcttaaaaggatttgatattggttttttgagaagttcctgatggattctagtgcaccaatctttgtcgtagtctgaaagcatttaaagttcgaacggatttgaactttttaatacaaaaccgttacaattgtgttatgtaaacggggtgcccctgccattgtttgagccaactaaatgacaagagggcttccagaacttaaaaaaattcctaaaggcgatattgatgcaatgcttaaatgcgtccaagaaatgcaacggaagccctcggatgccgctttgactgcaaacaaattaaaacaaatttcaaaacaatcaaaacaacgtcaacaaattgcaaaacaatcaaaatcatatatgggcgaactcaaaaagctaattaaagctgttgaaaatactcaagatactgtgacttcatcgattattgatcttgctggagttttacaagaacttccaactcttctaaagcttgacgcagatttaaaatcaaagcgtgatgatgactatgatacatgtagtgcatttaaagaaaggttaactctcttgtccaaacaaaagcgaactaaacaaacaaaagaaatgtttgatacgttgacatctcaatttaatgctcaccttgattctctatctcttcctgaatcatatgatgaaattgttgaaattgtcaattcaactaaaatccattcccaacctaaaacaatcagctttgatctcagtgatctaactcctgagtggcaggaaacaatatctaaccaaatttccgaatatataaatcttgaaaaagaacttaaacagtcttttgatgagtggcaaatttgtaatggctatgaccctgataaaaagtatggtggttgggatggtcttgaacatcaacgttttcttctttgtggaaataatgcaaatctcgaatttccagacaaaactgaagaagaaattattaaacataaaacatggacaataaagcatcagtttctctctaagaaacgtgaagcacttcgcactgaacttcggaaacgagtttcagagcttcgcgaggaagccgttaaagacgataaactcaaaagtgaaaaagtgctcaacgatcaacttgccgaggaacggcggttagctcttgctgaagaaaaagaaaaactaaatgcccaattagctataagtcgtcacgaaaagcaagaacgagaccgtatcaaagcagaacaaaaggcacaagaggaaaatttgagaaaacaaaaagaactcaaagccaaaattaagcgtactaaagaaattaatgaacttaaagaacatgttttaagtgagaaacaaaagagacaagcacaagagcttctcattcagcagagaaggcgtgctgcggagaatgaagccaaagctgatcaacgcattcgactaaaggaaatcaagaaacgtgtctccgaacgcggagaaatcaataacgaaaagattaggaagaagaaagaagaagagcaaatgaagatcgaacgtgaaatcgataggaagaagagattagatgagctagcaaagagcgtacgcgatgagtttgggcttgacgaacttgaagctgatccaacgcggctaacaaagattaatgaaataagaagaaaggcattgcatgaaaaagaagcaaggccaatgtttgttggaacttcatttgcaagcagcgttatcgaggcggacccaagaataagggtagagaacgcgttaagagaggccggactaatgaattctgcttatgcacaagaggtgatacagaaaatggctttgctcagaccaagcgtaaatatgccgtcacaaatcagtttcggctgaacagtttgaaatcttttggttataaaattattaaaattgtttggaagatatttctttatataatacaataatttcgtaatataacaatgaattacatttggtaatcaaaacttttcttcaaaattctttataaagaattcaatcattgtaattgttcatcatcaaaataaataaaaaagtgacttaatttcaagtgctggccgtttataaatgaactgaccaaatactcgggggttttaatgggaaatgatttcttatgcgctccaaaaaagccctaaagaaaacaattcatttcaacatagatcaaaacattttacaaaccccctttatatggggtttaaaaatagagtactaactcaactggaaacaagtccaaaatcatatgacgatttatctcttgatttgaaacttaaaaaaaatctttctttccttttaagtagtaatgaagaattaatcaacaatgctttatttgagttaatttcattatctgaaataaatgttaatccaatccttcaaaatgacgttttaacacctaatcacataaaacgtcttgtaaaaacattaaccagcgaagtgacgtgtacaaactctcttaattttatatttattttaatatctaatgattctgaatttgatgaaaaatttcttgaacttcaaattcatgaaggcctaaaaagcataatgactagcagtcaagatgctgagcaattatgctttgctcttcaaatctgttcaattttttgttcacgtgatatccaatttcgcgacttattatttaaagatcctgatttattttctcaaattttattttttctttccgatggcactgaggatatgcaacttttcacatctactctcatattaaaatctcttcaaaaaggtcaatgtcatccacaattttcacgaaatagtttaagtttcatttcgcttatgttaaaaaatccgaacgttgacattgtgaattgcggattttcatcattatcatatgcttctgtcgaaactgaagatgtattatcaatgcttaatgatggcgaaataattctttacttaacaaatcttgttggcgaaagccaatgttttgatactgaaattaacatcataaattacttctccaaattttgtacatttggcgatcaaatcatattttatttcattgaatacaaatcgctacaaaagattaaaatctattttgatttgaataatttgcaatatataactaatttttgtgatttaattataaacttcatagtaaatacaagtgcttatgttaatgaattgtttgaactgatcgtggatttcccttttaatgaaataattgaaaatatgaactttaaattaaaagagcgaattttgcatttgctaagaatttgtttcacaagatttacaacattacaagtggaacaaatattaaatatcgacttgtttaaaacaattctttcattgattgattcgggaaatgaaaatattttgatatatgattcatgtttttgtgtgttggatgtgttgtcgaaggatatatcatttagaaatgaaatgattgagctgttgaaacaaaatgatgtaattcaacaattggaaataatttcgaatacaaatgaagatgaaagtgctcaatatgcgtcgaggattctttcgttaatttctgaaaatgaaaatttaaatcagtattaatgttgtatttaaataaaaaagttttaaagattcattataaattgaccaaaattagcttcacattaaaatttatttaatataaattttaggaaaatgtatcacctatatccttcactaatggttattcattttataaatttggataataaatagaaaaataatcatcagcgagatctgtaattggaatttcaataaaaatgatcatttttcgttcgctaagaaatttgaattaaagtaacgatttgccaaattgaaagttcaatgaaccagtaaaaaaattgtatttcgatcaaaaaaacgatattattttggtgtttggccagatattgattcaattccaaagttggctgttaacaaattctgcctaacttagacaaatagtgatcgttttttgaacaaaaaacgaaagaaacaaaatttcgatctataaacatcaatttaaaatataaatatttttcaaaaatcatcaaaaatcattttctcagtaaatgaacatatttaaaacatataatttttgtgggaatagcgaaaattacgatcttttttgatcgaatgattgacttcaaaagtgtaaacagtgacgatcaaaaatttgacgcttttcaaaatcaatggaagatcctcaatcggaggatcctcaagcagaacaaaaaacaattgacgctgtaagttttgctgattctctatcttcttttgggtgctctatgcgagatcgttttattaaaattttttcttctgcatggaataaattttcaccaaaccaagaaaacgataataatcaaatgaattttaccgctcgtatatcagattttattgataagaaaataagattaagagaacgtctaacctctcttgttgattatgttgttccagattttaaaccagatgatattattttcgattcagacatggaaatagactctgctttcggaagccaaagaggaggtactaagtttcttgatctttatacagctcaagatattaccggttttattcaaaactcaaaacttggcgaattacttagtcaaggcccctttaaagattggtacattgagcttgatctctcagattgttttgttcattatgcttatatgaggttaaaatcccttccagagaaagaaaaattcataggttttcttatagcacaaaaaggaccacttcgccttaagtctgcaggccaaaacgagactccaggtcaaaaaattgtacattcaaaattaccagaagatcttaatatgttaaatatccgatggtttgcacttcaaaacccatttgccaagttctccgccaagaggccacgcctgccaggccagaattacccaggaacaggacttgcacgtgaagcatacaaccttttggtaactttatcgaaaagtgctaagcgtgatggaattttaaacgtaccagaacatttccataatgcatttctctatgaaaatttcttgtttttagatcctgacgatcaaggaatgtttgaaaagatgtccgaggaccttaataaggacataaatgaaagaggtcttgcagcagtaagttgggctatttactttggttttcttagatgtgatgaagaggttgctaaatggggtcagtatgaacaagtattaccattatcagcaaaattagaaagatatttccaatcaacagattataagaatgaagtattagctgcaaaacaaagaagaggaaaataccacatattatgggaagaggcagaaagctattgtttgtctgcaattattagctttagtggtgatgatgttcaaaaagataagtaaagataatgaaaatatgtaattgtttgagcattcctaaaaatgattttatccctaaaacttaatctcgaaaaactaaaacacattttgattcagatatctttggtgttgtccactatagaatatgtgttctatatttcagtagcgataatgcctatgcattgcttagatagaatttctttaactatgcgttttttggcatttcatgaaattattttgcgaaattcaacaaaccgctgacgatgttatcgcacattcaaaatcgtttacaattcaatttccactttttctaaaacaaaataactttttaataaatttatatttgaatggttcgctcttgaacacatttgcaacacatgaagaacttttcgttaaggcatttcttctttgcctccaattttaatatttctagacctcactaatgtcacaattacccaaacatatgtaataatcaaaaagtaggtaaaaacggatgtgaatatcgagaacgcgccaccatggaaatacccgattacgaaccatgccacagtcacaatgaacacgcatatccaagagatcacaaattcgatgatttgggagatgcataacttttgtgactcgaaccaaattcctgcaatgtttaagaattgaataaagaacattaagtaataaaacatcaaaacagcgaatgtcattgtgtcaaagcttaagcaatctccagctttataaccccatatccaaataactgcaacaagatgttcgacctgtgtttctatgtatggtattatatagatccaacagaacaagaagatgaacagcagatataaatgtaatggtaactttcgaggtcgtgtccaaaaatgtaataagcccaaatagaattgttggaaaattgtatattctccttcagaataaaacataaaatcactaaaattatcaagtttcgatttaagtggtatccaatatggtattatacgaacaaatgcaatggctaaaaagatcattgaaaaagggaaaattacgataccgaaattcaacgatatcttttcggttatgacgggtgaagtttcaccaacaaaaaactcaaattcttttgtagaatctccttcaatgcgcaagttatgtcgtccattttcaactgttacatttaatgaataaagtcttgtcctgttgttaatttgtcgagtcattggtatatttccaattaggacattatcaatatataaatcaagtgttaaaactgatgatgaaaagcctaaaactcgaactggaaatgagttcacattaaacacttgatgcttatggacttgatttaatggggttggatatgtgacagcaattatattttcatctgctggcgttatttcagaatatgcaatggcattcttttcaatggtaataaatccagcatgtgtataacgacgtgatattggacatatgactgataatgtatcattcacatgttgaacatctatcgatcgagggtgtgtatgaccggcaatatacaaatgagaacgtgttattactgaacgtaagctttccccatttggtgcggatcgttcccagattgtcgatactggaaaatgtgatacaattatattcgtaccattatcataaatgctacgtcttagtaaatcaacatcgtctgggtgaacttgtggtagagatccaaatggtgtggttgggagtggtggatgtaatactgcaaatgatataaaattaattggtccaatacttgtgttgatagaaaatattgtgcctgtttcactgagttcattatgaaaggcaaattttttgtaataatttaatggcgtatcatcaccagcaactttgaaataatcatggttgcctggatattctaaaagaacccttccttctttaacaagacctgactcatatctagaattgttatataaaacccaattttgataatttgatgaatatatctgaaagaatgaactacctgcggatgagtctgtaatgtctcctgataatacaacaagagatggatctattttatctgaaatatttttcataaagttttcgacattagtaacttgttctggaatttgtgtaaaatgcgtatctgaaatttgtacaaagtaataaggttcttctgtaaattcttctgttttaacttttgaattaattggagtgacactgacatttccagtcgtgaaaaaaacaacaattataactactgcaattataataaagcttaaaaagtgtgagaaaaaatatggaagaattttgatattgttttgcctttcttgtgttgagtcttccaaaatcaaaatgccgtttcgttctgaagcgtgtttttcaataatttacaaaatagtattttgcagaaaaacgaacgataaaatttgaatgcataatttgggcaaatatttcggttattatggtgcatttctgaaatttttattatcgtaaataaccacttatgactcaaaattctgtaatatcacagcactgatgtgacacctttggtcgcgaatcaaattccaatttcttagattcaaacattcaatccagaattgtccttgtcgtgtcttatgtattaacacgttgttagacgaatatattctgtgactatctgatgaaaaacatgcgaaatttttcaaaaaaagacttggagacgtggcaactttttttgagttcaattcagagtgagaccaaaaaattgaatgcttattaatgtatcggatttttacgataaatgacaaaaattctcatatggggcgccccaattccttgggagtccactaagaagctggaatttgattcgcgaccaaaggtgtcacatcagtgctgtgatcttacagaatgctgtgtcaagttgtgactggccacataaaagtgaatttttaaaatgttttcaacccacgtgtgcgagtagttctgtgttacaagaaataaatttttcttaaacatttgttttacttttaccctaagatacaattggaatggttgtgtatttatattttaagttggttccctttggtaactgctgaagagagagttccattaacgttctttgcaatgacactttttgtacccaagagcaaaacatggaagtcagcacattagtttttgataatggggcatatacaattcgtgctggtcttggtggagatatagaaccatcatgcgtgattccatcagttgttgggtggaccaaaggtgcgacatcaccaacaaattctgatggttcattaaattattttattggcccagaatcacttgttaacctgtctgccattttattaaagcgacctatagaaaacagaattattacaaactttgatgatatggaaaaactttggaatcatatctttacaaatgaactttgtatgaaaccagaagaacacccagttttaatgacagaatcaccagataataccaaaccagcacgtgagaagactcttcaaataatgatggaaacttttcaaataccagccttttatctttcatatcccgaagttctttcactctttagtgctggcatcaccacaggcacagttattgattccggggaaacccttacacatattctcccagtttttgaatgttttggcatgacacatgttcaatccaaacttgaagttggaggacgtcagctgaatggttatcttaagaagctcattcttcaatccggtgttaaacttccatctggctatgaacgtgaaagcattcgtgacatcaaagaaaagctttgttacgtagctacagacattgatgcagaaatgcagaagatagagcaaatgaacgcatccgagaagccattcgtcctcaggaacggtcaggagatcaaaatcacatcacagaaatttcaatgcaccgaaccactttttgagccggagctccttcaactcgaatcccaaggcatcccacagcttgttttcaacgcaatcgataaatgcgatgacttaaaagcgcaaatgttcggtaatattatgctcacaggaggaaattcaatgtttccaggattcgctgaaagactcgaaaaagatatttctgcaatcgaaaagaatgaaaaggttaatgtaatcgctttgccaaataggaaaaatgctgcttggataggaggttctgtcttggtgtcacttgcaacatttagtcaggcgtggatcactaaggcagaatatgacgaagtcggaccttcaattatgcacttgaagtgcttttaataataataaaaagaaaacgttaatgagaatttcatcaattaaaattcgcaattagtgatcaagaatttttattaagtcgtaatgcattcgaaaatgaatcgggttggcgaactggatgtctttagatgagtgtaccaaaagtcgtttgaatattcacaaaatcgagatttaaatctatatgtagatcaaattcatcttcataaagtaaagatatttattgtaaaggatcttcaaatcttttttattattatgattattttttgctgttagtcccaaaaaccgaaggacaaacgatagataaattaaatgatcaggaaactgttttccacagaaaaaagctatcggcgttatatgaaatgcttctttgctgaataaatatttttaaaggattaaagagtggaagcaaatgaattttcttcattctttataaaaaacaaatattacatacgaaagctaaagtttaacaacaactttttttctgttcttgctcgatttcttcagatttatcaaaatctgaaacttttgatgcaccttctgcaaccatatcgaaaagctttgtaacattaagacctcgttttgcagatgttaatataaagtcgaaattgttggtttttgcccattctttcattgataagataaactccgaattttcatcttgaaccaaatcgagtttattcccaacaactatcccataaaactctgtctttatcgattctgtgaagttgcttaaccatcctttaagctcttttgcagtattctcacgagtcaaatcaaaaaccaagataactgcgtgagctcctcgataataaattggacctagggctttgtattgttccattcctgcagtgtcccatatgtttaaagaaatttgttgatgattaattgttgtttgatatatataatttcctgcacctacagttgattgataatcagaagaaaaacaattgtactgaattttgttcgaaagtgaagtttttccaacagcaattggaccgatcagcacagctttccgatccattgttctgcctgaacattttacattcgattcaaaagcaacccgtttgacggttattttatcaaaacgaaaaatgctgaattgaggatttaatacattataacccaaatttaagctatcatatatccttgaaaatcatcgagtatgatatttgcttgtgtgttttttattcaaatttgcataattcaaaaaatagttatatctcaaagttaattccatgatcacctttgtaaaaatctactacataagtatgccactatgacaagtgttatgtatatatatatatatatatatatatatatatattgtatcaatttaaaaaaaaaaaaaaacagaggaaaacccctatgaaaaagttgttttttgacttgaaaatgatcgaattataagtttgtaaaacatgtttcaatactttacttttctgaaaaatattaatttttacaagaaatcaatcaaattatgtaagatgaacatacatgaattgagtaagcactgatatgctgaagatagttgaaatatctatttaagcttagaatataaaataatttaatacaatttgtcaccagataaagttggttcgttgtagtttacgaccgaatggtgttcaattacaaactttttcagagaggggtccttaactgtgacttcccccattcctctttttatctaaatgggaactctaaattcagaaacaaacattggatccgtagcattttcaaattgttatgatttgacaattttgaagcttggcacaggattaacaaattttggagataattcattttcaaattgtatatcgataataaatattacaattccaaattcagttcaatctgttggatcctcagctttttcaggttgttatgggttaaagatattaacacttggcacaggattaacagtgattgcaaatggcgcattttcgcaatgttataatcttcaatgtatttattattacggtaccgtcttcacagccatggattggagaaagtgcatattcttcagttaatgcaacagttcttacatatggtgatgaaagatttggtccatttgcagtgaatgattatgaaggatgagaatgcataccattatttacacattcattttcaagttcaaacacatatacacaatcaaatacattcattaaatcaaatacatttagtaaatcaaatacgtacactcaatcaaactcattcagtaaatcaaatacattcactaagtccaatgcatttataaaatcacttcaaagttatttatctttatcattttcttatataataaccatttcagtatctattacccattcgttaactgtttatgaaacgcaaataatatcattttcattatttttaagtaattcaatgttttcatatattgaaactaaatttatttattatgattacacaattgttatttatacaacatattataattattattcaaatttctatacatatattaatataaatgaattcctcagtaatgacaataatataacgacaattattattgtaattgtttttttgttattataattattataacactacttgttgtattattgattcgaattccaaacaaaaaatcagaaaatattaaaaacgaaagttcagaagaaaatgaaaatgaaaacaaaaaagaaaccacaaatacatttgcaacaggaatatctatgtcaacaattgaagaagatcctttcgctgatgatttcaaagaagataaatttattgtgcaaatgtaattttgttgaaatattaaattagctgatgcaatattaaagccattttctatttttagaataaacattaaatttctttgagatttgttctttaatcattaatattaatttcaataacaagaaatgcatttttaaaaatcattgaaaaaataaaaaaaaaccgcattttttgtgcattatatttttttttttaaattattattaatcttttcaactttaactattttttattacttcatgtctttagtataaaatagaattattactcaaaaaataaaacacaaaaaattctttatttttttctttttcttgcaatcattagaaatatttgatacgtagttagacatgacattacatttacaagtagaatctctgcatctactgaatccgtaattgagatacatgttagaatcaacattacatgttaatttcatttgttgtatttatgtaattcaatcttatgctttttgtgggtgaacttcattaatttcgttgaaagtgattttcgcttcttttgggaattatggattttcttgatacactggtttggaaagatactattcatcaaaatactttaattggtattatttgaggtaaaatacaaatacaaataattctacatgtataatcaacttctaatataaggagagcacgaataattttcgaattcatgatattttttataaaaaatcattttctttcttaatgagagtatttcattaatgacttcaatcttttatataatgagtgaattatcgttcatgctaaaacctttatttaatcacattattatattaatttcgaagtttattaaaattttctatcttcagaaattacttagtataagagaagccacaatttttcttgtgtgttatcattaaataatacatacacaaacatttattccaaacaataaattactttttccttctgctcatagattgcattgtcattggcctcgatgtttgccgttctgggcttcgaatggcttcgtcaatatctatcatgtcctgaataacgctcttcacgaagttaaacttctcctcgaggtcgtctccgacattgtctcttcttctgtacttgctcaagattccatttgatgccttttgatacatgttttcgatcgcgagtcgaattgtcgcagcttcttcagcctttgctctgttttggtttgcttgggtttcttgtagatttcgctgtcttccaaatgctttaaaactctcttcttcggcttgtgcaatgcatttgagctgataatcaacttcaacactacattttgaagaggactcgtcatatagttgcatagcgtccttaaggcgctgaagctctttcttggaccgcataagcttgacatgaagagtactacgccattttgttaaagtatcatatttcgtaacaattccttgtatttcattaatgccaccgttgttagcaacctcaggagctgcttcaaagacagagtcgaggtattctttgtaaggaagtgattgttgaagttttaattcaatggcagattttttttccatcaacttagaatgttcttcaataagatgagaaagttctgcttgctttgaaagtaaaagcttttcttcggattgaaggcgctcttcttccctttgacgtttattccaattatcagttacatattgatctttagagttaacttcttcttggttttcaagatgctttttctctagctcttctgctttcgcacgatattgtttcattttgatttcatgttgctgctttttggcatcaagcttaacttgcaaatcatattcctcgcgctttttatcaattaagcgttcgagaccagttttgctctctggaacaagtcctaaaagcctcctagctaaaactctttgcatgaaatttttggtcccaaaaattcgacaagtaacgtacaaaatacgataggaaagtgtccaatgattgagaattttacattatgaacaaaaagggatttataaacacagatatagttcataccaaaagcccaaatctctttgtatttttgggattctatcttctgttacaattttttgtatggatttatattttaaaaccaaaacaacttgaaataatcaaatttgaacaaataaaaaaggatactccaattataaattggagccgcatttatgaaagatgttcgttttgcagttctttaacagattctcatggtaattcttctccagaagatttgattctttctggtgtttttggaagtgaatatcgcgctaaatcatttttaagatcacttcgtaccgtaggttgtaaagccactgttgtttttgttaccaatttaacagtttcaaagaaagttataaatgaatttgaagattgcggcgctcaatttttcaaaatgaattacaccaacgaccttttgaccatcagctcccactcacttcgatacattgcgtacaaccaatttttatcacagactccttttcaattcaatcgagtccttcacactgactcatttgacgtatttttccaagcagatccattcactcctgatatcgatcctaactatctttactttgttatggaacaaccattaattatgaattcgacgtggaacagtggttggcttgttcgtgcatataatgaatctgtatcgaagtctcttggcaaataccttgtttcttgctccggaactcttattggaggtatgaatcaatttcagatatatctcaaaactttgctcggccataaaccattctggctaaatggtcgtcactcattggaccaagcgtatcataactatcttttacatactaaagccttcgaaaacaacggaattcacccgaaatatctcggatgcaactcgacctttttgacaatgcattactgttcgcgaggaaaatttaagatacaaaatgacagatttttgggacctgatggaacaacaataccaagtgttgtccatcaatataatagatatggtggaggaccacagcttattaataggttatgtggtggtaaataaatggtatcaaactttatcgtataaataaatgttaattaaatctcataatatacttttttttacagaaaagcgaattaaatatatccaaatgattcacttatcagaagggttttactgagttaagagtcgttttcacaattaaagctcaaaatttaatcgaattttaaaatttgaaatacaaaaaaagttttaagtaaacatattctatttggaattttgaaatcgccatttgtaactgcgatcaattataatttggaaagtctgttttttaccatactttaaattatctaaagaaaatttggcgatttaaacctctacaaaggaaccgatggactcaaagctatggatttactttttgtctctttctttcttctccataagttttatgattttggcatctttgattgccattaactccatcagcattgaaagtttaagttccaatgctttaattaggtcggattgattctttccttctataatcttttggacaagtaattctcgttcttcatcagtcattggtaattctttatgcgttttttttgctgtttttctttctccagttcgtgtttgtttctttggttctgttagattagctttaacatcagaaagtactttttctataaagccgggttttgcatttgccaatccatcaattgttgatttatcaagtgttatcccaatttttttaaataccttttgatttaaagttgtccaattatatatttttgtgtcaactcgaagtgcttgtgagtaattatgaagatcaactaatttgggcataaatttatgtatgacctctgccattaaaactccatcgctaaaatctcgtgccatattccttaccttttttgatagtgaaagagaatttatccattcttctactgacattttgtaattgtatcgttatatgattataacggaatttttcatgtcacatgtcgccgccaaatggcagatcgttcagaaaaattaatttcatgcgcaggaaaacaaccaactttatcagcaacgaaaccttctatgtgtatatcagaagatactttttatttacttacaaatgagctttggtgtttttcatctgattttcaatggaagcaaatatttccattaccattttgtacgcgtgaaggtcaatcaatgatatctaccccaatgggagttgccttttttggcggcatagaaaatggtaattttcagaatgatttatggatatatcatagaggtgaatggatttatgtcgcatgcaaaatttcgcctcgtgcatatcatgcagcagcgtgggatgatcgaggtttcatattaatatatggaggaaggaataatgacaataatcaccttaatgacatgtatttaattgatacaaccaatcaagaaacgattaacatttcgattccaaaccttccaacattttatgatcattccattacatgtcttacaaattcaaaatttgcaatttttggcaaaactacaaatcatgacaagcttgagttctatactttcgaactccaacaaaacacatgcacgaagttagacagtgtttttgacaatttttgtgagtatgatcattatgccaatcttatttttgacatgcttttcatcttttctcctaacaatgacaaactatgggtctatgagtttacgcacaatgtatggatcccattaatttttgatttcataccaacatacggattcatttcaaatgagttttgtacatctgaaaacaaaacactttttttggttgacagcaaatttactaaagtttttacgtatcaaatcttcacggactcaccgaataacgccaattatcataatcattcgcagtatatcaattttttgtctcattacataaaagaaggaatcaaaaattacgaaaagttgaagtcgccgtttaaagaagacattaataatgaaatgtcacaacttatatcgaatcgtaattcattatcatttgacttacaaaataacgaaattgttaatattgatttatcaagtaaaatattcgaacttaatgatgaaatccaattattaaacaaaacaatttcgaagataaccattataaataaatcgaagaacttaaataaacttaaaaaaatcagtaaaaaaaataataaaaacaaaaacaaaaaagataaaagtgatttgaatatcgtcatgaaacaaatcaaaataattaaagaaaataaaaaaactgaaatcaaagaattagatgaagaagttgaaaaattatcaaatgacatccaaaaaatttcgttttatttccaaactcaaaacaatttgcagtttaaagggaattacgaagaaattttgcaaaattcgcttcaaatttgtaaagaaattcaataccaaagagaaaatttgaatgaggcaaaaagtgaactggcaaaaattgaaaacgataaaaattcaaatgattttgaattgtattcaaaagtttggggtgcctccaaaaaattaaatgatttacaaaaatcaatcatgaaatctagaattaaatacagtgaatatttagttgattctataaagaaaagaaatgaaggattgaatttagtacaatcaaatatggatattgttatcgatgattatttcgatttattaaaagaaaaacaaaaaattgaaaattttgaaagtaaaattaaacggttggatacgttaacaaatgatctgaaaagtgacaaggccaattatcaacagaaattgtcgaaggcgataaagatcattcaaaaagtgggaaagcaacaaacaagaagaagatcatcaacatcaaaaacaaggaaacataagaaaaggaaatcaagtaataatgcacctaaaagtgctaattcatctccaagaaatgattttgctttgacaccttttgtggatgcaagaatgaaaaaagaaatttttgttagagatattaatcaaatattggacaagatcgagaaagaaattaaatattaaagtatttgtgattcatttatatctgagtaaaatttattgttttctttttttcctttgtttaattcaatttaacaataaaattatctttttgtaatttattattcaattcttgatttggaaggtgttatttttataatggaactcacattggatatggtatatcttgcacgtttttatatgaaaaatatacattctcatcatgatattatcaaataattcattattcataaagaaactatttaataaggttattttttgcaaaatatatattattaataatcgagttgtatatcaaaaaaggaacacaaagtttcgtttttctgagatctaataaaatgaaaaaaaattataaaattattaataatcgtgttgtacatatttgcttttactttactatcacaaaatagcattttatataaacgagttatttatataactcaaatgcattttaattttatgaattcatttcattaattttttaaaaatatataatatatatacaaattatacccgatatcaactccaaatttttattaactttttaattatttattattacaatgttatcactttctgctacatcatcttggttactcatagctaacatagaaacaccgaatgcaagagcattatgctgattgatcccaactataagttctttaccgaaataatctttgatcatttctttaacttttggaatatcccaacaatttccaacgagtattatattatctacatgatttcgtgatacacgcactgtatcaagtattcttttgattaatatcataattttatcaaacaaatttttattgatttgaatgaattcttctcttgttaatacatattctgtttctccaataaatattttcaagttgggttgatacaaaagttcaaattttgctgtttcacaaaatcttctaaatgtgttcatctctttgaaattaagttttagatcttcattatgcgttttcttaatgatataatccataacattttggtcaatatgttttccacttatatttatatcactttcttctgattcaatatcaattttttgatttttggctttaacgatagaaacattaaatgtttcgatttcatattcgataattaaattaattttccattcgtttgtattattcattgttattgtttttggaacacgaagtgtatttgtgtttatgttttcatatattatttttccttttttaatttgtttgcatgcaaatgctgcgccaattgcaatagtcactttgggatcaatttgtaggaatgggtttttcccaaaataatttttaattatttcataaagatatttcgcttgcgcaccaacaatgataatatgatccacatcatatttcgatatagatgctttttcaagtagttttgtgatattttcaattattttttcacatacatctttattaatttcattaaactttgctcttgttaaatggtattcaatatcttcagtgaagtatattttagtttgaacttgaatcgaaagtattttgtatgcttttttacaacttcttttaagctatttcatcattcttggtatagatcttagatgttctgaatgagttcttataagaatgtgatccattatatttcgaattatatctctattagggttcgtgcagatatcaaatgcaatgatgttaaatgataaattctttgcttcgagtagtgatatttctgtaaaatcatcattaagtaaatcgtaaattaaaaaggttttcttttctttaaagagatcaaaatgagaatgatacgcaagagctgcagctgttgggttactaataattttaataaaatttattcctgcataacggccagctcgaagagttgcttcgcgttgattgttgttaaaatgcactggaactgatatcactgtatcgcgtgttctctgttttccaaggtaacagttacctacatttaatagatattttagaaactcacttaagacttcttctggtttaaaatcttgtaaaaacggaattttgataataatttcatcattcgcttctcttgaaatttcaaaaggccactcatttctcttttcctgaataaaaagatcagaaaattttcttccaatcattatatccaaatcataaattgtagcacttggattcatgaaagaagtatctaatgcacatttaccaaatcttatctctttttttaaaaaagagacaactgaaggaatacatcgagattgataaccatcactaataacacaatagtctctcttggaaaaataagctattgatgactttgaaccaaaatgaatcccaaagcacgccattatataaaattaacgtcctcctaagtgacaaaaaatacttttatgctttgttatgtttacaaaattttgtagcgctacttttttgattcaaaacgagatctgaatgctatatcgtatgtgtgagagtcaatccaacacggacagatatcggaacatcattcttaataatttaccctgatgtctttccaattcgcgatttttacgaccgtttatagtattcaaaaaatagtaaacggcctagtgtggccacaatgcacagcaatatatttccaagaaaaccccataaagactacacgaattacaaaaaaaggccaatgctcgaatgtgttataactcaaatttcaagaggatacccaagaatttctaagattgcacaaacaagtaaaattcctgattccacactaagattatggaaagatatattaaagcataatcctgcttggagaccatggaataatgatcatggaagtggtcataggatatttacagacatagaagaacaatcaattaaggattttattgtcagttgttttttacaaccaggttttgtatttaccaatgaagacttcataataatcgctatgaatgcatatctaacaaaatatcaagatataactaattttaaaaaaacgaaagattttttagtttcacaccaatttatcgcagattttaagaagagaaaccatctatcttcttgagttttacatcctaaaaggagaccaaatgtgactgataaagaaaaatctaattggatcgatacaatacaaaaccttcttacttctgttgatcatagtagaattgtcaatgtggatgaaacatgctggaagtgttttccaaatggtatggtaacttgggcagaaaaaggatctgatggaatatcgatcaacttaaattcttcaccgaaggcatcgataactgtgctggcgagcatacgttcagatagaaccaaaattcccctttactttataacaaaaggaaagactgatcttgtaaaaacaacacaaattggtgatgtttcacctcacatgtccacccactcagaaaacggatggaccactgaggaaacgttttatgagtatttactgttcctccggcaacacttcaatgacgaagatcctatacattcgttacttgactcatataaagcccacaaatgtcaattaattatcgatttggcagaaactctgaagattaaattatatttcataccacccggtatgactgatgaatttcaaccattagatcgaagggccttcgggtgttcgaaggctacagcacgttatctgtttcgaaaagagtacaatcaaaacaatgaaaaaaaatttaccaaattacaagcagcacaatgcatggtttgggcatgggaacacctgcaacccaatataatccaagagtcttggtcaatctatgaatgaaacatttattcattaattttctttcagacagaaagtattcatattgagagaaacggtttttaacggtcgtaaaaatcgcgaattggaaagacatcagggtaccttgttttgatcgttttgaattgaaaaagtggcgcgataatattttttaaaagtgactggagtataaatttttacaactttttctcaaaactaagcataagaatctcaataaaactttggtatcatttcacccaaatcatcataatcatatttgaaaataaagatgaaaaaatgttcaattttttttatgcttgatttaaataatgttttacatcaaaaaataaatattcatcttctggtgtactaagaatgaaagcataaaaaaaccatgattctatatgtaaatttattaatgccattaagagggtaactttgttaggttacacaaaagcgagttcataaaaacattaatcatatccatgatgactggttttcaaaaaacaccaccgagcttgatggcactttttatgaagaaaatttaaataatattattctcaattgtaatgtttatatttacacttcattgagaaggatccactttttgaagccttcacgaactaaattaggaatttctggaaatgagcataaaaaaaaataatcatgctgtggcagcatgtaggacatcacattgaatccatcttttcaatttcatatatgaggaagacaagaaatggatcaatctggaagaaaatattgtgcttggacaaagaaaggagacaaaaaactcaaagatttaagcagcagctttggcggtgatctcgataaattaatgaaatattgtcctgatcgctctgagtcaaaaaaaaaaaaaaagaatgaacgttaagtaaaattcttaactttacttcactattttttgtgagaataattagtcggaaccactctcaagagatcaagaaatcaaagaaaaaaaaattataatcaacacgacaaataatgaagacgcccccaatattattgcaacacgcaaactctgagcgcgtatctttattcttcaagtattttcttgatattttgattttaatttgtacatttactaatctctatttatacattcaacaacttttaaagaccgaagtacatatcacaatgaatgcaatgacatcagaagagccaagtatcatttctatggattctttctcgtcgattgaatacacatcaaaagaacttgaagatgcgattaaccaattacacttaccaacatggtcacgagcatatgttccatgtacttccgaaaagagcgaagttacatgttcacaagttgttcactcatggcgagttattcaacaatgggttaattatattggggaaattccgtatcaaaacagaaaatatattcatatattacattgtagtaatgggttaggcaatcgtattggcatggacgtcgttatgttcttattagctgtgatgacgaatcgaagcattgtcatcgaagggaatcatttgtatcaagggaaagtcatcacagatcatggaagtgcttatgacttttcatatccggtcatccatcttacgaatgaaacgcaacaaattctttcggcacgtaacgagtttaaaatcgagacacttaatgactttcattcgattaatttctttaatcattcgaacgaaactttttatcttcgcgatctcttattttcgtcaatgatatatgtccattatcaattatcagattttgcacttcgacatttcggaatgcattcgatatatttcttaacaaacttcttgattaagtatagcgatgacaaatataaatacatatttgagctatataaaaacataccaaagaacattcggatatttggtatccatttaaggttccaacagcccggacacttcttcacatatggaattgaccataacatgcgaacattagtcccgttcttgaatgaccaactgaacaaaaggccgacgatattcgcgttcacttcggacagtaaagaaatggaaacggaattcctgaaagtctacggaaataacaccattctaacaaacacaattaagaagcccgacttcgatcatgactcgccgcaagtggacgtgctgttcctgatgtacgcagaccaatgtttgctcacgtttcgttcttcgttctcgtttttggtaatggcgtcgacttgtaagagaggctacttcatagaaaaggaatcgcccggtatatttagaatggcaaactcgcaagcgggcgcaatatcagcgctctatcatagacgggattataatgattggcaaactacaagaagattagtgctcaatgatatgaacgagaattgctatagatattatttcaattactttttgatttgattaaaattatatgtatgatgttgctgcatgtggatatgtaaaaaagatgttgttaggaattgtaaaatgtttgattctttgctgggggtgtggcaatttggcgtcaaacgatcaaaatatatttccactattttttaaggtaaacctaacatgcaacgataaaaaccgattcaaaaagtgaaatccacgattaaaaacaaggcgaaaaggtgttcatttgaatactttacatttctaatataaaaatcatttttttgcgaaatttcgctcttaagtttttttttgctcctacgatattttttaatcctaatataatcatacattttatacattaaaagataaaaattaaaagcataaatcaggaaagattgctgataaatgttgtatttctaaaaaaattgagcattgtatttggctagaattctaggcctaatgtttttaatatatatatatataacctagctattaatagaactttaatagaaaaagaaaaaaaaaatgtcccaaaccaattttcatttctttcgaatgtgcgttattttttataattttttgaaattgatgaagataatgataaacttcctcatattgtttttagtgttttaaaaattgctgatgtgcgtgttttgataaacttttcagtcaaacatagccagatcctctttatgcctaagaataaacttattagttatatctctattatttcttgtgcctataatttttatcaaaggacaactggtaaaggaaaaaaaatcacataatccctcattttttactaaaattgcttccgactttttgtgttcaaaattatcgtattcgattaactatgttcgttggaagtcttgataacagtttatatgagaatatcatgaaactgaaattcaaaagttctcctctctctcatcagcaaagaatcaaaaacttgtcaagcccaattgatgatgattctgattctttatattgtggtacctctgaagaactcattcacaaaaaaaattatttgtttaagaatctcaaaaacaaaatagatagtatcccacaaattgctgatatagatcaaaggggaaatgttttccaggaaataaaagatatgtttcacaaaatgaataagtttgaatcttataattgccatataacatcggaagaattcttttatatatttcggctgcgtgcatatccagagctagaagaaggcgtttacgtctttctcaatggggtaattcataataatcctttaattgcaaatatttttattgaaagttctatggcaaacattcaagagtttgttaatatgtatcgatcgccgtttttcggttggcagtgtgaaatgattaagaatctacttaattctggccaaatcatatgtgatagattaattacatttggtttatttgacaatcttcaatctggttttttagcatctttaagccttggtcccaacgaaaatacaattgattactggataaatttattcattttatttgaattaatgattcgacattgttcatataacgaaattttattccaaaacatcattgatttatgcaagaacgtaattaatccaggttttttagttgacaaattaattggagttatttctaagtcattagattgtttaacttgtattctccacaaatgcccaagtctcaaaagtgaaatttcacccgttcttccactttttgaggaggctcatcaaaacggggcaccccttttttatgacgaccgtttgttacaatcatttctcagaataattgagatatttacaaaacctccggagccatatgattttacacaaacaaatcttctatcaattttatttcaaaagacatttgaaagcaaagttttctcagaagctaatgcctataggaatcgaagtttatttttgaatattattagttatagtcttcaatcatatccgaatacattagacttcatacttaataataatatattaattataagttttatcttattagaaaaaggtgatttatcatgtaaagagtcttctggtgttttattttctcgattatgtgatccatcaatttgggaacaaatttccgatttttttgcaaataataatgtaattattgaactcgcaaaccaattactattaaacattagtaaagaatattcgttgactattttgttggggtttaaaagcatcgttttccaattagcgaaaaatgattttttggaaaacaatccaattttcgagcagttctacaacgatgtgttcgaaagtatcttcaacacaattggcgattttgaagacgaagaagtagaagaaagttttagagaattggtgcaaatgatcagaaataatgacccaaactatttagctaactaaaatgtatttgaaagcaaattttatttttttgttattcgatgaatattttcttttgtaaattaaatttgattttaacatttatagttaaataaaaaagaaaatgaataaaaatttaaattctattttccaaaagtatctacatgttatataatattaagttttcggtctgtcgctcgattgtgtgctttactcatacgatatacttctatgtaatttgatcacttcagatacaaactgtataaatatgtaattaataatatattatatttcaaataattattgaatacaatatcttatataaaaatattataatataataatgagataattatttaaatttattaaaaaaaatatctttcatataaaattatcattgtcttcattttgcttcatctttaaatccttcaaaacaactttaagtactgttgtacttcggggatacttgttataattctgaatattgaaatgaaataaatgatttttttcatgtattaatcattagcaagtgttgttaaagtattttataatatgttaactaattgaagttcattaaaaattgttttgcatgaatattttacttaaaagaagaagtaatcaccggatatatctctaataagaaaacatttatttataaatgcattttgcttgtggcgcgcgaagtctctttatgatcactgggtcattgtagtcgaatggctctgcagggaactgcacgttcattgctgcctgttcgaaagcctttttcagcagcatgtgctggtttctgttcaatggaataattgtggtctccaaaaacgacaaatttactttgaattgcttcatctttgcgatgacatatgacgacgcttgatataatgagacgccgttcaatgcaaggatttgtgtcggatgagaataaaatgcctttaaaaggacttctagtaaattttggagagaccggacaacatctaatgagatcggaggggtgccaacaggcggaggtttttccttattttgttttgtaaattctgataacgaaaagtttccttcaaacattgggaaacgcttcgaaaataagctccgttctttaaggtagttattaagtggtgtgactggaagtgcgggtaaagatgttaatactcgtattccttgtatgccactttcatatgaataatgtaatatgaagttagtgaagtttggacatttgattgataaggtaaacaaggttgtgtttaaatcaagggaattcatttgaagaagttcatgccataattgttctggtttggcttgcatcatagaaacataatcaggtgtgtcttctttttgtggctcaactttgaagatttcattaatcatgtcttcaattgttacatcgagattgattacgtttggttgagttgtggtaacggtttcgttatcgtcttcggcaaaaacaaactctgtgaattcttttgaatcgactttgggtattgtcgccggaatttctgaagtttcagtttcgccatcgtccatttcaatgtcactttcgtcactttcgaattctttaaacggtggtttgatgctgagcaaaagttttacataaccactaacatcaaagctagcattattttgttgtggatagattgcttgtgcttgtgcctgtgcttgatttctttgttgagttgtgttctcaccaaaaacaaaaaaaatttgttgaagtatctgattagcatctggcctttgttgctgatcttgccgaaggcactgtgaaacaagggaaacaaaaaattcatcaacttgccaagtttgattccatttataatcagttttgagaatttgaatattggttgcatttggaaaagcatcaactaatgtgcataacctaaagagaagacagccaaggccccaaatgtctgatttggtgccaatcgtttctccacgaaataggtcaaccatttctggagaacgatattcaattaatgtactttgatcaatatctttagatgccttcatcctctcatctgcttcttctgtatggaaaatagtggtagttgctgaataaaattcacatatcttccaagaacctgaaaataaaaaaatattatcgggactaaggccacgatgaataacaggtggtacatgctcgtgcatatatgttactgccttgacgatgtctgaaaatatggaaacaatatctttgtttgaaaggccaattgattgaaactttgaaaggtaattgtttaaagtaccagagcaaggttccataagaacatatatttttcctgtttcataagaaactgaatgtatttgagcaatgtttggatgtgataacttactttgtaattcaatgctgaacttcattttgtcgtatgtttcaaaatcatcaattgtgtagatttttagtaaatgttgtgatttttggttatcgatacaattgaagcacttgcaaaaaattgaatctgaaatcttttcttgtattgtaacttgaatatcaccagatctgcaagtacctcctgaaacatcatgcgaagagtttcgtgaccttttcatctgttttcaaatagggtccaaacaattgcttaaaaaaattgaatattcaattcaagattttcttagacattttggatcaataagttctatcgttaataacttttgaaaggatcgttcatttattcaaatgtttgcctttttggcaaatcagtccttgacttggataatttcattaaaataaaatcgaccctacaaaattaaatgaccttctagccatttttttaaaatactcttatataagagattttataaagttagattttacaaatcatgatgagaaaaatcttgatttagctcattaaactcaaagatagtttctattgtgattccagttcaggctttagttcattatactgttatacagtatattattttaagcaagaacgaataaaaaaattttatcgaatgtcactttttggataaaataaactattgaatgccaaaattaacgtacgaaaattaacagttatgaaagaaacaacaaagaaactgaaagaaaatattacaatacttcaacaattccaaaaaattgtttttgaattaacagaaaataatattgatgattcggccaaatttttaatggatttatttgattcacaatatattcattcttgcaattacattgtatataacctaatatattcttcttttatttctcaaagcaaagactataatatttatttttctctactaaaaacaattgataagttagaaaataataaaaacaatgtcttacattatttttctgtatatatttttgaagaaaattctaaagaagcactttatctgtttgaaaaattagttgaacagaaattaatacgtttaaaatcgttctttactaaaaaaatagcagctaataagaaaaaatattttttattggtgcatcatttatcagatgaacaatttgataataacttttatcttttatttggttctgaatattataatcgtttgaagcaaataaaagagaataattgggaacttcataaacaattaatagaagaaggtgttaatccgaatgaaatcccaaaaataattcgaaatgatgaaatagaaaaacttcaagaaataacatcacaaacaaattttgtttttaatcaaaaaattaaacaatcaatttatgaaagatgttcatttattaatcaggaaaatgttacattaattgattatgcagcattttatggatcagtaaaatgttttaaatatttacttatgaatggtgcaaatatcgaaaatacaggtgaatatgcagttgctggtggaaatttagagatcattcatttatgtgaacaaaatcattcagcatttataaatggatatgaaactgcaattaaatatcaccgaaatgatattttccattatctatatgaaaacacaattgataaaaattttgatgtaaaagaactaataaaatcatgtatcaaaaataataatttcgaaattcttaactttttattagatgaaaatgtatgtattgataaaaatattattcaagaaattataaaaagttccaacatatttcttataaagaattttgatccaaaggaattaattaagtattcatcccttcctaatgcttgtagtacagggaatataacatatgcaaaatatcttcttaaaaatatgaaaattgatattaatgctcaaggtattaatttgttttattttgtatttgttttaataatatgagatatctaaataacatttggaaattattaaaattatttaaaacagtactctttgatgcaatagaatctggtaagacagaaatggtcaaattgcttcttaaacaaaaaggaattgttctcaataataaaatagtcaatttattttaattaaaatttgttttgtcaatttttgaatattttaatataatatttggaatttgttcaaaatttttcaaaatgaacttctatatgcatcattttatggtaaatcaaaaatagtaaaacaacttctaaaatttaaaaaatttgatataaattatgcagatgtttatttattatataaattgtttttttccaataatttagaatttgcatgtggtttttggtatttattgtgatcatttgaaacatcccttatgattgcatcaaaatatggtgaagtatctacagttaaaactcttcttaaacataaaggaattgatgttacctcaaaaaatattaatttattttgtttatagtttatttccttcatacattgttttttatgaaaaaatggaatttattttgaatatatgaaagcgcactaatattagcatcaattaatggttatattgaaatagttaaattacttcttgaacaagaaggaattgatattaatgaagaaaaatttttgataattttgtttgatgtttatattattaattttggatttcaatatcatttttaaaatttctcaaaatattatgaaaattctcttttttgggcgtctaaaaatggccatgttgaagttgctaaatttcttattaaaaacggaattgatattaaccataagagtgttattttattaatattaatatttgttttatataattaattttttagaataacaaatggaatatatttaatctatatgtaacagcactaatgaatgcatcttataatgggtatattgaaattgttcaaatacttcttaatgaaaaggaaattaaaatcaatgatactgatcttaaatttttgtatttaatatttattaattaaattttatattttataatttaatttggtattgattataataattttggactgcattaatgttagcatcatttaaaggagatgttgaaatagtatagggtgttcaaaaagtcctgaccccccctcctattatgggctgtgattagtttataaataaaatattcatataatattaaaatatagttaatgaagatcttatatatgtgaaatatgtgatttttgattaattgcatatcgagaaaaatttaatttaaattttggtgacgcaaaaaaatttgagaagaaccgtcactttttttcatggatgccgtcgaacaaagattcattattaaatttctcttcctctcaggaaaaagatacaaagccatatacagagaaatgttcactgtcttgggaaataatacagttcatataagtacagtcaaaaggtggtgtagaaaattcaaaaatggtgacttttcatgccttgatgaggaacgtacggggagacccccatctgatcttgttcatccaatttcaaaaattcttcaaaagcaaccatttatttcagcccgcttaattgcaaagcaattatcagtgactccaaatactgtattaaaagttctttatgaggacatggggttgaggcgcttcactaggaaatgggtcccccatgatttgacggaagaacaaaaattggaaagagtcgatatgtcaaaatcaattttaaaaatattagaaaaagcggaaaagaaaaatttcattaatataatgactggggatgagtcatggttttattttaattatcaaagttcttatatgtatgcagcatcacgagatgaagtgccaacccgtacccaaaagaaaattgacagtgaaaaaaatcatgctgacaatgttcttcaatggaaattccctattatgcattgattttctaccaaaaggcaaaaaatataatcaacgctatttcatcgataatattattgaagaaataattaaaaatacaaatgaggatgaggatcaattggacttagatcaaatgatgattcatatggacaattgtaaagttcacaaaggaaatttagttcaacaaaaattaaatcaaataaagcttaaatccattccgcacccaccttattctcctgacatcagcccatgcgacttttggttatttggttatttaaaaaaatatttggaagataaagagataaaatcgaaacatcaattaaaaactcaaattttaacggcatgggaacacgtcaattttgaagagcttcaaagcgtgttcttggaatggatcaaaagattgaagtggataatagaaaacaatggagaatactatatcacataaataaacaagaatatctaaaattgtttattcattgagataggagggggggtcatgactttttgaacaccctataaagttactacttaatcaaaatggaatcgatgtttcaatcaaagatatccatttgatttcattaaagattaatataattatttaaatttactcaaaaatatttggattatattccaaaattttaaaacagctcttattcatgcaactgaaaagaatcatacagagattattaatttacttcaaaataatggaaaataacatactcaattttaattaaatttaaaatattcagacaatttattgaactaatctttgaagataacctttcttaatatatctttttgcagaagaagctgtatagtataacgaatttatcatttctatgttatcatcttcataaccaagatcagcgaagaaatctacgcatttatatctaccatatagatatgcataattcattggagtcataaaattttcaaataaatatctgaatcatctggtattgaaggatcaccaccataatcataaagtaattcaacactatctatttttccattctttgctgcataatgcatagctgtctttcctgaaaaatcaggttcattaacaaatgatcctgcatcgagtaagaatgtcatcatatccatggaattcttgataacagcataatgaagtggataataccctttcagaaaatataaaataaatattgtcttgaaaatgtaaacattccatatcactattaaccatgatcttcactaattctaattgattcatattgactgcttcatggattggatataatccatttttatcttgaatttgttctatctcactatcacaaagccattttaacaattcactattgttatttagtacagcttgatgaaagattgttgtataaaaataggaaaaaactccaaaaaaatttaataaacattatcatcatattgatttggatcaattcctgttcgaattatgaaatctaacatacttaaatttccttttttagctgctaaatgaagtggacgtattccattataattgaaatgattggtattcccgccatttgcccatatatatttacatacaggaagattgttatgtttaatggcataatataatggtgtacgatttttattatcttcaaaaaacatatcatagcctaatgtacaaagaaaagtaaacaattgtatatcacttcctcgcgctgcataatgtaggagtgattgaaataaaatgaaagaacgccatgatcatcaacatgttgtatatctgaatgatttcctagaagatacatagtacacttgaaagcattaaaataaaccactaagtctatgagatatggattgaacttcagaaactttaatgaaggatctgattttggatcaattaagatcaaatttggctcaaagtattctttcaatattttcttaaattttttaacattgtcgttgtgcattgattggattaactcgttggcattctcgatattgattcttttgctcattttgaaataaatggtgaactgttgaacatgaaggaaactcaacagaaaattgaattcaaaatttctttttttcaattgtttattcgttagatggctacaaatttttgaatgattggtcagtgggttctttaagtgatcttgtatcttgataacatcaatttaataaataattttgttaatgaaggagtcaatcagaatgaaaatgtgagaaatgcattcaataatttgcattattttttggatcaatttaatgactttgttagaaaaaagaaaggacatcaaacccatgccacaaagtataaaataaacaaaactttaatttgctaaaatcttatcgaaacaagtttcatcattgaacaatttgtaaaacaacgaccgttaaaaacttgaacatgcttaaaaattaattcatagctttacttgccctacatggtgagctaaattgatcaatgataactaaagcatcaacatatgataaatggttcattgattcaaatcagttcctacaatttgctgtacatctgaaagatccatcttatgtaggtccagttgttgataaatttaaaaagttagcaattggcacaagattgaaattagatggcgataactttattccccatgaacaatcgccagaggtatatagattgccagatggttttaaaaatttaagggaagcttctttatatatggaaatacattacacgcctgaaactagtcgaacactggccacaattggtgccaacagcgacactgttgttcttaactcacatcattccataagtgatggtggttgtttacttaatatgtttaataccataagtgataatctttattttgatattccttcacgttacataatggtgttgaaatcttccaagaagaattttccaaatccacattaattccagttaatgatgttaacaattcaacattaacacgattctttagcaaagaccctacgtttctaacctcatatccatttttccatcgcacctatgataagtcaaatcttgaatctcttcaatgttatgatgaaaccctaaaacgtccaactggtttatctgattcattgtatgcccaattgatattaacagcatccgcatatgaaggccgcttcaaagaagtcggcgtcaaaacgataatgaatttgcgaccgtttatgaagggcaccccgacttttgaaaacggttgtgtgatgtcgatagttcccatcacagcaaatgttacattaaaatcaacagtcaaagagctcatgaagcaaacacgtgaatgttataataatcatttgaaacttaaaacatattatggatttctgaaatcacttaacattcagcctgatttaaataaccaggttccggggataatgatgttgcttactaacattgggcaatttaagcttggaggacctttcgatgatgtatggattcaatgctcatcgacaaatcagggaatttctaagcaactaactttggtacacttcggaattagcggtgaaggtaaaaacgaaacggtaagcgaaattatgtacacgccaaaccaaattagtttacgagaggcaaatttgttctccaagtcaattcacttcggattagaaaacattaaactaagcgatactattgaagtagcgctcgacaaaatgagaatgttccaaaataattatatgaaaaatgaatatccaaaatttttaataaataaaaactaatttaatagaatacataatgtttacgttttctttggaacaaatttattgtgttgtattgagataataattaaatcaaaaagttgtatttaatctgaaaaactctggaaatagtttttttttagggttaaagttattagctattatattaccattgatatatttaataaacaaaaaataatgtttgatatgttgtttattgaaagcaaattaataagtgtcttatgtcataagcttacctggccttagccctcatttgcctcctctttcttttgagtctccgcattcttttcttcaaccactttccacgcattcttactaaaggacgaccaaaccggcaataaccgcagtaaattgggaaatatataaactacacaatattttctggcacccccttagtgtaaacgttcgcgtcgataattaaaagaaacgatatattttttcacttgacaacgacaagattcttctgttaaaaacgattcttcatcattgaattttgcaagcttgcaattatttttcgatgataagtgttaatattaatcatattagcacttataattataacagcaaaggaggcaaaagttctagaagtcaaactatcgagcagaaatgcttacttcactcgaaaaatatataaataattttattcatcattattaacaaaaatggcaatgttgaaatagttaaattgattcttacacaaaaaggatttgatttaagttctaaagaaatttttttgttgcaaatgaaatttattgaaaatattttatagaatttataatctttacttcaagcaggacttataatggcatagaaggaaggctttacagaaatagctaaacttcataatgaagcatgaatatgaaaattaaacaatttattgatcaataaaaattatttttcaattataacaactccaaaaattgaaaaaattaatttataaatttttttatgcttaaaaataaaaatgtatttctatttttgtttataatggttcatctgatgcatctccagatgaagatgattgctctaagcaatcaaaatgattctgttcgttttgttttgcagaattttgtgtttccaaatctgtcgacaaaaggcgctcaaacaaatcatccgaatgttgttgttgctgctgtacaacagatggatgtggggtgtgactggacacattcagtggcggaagattaaacaagtcatatgtttgtgtctcattgtcaactttaagtatttcagcatgttgaaaattatgcctacttctccttttatgccgacgtgactcattcttctttatatactcacgcatgaaatcacattcaatgatttgatccaagctattaaatagatccttaatcgatgaaattttaaaatcaaactcaggcggtttgacgatagatgtaaccttctcaaaaatattaaagcgctcgagaacaaatgtaatagcaagctcaagccattcatcatcacgtatatcactgtgaccaccatggaacgaaataaggtatttgataggactaatgcaattttggaaaagttcgatgccatggaaaaaaggaataaattcgtctgtttcactgtgcccaaaaatagttggacaatcaagaattttaacagactcaattggagaatatgatggatcaaaatttgtgttattatgaatgaaaaactctgcagcaggtacaaattcggatggaagattgaattcttctgagtagtgctgaagtaggtcagttattgaggaatatgatgaatctgatacttttccaacaataagtgaactgcttgctagaagtatagatgcagcaccaaaagatctcccccaaattacaaatggccctaagttataagaactttggagaaaatcaatggaatcctcaattattttcttttcttcagaaccatatgaaatatacccactcttagaataacagtattgcatttcaatacaaaatagataaatgtcatgattacaaatattttgcataagatattgtccttctaattgattcgaacaaattccatgaacataaaaaagacatggacctccatcatttggtccttttttagatgtgtgatacaatgatccaataatttgtcttttatctttggtttgggaatttatgttatgtcttaaaaaagtttttgttttgtctccatcaaaacgaagtggtatttcatctgggttgcattttctttgaggtggttttaatatagctgtgagaattttttgaggaatttgttcttgcttcatgttgttctgaagacgtttattaattttctgaagtttatttcataaagtgccatcttccaataaaatcaaaaaatgtctgctggaaatatcgaatgtcacatatttcaagaacctaagaatgaggctttaatgaaaggactcgatctattcctgagccaggacaaaaattctatacaggaattggaaaaattaattgaagtaacaaatgttgtagataatcaaagatcagggcaccaaagcaacaaagccaaaaaagacaaaaggcaaagacgctaaaatcataggaattaaatttcaaaaaaaaaaaaagattatttcaatttttcaaaaaataaattcacacatctcttgttcaatttagagaacttacattaaacaatttttcgagaacttagttttttcttgtataaaattcggaaaataagccatgatttgtttacaaaaaattgactataaaattgaattaaaaagatcgtttacattcaaaaagttactgttgaattcaacagcatttcctttcttcgtttggtttttctccatttatatcaacatttttttccttcttctcttcggcatattttgaatctggtttttgtaaagcactttcagcaattgcatcaaaaagttcgtttacaccatatccgatttttgaacttacttggaagtagctgcagcccaaggatttcgctttttcttcagcttcttcaaatgaaatcaaattttctaattcgtatttgagaccaactaaaaagcaaatataactatttttgacatgctcttttaccttttcgtaccagttatcaacatgaacaaaagaacctacgtcattaagagcgaaacatatgaggactatttgagaatctctataataaattggcatcaaggattgaaagctataatttcctgaagtatcccaaaggtgtagatcaattatttgtccttgacattcgactttttttgatgaataatttgcagcaattgttggcatatagtcctcatgaaatatatttgtgacggcgaagttaattaggcatgttttcccaactcctgcatcgccaatggtaatgactttaagcgagatttcgtcagccattgtatttggtcctcaagtgataacactttttaaaaaatttactttttcaacaacctttaaatttttgtcaaaaaaaaaaaaaaaaattaacggacaagtcattgcagggggggtctgtcattacaacagggtaccctgttcaaattgacaagctatgtttgaacaaaacgttttgcttcatgaaaaaaagaacgaaatctacaaatgaaaaaatagtaactcaaattaatactgaagaacccacaacaactatctctcttccgcagcaaaaaccaaagcaaaaacaagctgcaaacacaataaatgttatatcagatacggctaaaattgataaacaagaatcatctaaagagctaaaatccatgttattaaagaacaaagaagattcacttgacgctagggttataacacttgattcaaaaactgcaggttggagaaaaatcgaattttcacttgatcatcagatgcctatatgcaaagactaccatgacacaggatattgtacttttggggcagcatgtaaatttcttcatacaagagatgatgtttcttcttcagaacaatatgaaagaaaacttgcactcaaagcactacaagagaagggatatttagaggcaaaaccaataccacaactagagatatgtcaaatctgtaaaaagtattatacagatccagtcatcacaaaatgcaagcataagttttgtagcaagtgcgcaatagaaagatacagaagtgatccaacatgtgccatatgtgggaagaacaccgacggtatttttaattctgttccaaaaactaaacaggtagatgattaaattaagaaaatgttcactctcttgaagaactcaatagcactaaaagtctacagcactgtatctggtagagaatgggttttcacataataaattttgtaaactattcaaaataaatatttattttttatttacacttttaataagaaatttggactttaaaagtcatgtgttatgttctaaaataacttcaactttaatttgggtttgttaaaaacatgttaaattgaagaaaaacatgagtagttcagcatactgaacatttctaaagaatacattacatgtattcaactcttaatcaattcacattaaacaatatatgtgatatactattttttttatattatgtacatttttatttgaagatctaataattttgtacaaggtcatgaaaatcgcttgtgcactcctataaatcaaatccattgatcattatcattaataacattttcatccatattttggtcaaattctacaaatctcgagtcaactgatgttgtatgttcttgaatcgaacatgttttcgtttgagaatttttttgatgttgaattacaaaataaataattcctacaattaacaaagcagctacaactgcaccacagataattccaatcaatgcattggtagatatcgattcgttgtttccgagatgattttcagtcattgtatagaaattagaataaaattgatacagagaagtgtaatagatgactgtgtactcatatgaaataatgtttgtttgataagaattatatagtgaatgaataatatgtattgtgtaaacagatacagtttgcgtaacagaatatgaattcttcataacaaaagaatgtgaaaatgctacatcaattgagagcgaatcagaaaatacactcggctgattacatgtgcgactttggatatatgaattagagtttgtaaatgtgtttgattgattatttgtgttacattgagtaaacataattgatttggtaaatgaatcagaattagtaaatgaatcatattgattatatgtgttactctgagttaatgtatttgatttagtaaatatatttgatttagtaaatgtatttgatttagtaaatatatttgatttagtaaatatatttgatttagtaaatatatttgatttagtaaatatatttgatttagtaaatatatttgatttagtaaatatatttgatttagtaaatatattgcttttagtaaatgtaatagaaaatgtattcgattgtgtaaatgtttgtgttggccaaggacattcttcgttcgttgttcctttgattgcattcaaatctccaaatgtgtcacttgaatatgttcccttagtcataattgatgtcgttgcaatatcattaaatgcatttcttgcgatcgttgatggtggtgtttcaccataataataaatacattgaagtgatgaacatgatgaaaatgcataataaccaattgattgaacattttctccaataaaaatcgcttcaatatgttcacaagattgaaatgaagaatcaccaatagaagtgattgaatttggaatatgaaatgtttgtgatgaatttccaattggatatgtaattaagtttgtaatatatttatcatataaaactccatcattttcataattagaaaatcgtgaattttcttctgaaactttaataaattgaagattatcacaattaagaaatggttttgatccgattgaagaaatagaactcggaatataaatatattttaaatttccacaattttggaacataaaatttccaagtatcgttaatccttcttctaaaattactgtttcaagatcagtacatccttgaaatgcattatctccaatacttgtaactgattttggtattgtgatattgattaatgacttgcaatttgagaatgcactttctgatattgtttccaaatttgtcccaaattcaacaatttctaatttggtgcatgaaataaatgcacttgataaaattgttttgactgaatctccaatttgcactgttaataatttagtccatatttggaatgctcttgatttaatttcttcaacatcagaaattataatatgttccgttacatctttataatctaccgtaaattcactcgtttgtgtaattgtaagtgtttttgtcgtagaatcaaatgtttgtaatgtattgatgaaaaagattaaaaataaaaatgaaatatttcttttgtttttattagatatttttttatgataataatataaattaaaattgatgattttaaaagaaaataaaatattaataaatataaacaatatattacttgataatattttgtttctattgttaaaaatattcaacaaatttttcaaagaaagattaaattttatgaatttcattttatttgtaatacatattaataatttactttttaaatctgtttggaattgaaattgaatttttttttgaagaccatcaaacaaatttatcgaattcttaatgttatatttaggacaatataaattacatgaaataacactgtttaaattgatgatcgtttgtccaaatttttgtgttttcaaagaatcaaaaaataagatctcatattttttcaaatttatctttttattcgagaaacgattaaaagcatggttttgttgataaaaaaacgtgggtatattttgattttgttgatgatgaaagaattgttttttataaatcgagattgaactgtaaattaaataacacatgaatgggagcaaattgaacaattttacattcattcgaataacattggttgttagcattaatttcgtttctttggaagaaaaatgaaccccctcattttatgcaacgcaagttttcattgaaaattgagtgttgcgtcaatgaggattgaaatgctatgaaaagttatactgaaatttttaacccaaaaccgctgggacaccagcacagaaaaacaactttcggatattaatcatttcgtcattttgatgcaataattataactaaaggtgaatatgaagaaatatttgatggaatgatatgatcataattggaacattacatacacattcagctacaaaacattttcccatagttatatgaaacgaaacactcaattttcaatgatgtactgatcttaattacatatccaattggaaattcatcacaaacatttcatattccaaattcaatcacttctattggtgattcttcatttcaatcttgtgaacatattgaagcgatttttattggagaaaatgttcaatcaattggttattatgcattttcatcatgttcatcacttcaatgtatttattattatggtgaaacaccaccatcaacgatcgcaagaaatgcatttaatgatattgcaacgacatcaattatgactaagggaacatattcaagtgacacatttggagatttgaatgcaatcaaaggaacaacgaacgaagaatgtccttggccaacacaaacatttacacaatcgaatacatttttcattaaatttaaacaatcgtatgcattcaccaaatcaaattcatttactaaatcaaatatatttacatatattgatccagatttaacattcacgaatatttatactttaacatattcattaacatttacaaaaacattatcatattatttaacatttatcaaatcatattccattacaaatactgaatcagaatatcgatatatttatacagaaattatttattataattatacaattatcatttattcgacttattatgaataatattattccaatttttattcaatatattattcgaatgaaaatatgaatgaagataacaataacgataataacgaattaataattattgtaattgtttgtattatcataattattctgattgttataacattacttgttgtaataataaaaagaaatcaaatactaaaaatgaaatatgaagaagaagaagaatatacagaagaaggaaacacgaatatattatcgatagggattggaatgtcacatattgaagaagatccatttgcgaaagattttaaagaaaatgaattcaattcacaaatataattttttattttaatgttattgataaatttttacatttattccaacatcattaaaatcatataatatattatctgtattaaatcaattttaaccaacggatattttaataataatttaaaagttaggagtttcaataatttgtttggtaataataattatattaacacagaaaataaaacacaaaaattttaattaaaatcactgaatcgaatttaaaatgtgtctgtgatgttcttgaatcatttccacaattttatgctatttaaaattttcatatatgtaatacattaaaatatccaaaagaatattaatttgatttaataaagttaaagtcattctcttgaattttccatttggtattgcaacatttgtcatcatgtttatctatgttcataagaagaaacaaataagtaaagaaagttctttcgaagaaattgaaaataataatactaacagattaacatcaaagaacacaacagatttcactattggggaatatctgtttgaaaatgattttgacgttgaatttattccaaatgtttaaaccctttgaataaaacatcaatatatagatctatatatcggaatacaagaaaacttatcgaacattttacgtgtgtatacaaggaatttgtgttacttctttgcaaactttcatttgcgttctcggcttcttctttacttatttttaatgttcttgtataacttacataagcttcattttttataaaagagctctgttttaactttgagtttgtactgtttgttgtgtatgtggtgtatgtgtttcttatttcattgtactataatatatgaaatgtttttttcattcatcatgaataagttaactctctagtatattttttctctttgccctcatcaaatctaacatttaaacttccaaatgttacatgaatattgtttcccttgtcataactgatgttgcattgatataatcaaatgcatttcttgctatcaattgatgtttcaccataataataaatacattgaagtgtagacagaattatttttcgttggtcaagcatgaactgcacattatatagcacttgaatgggaacaaaacatacaattttacaagcctttgattaatatttgttgacagcattaatttcgtttcttcccaatattaacataccccaaagcccctcattttctttaacgccatcaggaaatcggagaataaagcacaagtctgcgctttttgacactcagttttcgttgatttttccagaaaagaatttatacaaagcgattcttttattaaatctatattaaatgtaaacaaaaaattagaaatcacatttctctttttatgtttcgtatttgaattaaaaagaatatgtgtatttgagtggtggtaaattactaaaatttattgatgagaaatgtgaaaaatttcaccaacattgcaaaatactctcaacacgctacttcttattgaaagtgttagcccagtctcttgaaaacagatcaactttaacttgatatattatttgaattttccgatatttcaacttcttgtttttattttagtaaaattaaataacaaatggttgaggtaatgcaggcggagatacaagaagcaaaaatattaaatgcaaattttcgtaagtttttgtcatttgaaataaacacagttgaaaaagatgtggctcctaaaacaaacaaaataaataatagtgcaaaaattgttgatttgtcatttttgaaaaaaaatgttatcatgacagaaataaaaattcctgccactattgaataaaatattggtctatttttggtatcatatatatttgacatgtcgttgttatctattcttatatcatcgagttcctcattttcaagcattttccccaaaattttaccaaacggttttttgaatgaaaatttatatttcacatcaaatgtcataaaaacctttttgcttttctcgcatgttttcatatgaaattattttaaataaaagtaaatcattaacataatatttaatattttatatgctttctaacttctgacgccaaagtgaacaaattcattttcaagaaataaaaattgaaaaacgtaacaaccaaaacaattaaaacaagaacgaaacttcttcgttttgtttggtggcacaatacaaatccggatccaattgctacaaatattcttccgatcaatgctctcattaaacatgtatcatcttgagatgaaatcgaaaacaaaaacacacaaatcacagcaaagaacaaaaacaaaacaaaagcaaagcctttgatatcaaaagaagtcataaaaggccaaaaaatcgggaccatcaataaaggaactattaatgaattaaaatcgttttcgataaaacattttataagttctttcgcatcgattttgttcataacaatttgaggaattccaatcttttgatcaacaaaaatgataaatccaatgcttaaacagatagaaagcaatggaataagtatagagagcaaagaattaatggatactatgtatattccaagaattggtataaacatgataaagaattcaattctaaaagtaacacaaatagaggctaaaaggatagaaactgtaaagcataaaagccgcaaggcacgattttgtacatgtgtaaatgatgtgagtagatatattgaaatgataaaaattaatagaagaaaagaaaatgaataagattgtgtaatcgtgttcacaaggaaagaatcacaaagtgatgatagtgaaaaaagaaaagattgataaatattattggatcctgatgaaataattgcacattcaaatacaattattaagcttgcaagcaccgatttgacataagtaatcttaggacatttgctttcaagatttataaagaaactttcgagcaaaaaagatgatttataattttcatttggtttttgaatataagatgattttttttgcttcgcaaaaataatgtaaaaaaatgttgcaacaaaaagaatagagcatgttaggaatgaatatgattttggtgcaatttggatttcggattttatctttttaataacttgctttgtttttttagtgtgatttgggataaatggttttacaaaagtttttcttttaatgtaacgttgttctaatgggcgttgtttgggcatttttcccaacaaatcgctcattagagtggcacttttttgatatggatgaacaacaaaacgttgttgatgcctcaaatcgttatatgttcagccaatcaacactcaaattcctccaaaatcaatttacacagaatgtaacacatcttgatctttcaagtaatcatattgatgaaaattgtgcaaatttaattgcatcaaatttacgagatccacaattttcccttacttctctctcagtaattcaatgtcacatgaatcataatagcacaaaaataatatttgatgctattgcaagttcaaaattatatgaattttatgtagacgataatttattagatattgaatgctgtcgcactctatctcactcaatttcagaaaatccaccattacaattacttagtcttgttggatgtcaaattgatgatctatcaagcatcgaactttttgaaggttttaagcaaaacacaaacataaagcatcttcgtattgattccaatacaatttatgacaaaggtgctattgcactagggaatctttttccaaatcttcaacttgagtctctttgcattagcgacaatcaaatctggcaagaaggcaccaactatcttcttgagaaacttcgtggatgtcaaacacttacaatgcttgacattggatacaacattattgacattcaaaatttgataacttttttaaactccgctccgaaccttgttcagctaagcattagtggctgcaaagtaaacgaagcttttttagatgaactacttttaattctttgcggaaaacctttaacgacgcttctaatagatgcgcttaatttcaatcagcttccgatatcttgggaaagtgttcgagaaattacttggtcaacgcatcttaaatctcttatcgagctcatcaaagcgaatcgttttcttgatgacgttcgtatcggctttttgagtccagaatcgatttcagagcttaaacagtcacttaatggcattgaaaaaaccgtcacgatttcacttcatgatttcggttatacccgaaacacttggcttttacatattccccaatttgaattagaatcaccaacagatgttttcgaatggaagtctcctgttttatccggagctctccttgctgaggtttttaatatttctaaattcaatggccatcatcttcgaaaaatcaattttcatgatatgaaatttggcgatgatgttatccaacaatttctacagcatctagatcctggtgaattccttgaaatgaatctttctaataatgatcttcattctacgacaattgatttccttcttaagttcctagaaaaaggtgcatacatacataatatcaacctcgatcggaaccggtttaatttattatcattccaaagttattttgagtttcttgtcaatgatatcgataaatgtccgcgatcaattgacatcacatttgaaagtaaagagattcaggaaatgactctccatctttttgccattcttatcggcactcttcttgagcaaaattgtcatttggaaaatttacatattgaaggatcgatcacatgctctgacgtgaaccatatcatccaacaccttcggggcaacacaacccttcgcagggtcgagtttgagagctctttgttccaaaagtataaaagtccagatccgccacttgatgaagaagtgaagaaagtttgcggcgaaatggtgcgcgaactgtatgagctactctgcggagatggcacggaatgcgttttggagtcatttgtgttcccaatgttgacggaaatttatttgtactcggacgggataatcgaaaattggccggcgatcacaaataaattgttggaaaatgaggataacaacgcaaaaaatgtataaataaataattaatgaatgtgctttacattatatgtcatctgttgtataaagattttttgttattaataacatattcaattgaagcaattttatgaaattttaattcagaataattgttcacataattcttagtaaaaacatgttcgatgtgttacgaataggcagtgatttcgtaaatagactcttttcctgaaaaaaaaataattttccaggatattcacgaaaactctttaaggtaactcatgcgaagaaatatgataaatgcgttgtctgtgaagcaataaataaaaatcgatttatacaaattaacaaaatatttattgataaatttatatcttgaaatctacaaacgaagtcatttccattgccatttccacggtgaatttagtccctttaagtaattcgctcttttcattgtttggtaattttctgaattcttttataaaatcgatttcaataatttgtctatttgctgctatacacctacctctcattacgcacctctgcatagtcttactgaatcctccaacagatttcattttattttccaatatttgataaagttctttaaattcgaaatcaaatttttctatttcgagtgtcaaaaccgttcctttatcggttcctatcaaaactaaacggtctcctattgaatctatttttgtaattttttcgccgatgttaaattggttatcgatttcagttgcgtaattatttgtattaaactcttgaaccacgtttagctgataaacattacctgtttctgttccatatattatgaacatatctaatgctgaaattgcggaaattttttcttgagatttaaatgatggaagttgaatcaattgattaaattcttctttataaacataaatatcataatcagaactaataataaataactttttactagttccaattcgtttaattaaattaaacttcaatgtggtgaatgagatattttcaacttgttcactgttataattaacggccccaaactgaatttctctttcaaattgaaagtacacaaaacctttgaatttccccgatcggaataaattcaatttaaacgtttgatgttcacccaatttgactggtttaccatttacaattctaaatctgacaaaaatacgattagaacaaattgaaaaattggggccctccgaatggaaacctgcgtaataattattgttttctattttataaaaaggtttaattttatgttctgcttcgaataagttctttgtcaaatagaaataatatttattatctactttatatacagttagataataattatcaattttatggattctaaatataccatttttagcgtaaaaaatatttttgtaatttaatgtgtttgataacattgtcattattaatgaatcagaatcaacaacaaaaagttgtccatcaatataagaagctgatataaatgaaggcgaatcaattgaaattatttcatcattatgaattaaaactggtttagagccacaaataattgcggatttatttgttaatttagtaaatgaactataaaatccttcgctatataaatttgttatgtttttggttggaattaatacttttattatcttattcgatatgttaattacataaagattattattaagtaataacatttcttttgtgtattcaatttcgatttgggaaatttgttgatatgtttctaatgaatgaatatatacagaagaagttgtcgaatatacaaaatatttgtctgatattgtgacgctattaaatatttcatcattcattgttaatgtctttaataaaattatattgtcatcatttaatttataaataagtatcgagttatttaacgataatattatattcgttttggtgattgaagctgatataatttcgtcttgaatatcaatagttgtaataacattattattgtcaaatattataatacttttaattgtgatttgaacaaatttgttatcttcaatttgcaaaaattcaattgtcggaagattataatcaatatgacaatcactaagttcaaaaaattcaccaatatcattcattgcaattatattagaaattattccattcgttacaatacaacataataaaccattgtattcaaacgtaaaaactttggtgcaattggggcaccctattttcactaactgttttaacgataccattttttctgaggttgatattgctctttgataaaatgtaaaaattttgttatcaaaatattcaaacgaaaaagtgccacctgtgcttttgaaggtctcgagctcacgaacagtgcatggaagtgattcttgatcaatattatataaaacagaatcactatcatttgatgcaataaatgcaagagatgatgaaattgataccgaagaaattggttgtggtacagatattccaaaatcaacaaaatgaacaggtccttgctcttcaattttagcatacctcatcgtgagatgagaatcaatggaaacataaaaattgtgactcatcggaaacatatcaattatttgatatggagtgaaaatagtagcagtggttgtggtgggagttaaaccatcatacattatgcgtatggcttgctgagatgaaaaggcaatgattaatgatgagttttctggatcatatggaattatcttgtatgtgtcattgggtaaagtaacgtccatagaagggtcagatgtgaaagaactattcataaggtcgatatctataacacgtaaaattggtggcgtattaaattcttcagataaaattgcaagtctggtaactttagatgttgggccaacaaatgcaaaatctatgatgcgtttacatccaatagttattggaagtggagggtcaagtgtacaatgtgaagaaattggaaaaacttcaattgtgaaatttgtgtatttaataacaattgctgttggatgagttgctatcttaattggtgttcgagggaaattgcttgttggtgttaaattaccagttgctaaagttttaattttgattgaatctgaatcaggatcattttgtaaaatacaagttcttaaatcatttaaaattaacatcattccagattccccatatgacatttgaattggtactattttttcaatttcaccataaacttgaaaagaatttggttctccaataaatccatcttccattggataaataataattctatctccttgtgcaattgctaacacatctaaagtaggcatgaaagattgtattatacatgcatcattcgctcctgttggctggattacttcagagagcagcaaatccattttatagccgtttattaactgtttcaatgcgacgataaaaaagtgactattctatgatatcattttcaatggaaacgattatttaacatttaattttctcgctagaaatgatcaccacaagaaaacataaattttattaaaaatatttaccaaatgaacttcatgaaagattatcttcgcataccattaatatctttgtagttctttgaaattttaaagatataatgttttacttttgattttaataattattaaaaaaaaaaatacattttatttttataattatttgattgtaaatatgattgaaatagggaggcaacttgtatatgtcattataacgactgaaccattctgttgcttaagtatttgtggtttcaaagcttcactcttagatattaattcgaatgctatatttgcttctttttcttcctcttgattttgctgagttattctagtatcaacaaatacaatactattctttggaactagctccactttttcaatagaaaagtctacggttatttcctgtttggtcggttgtttggctgttattttaaacgtttttttatcgtcttcactttgtaaactgaaatctgacaaaaatgtcattgttgtcagcaatgagacagagaaatcggaatctttcagattcttttgtaggctcacaatgaatggctggttttgggagaattgaagtgctccttgtgggtaataagagattgtatcaaggggtgtttgatttgttctggcgcttgtggtttgagttgttgtccttgttattgttcccagtgttgttgtggcttgagcatttccagagctagatgtatccaatttgtctgcgccaatagttttactctttggtggcgcacgttgactaagctgataaccgattgtcccgaatttgttgaatccttttagggtatattcttcgagcggctttggaatttcgatttcagacctatggctaagagttgtgtattgattttgtggaagatctccatacgtttgggaataatttgtcgacgtttcttcctttttttcttcttttttcgaaaaatctggaatctgtttccattgttcaattggaacattataccaaaatttggatacagtttcagcgggagcttgttgggcaaatcctaggccacctgtttctgtacttgttttcccgaaagaaaattgtgttccaagaccagtacttattgttgttgcctgccaaggtgcactaagttttcccgttttgacataatcataaaatcgaagttcttcaactgtatagcaagcgaacagttcaaggacactaatgtgtttggaatgataaactactcgatttctctcttgaccatcttcttgctcagattctttaaatgggaagcctttggttgttattggtacctgaaaatcttgttgggtcccaaaagtagatcctgctttccaaccattcgttccaaaacttgtagtaccaaaattactctttccaaaaccattcgttccaaaacttgtaaaaccaaatccagtcgttccataacctgttgtttgctgttcgacttttacaccccatccacctaatttactctttgtgaatgttttttgagtggcaaatgattgttttttttgtccaccttgggtactagtaccaaatccactttggccgtaagtccaagttgtattttgcccccattttgatgtagaggttcgagaaccttctttgttatctttggcgttagagttccaggaagaatttgttgcgtttgcccactgatttgtggttttctggccccaggctgttgtgccaccaaatgacatttgacacttttttataaatgatggttttttgtaaaggtgtccgttaacaaaaataacatttactaatgaaaagtgtttgatatttattttgctgccagcatctgctcaagctgggcttttaattgggctgtttgtctcttgagaaatgagacttcatctgcatgttccttctccttctgaattctgtaatcttcttctcttttttcaatgctttctatttttgcttgaagttctgctgctttaagttctaattgacttttttcttctttcaattttatattttctgcttcaacttcatctttgccttgttcaacttgtgttgcttttttcatgccccatgttatagcagattcatagagtgcttgataagcggcaattgttatccgtagctcatcacgcacacgaacgagaagtaatccacgagctgaacaatcaatggtaacttgacgtatgatttcatcaaaacattgtccatagatttgtgatctaactggacaaattcctgactcacgtgcttttctttgagatatcattttttcaagttcttgctgaagatggataacatctgttctagatgctggagttgagcttacatattgaatataatcttgtccattttctgtgaattcacgtgggggtaaaattgaatttaaaacatcacgagtaagtgaatcgcttgtttgctcagttttcttcgtttttttcattgcagacgcggccaaaactggaacatcatatttcaagagggtttcttttgttttttctttcattttaagcaaaaaacgtacaaacctggaagcaaaaacggttaaaaagagttcagaaacaacaattttcaaaagatttctttataataataatatggtaataaaccaaagctgtttattccaaacataatgtatttttgaatttcttctgttatatttctagatattataattttatattttgtttgaatttaaattgattataatcgttattgtttcaatttacagtatcgtttttgacggtttcctccaccccccttaagtgtacacttccaatttttcccatttaaaatcttcttcatacaccaaattttgtttctcttggtttgctgtgtcgaaagtaattgatctattgattctccttttgtctttgatggaattgattgtttgtattttgtttcctttaaatttattataaactttccttaatttaaaatttgtgttgctgtacattaaattatagattatagttagcaaatttctcccaaagtccatttttgcctccgccatgggagaaagaaagttaaactttttgaatgaaatttgaatactttataaagtatttaatgttatttctatatggaaaagtgctatatcatccctgattaacggatatttaagatatgaaatgtgaactccgatagcaaaagttcagaaaattgaaataaaaatccaaccgttaaaaagcaaacaaaatttgagcacatttccctctagtttttctgagtttatttggctgctgccctcgtgcggtcttttttttttgcttgtgtagatataagtaagagaatgacaaataagatattttgattttatgactaaaaatatatattaacattaatatcaattggtacacaatattccttcttgtttaagaagtaatttaactatttctgtataaccatttgaagatgcatacataagtgctgaattaaaaatttgaagtaatttccaaatattattttgaaatatcaaaatattaaaataaatatcaaataaaacaaataaatatttttagcattaatatcaattccttcttgttcaagaagtaatttgactatttctgtatgaccatttgaagatgcatacataagtgctgaattaaaaatttgaaattatttccgaataatattttgaaataccaaaatatgaaagcaaaaattatctttagcattaatatcaattccttcttgttcaagaagtaatttgactatttctatattattatatgaagatgcaatcataagtgctgtttcaaataatataaataatttccaaatattattttgaaataccaaattattaaaataaatatcaaataaaacaaataaatatttttagcattaatatcaattccttcttgttcaagaagtaatttaactatttctgtatgaccatttgaagatgcatacataagcgctgttttaaataatttaaataattcccaaatattattttggtatatcaaattattaaaataaatatcaaataaagcatataaatatctttagcattaatatcaattccttcttgttcaagaagtaatttgactatttctgtattaccattccaagatgctctaataagtgctgtattaaataatttaaataatttccaaatattactttgaattatcaaattattaatgcaaatataaaataaagcatataaatatctttagcattaatatcaattccttcgtgctcaagaagcaatttaactatttctatttggtcattttcagatgcaatcataagtgctgtttcaaataatttaaataatttccaaatattattttaaaattataaataaaaataattaatatattttacattaatatcatagctattttgcttcataaaatatttaactagctcaatattccgagattttacagttgatacgaacattgaatcaggaaaattattttcatttttaaactcttcaataagatttatatttccattaacaactaaattatgcattaatatatcattgattttatattcttcttttataaaaaacgaaagaatctcataattacttaaagaaatacataaactcatatatattaccttataattaacctcaattttattataaacatagtaaaatatatcatttcgatgaaaaataattgcaaatttacataattcttcatataactcatgcgtttgctcacaaagatgaagaatttcgatgtttccacctgcaacagcaaaaacaattgtatttgatgtattagcgccatttaacattaaatatttaaaacatttaatagatccaaaaaatgctgcataatcaattaacgaaacattattttgattaataaatgaacatctttcatatggagatggttcaattatttgattaatatcaaaatcattttgtgttgatatttcttgaagtttttcgatttcatcatttcgaattatttttgaaatttcatttggattaattccttctttcatatatttcttatgaagttcccaattattcttagaaagaatactatgatttacaataagataaaaccaaatcgattcaatattatcttcgtcaaaaaaatcatccatcgttggctgtataaaatttaattctttaatttcattttctgttttataatgaatgtaatataatgaattcttattttcaataactttagaagaaataagattcttttcaaccatcatttcgagaaggtaatgtgcccctttatgagaaaaaaatgtatttagaagaaacaaaaaaatatcaaagatatttaagccatttttgttaaaatgcttaccaacttcagataaaaagtgtagaagcatatttacatcacatgttcgggaataataaaaagaaaatgtgattctacatatgagaaaacaaaaagaaaatggattatttccatcaaataatgagatgattttttggagggatgattcaatattttcttctcttaaattgaaaatggtgtcttcaataaatactactatgtttaagtattcttttccttgattttttggagaagacattgttatttataaatatttcatttgtttggattttgatcgtaaaccaccataaatccttgaaattttattccaagttctcgcgttctatatactaattgcaaacagcaacctgtatactattgtttacatatgttcttcactaaaatttatatgaaacaaacaaaaatatttagttatcacatatcttaatattagaatatggagtttctcttttttgcgctttcacagtttctgtttcctcgtcaaatgattcattccaattcagccatcctttgcatcttggagaaccacaacaacattttatacgcttttcttttggttcatactctattttatagtcataaacaagttcttcatagggttcaatgtcgcgaattgcacaaattattatgtgtttctctccaaaaaattcttcaagaattgtttcgcaatttggatcacaactatggttgataaagcgcgctttccctccaacccgagtggcatcaataaaaacatcatcagagagacggaaaatatatgatccattgttaccttcgcgttcatacattttttgtcttttttcaacaactgataatcggattaattcaccaacatactcaatcaaaggatcgcctagtttgtgtttacgtgttgtaataacaccccattgatgaataatggaacgatcatatcgtaatgtcatagagttggatcgaagaacgcgttcaaattcttcaatggtatcattctgaagagtttcagcttgaggttgcattggagtggttctttctttttctgaataataccatgcacgagtttgtgtgatttgctctggtgttggtcgatattttagaggattcagtgcatagcacgacatgtcatgcttataatttttgacttgtggatcttttttatagctaagatgagcaaacatttgttcagagaaatgtgatatgaaattgaagaaaggagattaattatttttttagctttataacaaattttttcatgaaaagattattttttggggatcttgatccaatttaattcaaaattgaaaaattttcgattttaaaaatagatagaaaattgaagtaaaatattttaatctagatttttttgtaatgagcttatattttcattaggttcaccgaaaatccatttgttataattagaattatgttcttcaaaaccattgttttcttcttcatttatgtttacattgaaacaaacccagtcaattttttgctttttcaaaactcaaattaaaaatgaataatcacgaaaatgatttccaaattttgcgaattgtcattgcttctaacatcagtggaacagtccttgccgattatgctctaccagaatggacatatattaaagaagataaagcaattgcaagacttttccaaacattgatgtcgattccgaaagaatttgataatgaaagcctaaggcaggtttcattcaaggttggagaagagtccatgccccaagtcagtcgacattcaaatgctggtattcaaaacacaaatttgaatcttgcaatgacaatgaaaaatgatattatagttggtctcttttattcagttgaggatgaagatcagataccaaaattatattcaacatttcaatctttaacagaacaattatatgaaaagttcgcagaagatcatcttgatttttatttgtccataagagcagagctcgagaaggcattccagctcagcgaagatcttccagtcgaaatcaacagaagatttgcaacatttgttgataagattcctgctttactccatgaacacaactactgctaattttaaacgctttcaagaaatttccaataaatctaaatgggcttttttcgataaatatcaaagataaatttattttcaaaaaatcgaaccaaccacaaatggttcattctttggtgaaagaggtttttgtggtgaacgattttgtatcaaattatgttatttcgaagtctatttatttcggacctaataatattatttgattattgttggtggatttgtttgatcctttaagaatgggtgattgagtgcttcttttgcagttggtctttttgtgtaatcaatattcaacaatgttttcattagatccacaagtccttcatccacaatttgagaaagctctggtgcgaaggcagattccagtgatttgattggttcatcaacgaattcatcatcaatgtcatcatcaatttgaattccaatttgatctgcaattctatccaactcattaccaccaaaatattctgacattattataagtgtttgagggcttgacctagctttccaaggaatatcgccatgggtcaaaatgtagaagataagcactccaaccgcccacacatcacaaccgtaaccgtaattggtgtaccccaataacatttcagggggcctgcaatgccttgaaccagcttttgaagacatatcttcattcgcaaagcatccacaaccccaatcaatgagcttcacatccgtgaaattatgcatgattagaatatttccgagcttaacgtctctatgaacaatccctaatgaatgtgctgcgtcaagtgcttgtaaaacagatcttattaaaaaacgtattcgatttactgtaaattgttcaaagagatggttgggatcgattcctttaagaagttcaaagaccaacattgtttcttctttttcgattacttcatataattgaacaacatgtggtgcgcctttgagtgtttgcaaaattttaacttcattattaattaggtattcacttcctctttcaattagttttattgcaacttcttctttttgatgatatgttccacgataaacatgagaaaaatgtccatgaccaatgcattcatcaaactttaagtacgagacataaggtaagtattctggaatgtgacgttttcggttggggcctttcttttttcttctttccattagccctcagaagaaaaattctggccaaaatcctcaaataaactattcaaaaagtttttgggctaagccagttgagtggtttacaaaattgaaggaaatgaacccacaactcatgaaatagatttccatagcaaacaaattccaaataaaaataagaaacgctacgattaacacttttctcgaaatttaatataacaaaaagattcgataagtcaaatatttttaagcccatgcttgatcagctaatgtataatcatcaacatatgggtttctgtttccttgtgtttggttgatcctatcattacgtgtgatttcttgttgtgttggtggatgttctcgattccatttcaagaaggtattaagttttccgacatcagataacctatagttgtcatacattgtgaagaagtaaagaatgccacgagcaatttgaccacgatcttcaactcttggcatgaaagaactactgtatgttaagcaagaataatcatctggatttgatggtcttgtttttgaacattccaggtccctacagaacttcatacattcactataatcaacttcttcaaatgggtagtcagatcttgcactattgatttttgaagcagatggatagagatgatgaatatcagaaaccattggggtcttcttatcaaagaaactttgaggaacactatgttcgcagttgatatcagttgcagatggcttttcagttctgccacatttccaagggtatgtagtaccagagtacatcaaaaacatttgtccatcagtacagtcaacatcattgtacatatagacacgagcagtgttatatgagaatacggtatgtgcataatattctttcttgagtttctgccttaaagcctcgcctttaaggccatttgtttggatgtattcgcaggaaagggaaagaaagaagaaaagcattcgaattaacagtctcaatctgaattttgaaccgaagccattgaatttgaatgcatacaacaaaagctttataaaacatgacacttttcgcattcacacagaaattggttttttagaacgatggaactttctatataactgtttatcgtttgtttgtcccacatcataaatattaagatcattaaagatttattgaccaattctttaaggaagaggacacagaggtgtttcttaattgagaatagacattcctgcttgattgtattgttggcgagtaataattctttgagggaacacatcaagacttgcaaatatcgaaccaccaatccagtcagaatacatcggctgtggtgaaaggacaactttaacattcgttcctttaggcgcctagtttctaatttccatctcgaggcgttctttgaatcctttaatcatagtgttaccaccagtgaggatgatattcgaataaagcttattacgtaagcatttatagagttaaaaacaatttgatcaattccgtcataactaaatccattaagatatgtaactgcacattgaaattgttcttttccgaatttgattgtacttccatcagattgtgtaaacaagagatcgcattatgttgttgttgtcgccaaattataatcaagtgcaacatacgcatggttttctttgatgctattaaagtatgacttcgggatgtattgattaattgtttgatttcgcattgtttcttcttgtagatatgtggttacatcactccctgcgaggttggtgcatgccaaagcttttgtcatgatgcgcccttcaatcattgggaaaacctgcgtaattccatcgccagactctaaaacaataccagacgtacgacatgaatcatacaatgcaagattcggttgcaacagaataaaaaaccctctgaagttatatgtttcaaatatgatctgcatcatcatctcactattccgaatgggcaatttggatgttgaatgatttcggatacttattggctcggacattaatacattggataatggtggatcaacttgaagttggtttttaaagatgtagctacatctccagatcttttccatttcatcccaatttgtaatatgtccatggctgattggatggtaaagattgagcattccatatatagattcagcttcagtaccaatatatactccttgattgggcaactgattatttggatatttgggatgaccagtcgtcgttgctaattatagtgggctgttcgtatcctgcatagcctgccttgatgaactttgacccattatcaacaacaattgtctggaagttcccgttcattaaaaagatgaagtgacacagataaagaaagaagaaaataaccgtaagttatttgacgtaaataaaagaaactttttaatgcttcagaaagtattgagttaaaacagaaatttgaatccaacgcacaaagaaataatttggttgtaaatttttcagaaggaaacacgaaaattcaggattctattttggaatgagcaaaacacaaagcatttgcttttttgatggttcctcacaaaaaataattaaaaaattgtttcatgttgattggaaaaataaggaaaaagaaaattaacccattgatataaatataactttggtagcacataagaatgaagtgggaatgttgttctgaatgattcaggatccaaaaaaagatttcttaatataattatgataatatgtaatgttgcagattcagggtgtgggaagcaacatcatgaggagtgtgattgaacatttgagcgttggatgttgaccagagatttttatctttatcaaaaagtgtcaatacgataacgttttctggtttcacaaactttttggttttgtgttttggaaatcatatatgattattggtgaaaatgagtgtaacattacatctatccaaacaattggaaataatattttaatggaatttcatttacttaataaattttaaattaattcaaaaaattaaagttctattttcaatcccatcgaaatgatatttcattatccacatgataagaaaattgtaaattaatgttatataaaaattagttggaaaatgtttgaaattaattttgaaatttattgaaagagaaggaatggaagacttgttaacaatgaaccatgactcgagaaatgtttcataaaaaattggttaatttaccttttctttaatacagcatgacccattttatagggtcattggataaaacctcaaaatttttccaaaaattatcgttgacaacatcgagtatacttctcaaaattcacagacttttgtgaaatcaattgaaaacgttacatgagttttgatttatattcaattcagctgttcaaacatccttcttccaaatcacttcatgtgcgccaaaatatttttcatctccatattctttattggttacacaagccaattgtcatttactaaggttaatgctttaggattttcaagttctatttccaatgttccgacaattcaagaaacatatgttccttcaaatacactatcttcgtcatatacatacacaatttctattactcaaatgccttcgcagacacttgtaggaacgaatacaatggtggaaagttattcattaggaaattcaatttcaaaatcacttacttctactcaagttccttcaaatactctaacaaatgttgatacatattcactttcaatcacatatatatcttcgtatacatatttgacctcatacactcaaaccatcataaattcagttacatcatctccatcatatattcaatcaagtacatttgtgacatcatatacaagctcaagttatttgtcatatgtttcatcaaattcaataatcctagtcagtacttctgttccttatacaacgcaaacaattgtaagttttcaaacattgatatcatcttatgttggatcatatacacttgttccttctcttgttagtactttaacaaattccattacatatacatattcaaaaacaacaacaaccactctaactaaaacagttgttcttacatatgtttcagcaattacaccaactttatctaatacatataaatcaacagtaaccacatcatattcttcagtatatgtaccatccacaacttacataacctcatatacatcatcagtaacattaagtgaaacatacactgattcatattcaataactgttagtatatccaggtcatcaacatatgttcccgtattgataccaactatggtgatgatgggaaataaagcaaacaagaaaagaaataataagttaatgacattaatatattctcctttacaagacaacaaaaatattaaggcaagatctggtgttcccccatcaatgatttctggaattaaacgaaaagtgtttattgatacaggatcatatacatggaaatattatacttattatttttcaataacaactgttgttcaaactcttacatatgtaaatagtgaaacatcttctaaaacaatggttccatcaaatactcaatctttaacacgtacttcataccaatcgaatacatatataataactcaaactctaacttcatcaataacaaagtcacaaataagcacaacaactcaatcatatacaaatactcaaagtgatacattttctcaatcaagcacccaagtaaagacatcaataacttcacaaataagttcaataacatcatcaataacaaattctccaacattaataacttcattatcagaaattgtacaacaaacaaatactttaacaggatcatatattgaagtatcttcatctataagtatattaactttatcatcaacttatagtttatcgccaactcaatcaataacaaatacaccatcaaatacaccggtattgtcatcaatgcttacatattcaaacaatatattcccctcagaaacaatcacattaacttcatcaataacaatatctccatcattaacagatagttatgaatattatgaatcaaatgtaatgactcaaacgcaatcattaacactatcaaataatttaatacaaattaattcaaatatgaattcaaattcacttactctctctcctacattaactatgatagattcatttattttatcaaattcatataaattatcatatcaaccaacattaatacaaattgaagttccagatccaacaccaacacaatcaataaatgaagaaatagaagaaattacttatacaattgttgtaacatatgtacaatcagcaacaaatacaattgctattactcaatctatgacatttgaaaatacatatctttcaaattcttatattttatcaatgttaaattctacattaacttatactaatacagaacttattttttataattatactattatgcattttactacatatcaacaatattattcaaattacttctatgtatatgagcaacaaatcttaacaacaattaaaaaacaagaacaatttagtattggaattattgcaggaattgcagctgctgttgtggttatcattattgtaattattgttgttagcgtatactttagtcatagaaaaagaattaatgatgaagaagttgtcgaagattatgattataaatcaaatgaatttaatagttttactggcacatctgcattaaaagaaattgatgaagatccttttgcaatagatttcaaggagcaaaagtttgttaccccaatataaaatatgaatctaagaaatagattataatagtaaactttttcgtagtaaatactatttttattttgtgctttactaatttatataactggttaattctcagtttcataaataattttcttaaacgtgaaataatttttctttgttctattgttttaaatacttttacatattaaattgaaatcttttctttcttaataaacataggtttagtaatttaactcttttatcaattttcggtgttgctccttatttcattgatgtatatatgcaaacgcagcaagagaatgtttgcaggttcaaagaatggtttagatccccatctttatgtattcatcaactcattttatcgtgttttcatacaattttatttcattatccttaaggatgaaataatgaatgtgcatctttcaattaaataaacgttcaccctttttgaattatttacaaaatgcgcaatgtttctgtttaatgttttttggattttagggaactttcaaatattaaaggacagaaacttaactatttctcttgacggaacatgggctgacacacctcttttgtctgaagcagttgtttttatcgcagatgcaaatggagaagcttattggacatttattcaaggacttaaaaaagataacgttttacctcaaactatagatcaaatttacaaatattctcttgattttttatctgatgaacttagatcattacttcgtctttcattagaaactcgtgcttattcgccaagaattgaattctttcgtcaaatagcttcaaattatacatctgattttaatgaaatttttgctattctttcagatacaaaatattctcaaatccaacaattagaaaatgagattaaaaatcgaaaaaaaagtcgtccaactgttttccctttcgaaccaaggaatggggatatgagagatacaattataatttatggacctctttctaattccacaatttatgaatttttcacccttattgaaaaatacaatgaatattattcctttatatttcgaccaatcggaaagccttcagatgagccagttcgatttcgaggttatggtattgaacttcgaccatttaattattcaatgacatatacaacccttaaagaagaagacataaaacatggtcctgagtccgaagacactcctttgatgaaagaaaagcatataattccgggatcatcaattcctcaagtatcaaaattgccttcacaacttatccaattctgcaaatctacatcagatccattctctacgttagttgaagtgttacaaaactttccactttttgcatcaaatatatctaaagtatcatattcaccaagtttaacatctaaaatcatgtctaaacctgattacgttattcctggagcaacctcactttatgttaatggacgtattattaaaactccagacatatttcatattattcaagaatctcttgatgagcttagaattgctcaaatccttacagaacactttggattgtccaagaaatcactaagcaaagctcttcatgctcagccagccaaaattcctccaaccaaatatattattgattgtcgatcgtcttttatgtattcgttaaatgacattgaatatggaaatgcatatcgaaattggacaacttctctctcttctttaatgtctgatattccccaaaaaattcgaagaaatctttttaatgtcgtatttttgattgatcccattgataactccgatatgaaatcattagagtggatggatgaacaagttcgaacagctgttccatttcgtttttcatatattgtaaccccaagaaataattcaagatttgctaagagagtattatatgcatgggcacatatacgacttaagtatggagttgagaaaggtcatcaatttttattgtcaactaagaaatctcttcaaaaaggagaaaagctaaaagaaacccattacagaaccatatatcaacagatggtcaaatcttcatcacccaaatggcaaaacattgatgaattatttagtcccaaaagtcgagaatccaaacatattcgacggttacgtaattatattgaaaaagtgaatataaacggtcccggtctattctttaacggccgcttctattcaggtaaaagaggtgaattaaacatcgataaatattatataaaatcattaccacgattacgaaatttagttacaaatcatttatttaacaataaaaccaaagatactattgatatcatctttgatggtgatgatgtttttccacgatataatccaataattcaacgaactgataagacatcatctgattttatcaatttaataacacaaagtttttatatccaaaaagaatttttattatgggccaaacaagttcgatataattataccacaacgaatgaaaacgtaatcaaacattcgacatttttcatattcattggagaaaatttaacaaattcaccagaatcaaatcatattattactgaagtggaagaatttatacgtgataagatgacaactgattcacgcattgcgattttttgtaatggattccaaggaacattaataatgaatccacaagcaccgcaatttgtttatgatttaatacaacttaaatctgatgaaattacaattatattaaatggacgaattattcgacttaaaggaaattcgatatataaatggacgtcattagattttaatgttttatatcaatgggaatatcatcgatcgacatcgattgtacaaaacatttttaaagaagaagaaatcgaatttaattatgacgtcatattaaatgatgttgataacattaataataacttttattcggaactttcattatatttaacattattatatggatatttcacgcataataatatccaaagatatccaataaatattaattctttgtttaatcaaacattaccaatcctttataattataataataatgaagactcattattaaattataatgttatattaaatcctttcaataaaaatttccaaactattggaccgataattaattatttaaaaaacacaaaatcatttaatattaatatatatattaactttaataaagaattaaaagaattcccattaacattaaactcatttcataaatatttaattaatgaagataatgaaattatatttaatcgttttaactctaaaattatttattcaattataatgcatcaacctataaattggaatattaatgttaaaaaatgtgatttcgatatcgataactttataccaataaaatttgatcctggaaatattttactaaaatataaattaaattccattttaatcgaaggctcaatattcgataatgaaaaatatgttccaatgaatttaatcgatttaacattaaatggaaaagaaacaatttcattaaaaaacttcggatatttccaatttaatgtaaatcctggaatttggaacataaaactgaataaagtttcacatgatttatataaaattataaataataataatgtaattgtttataattttataccttcttggatgaatttatatatcgaaacaattaataaatcttcaaaaaacatgaaaaatgaaatcgttgacagcgtaattcacgttttcgttgtcattagcggtgaactttatgagaaattagcaaaaattatgatgatatcagtgatgaaaaacacaaaacataacgtaactttttggttcttaaataactttctgtctaaaacattcaaaaaagacttgaaaacaatgaaaatgaaatataattttgattataagttcgtacattataattggccaaattggatcaaaaatcagaatgaacgacaaaaagtaatttgggggtataaaatattgttcttggacgcattgttcccagcaaacctgtcgcgtgtgatttatattgacgctgacgctgtggttagaggtgatttgtatcaattgatgaaaatgaacttaaaaggaaacccgtacgctttcgtgccattctgtagcaatagaaaggatatgaggaaatatcagttctggaataagggatattggaaaaagagattggacggaaaaaattatcatatctcggcaatgttcgtggtagatttggatcgattcagaagaatgagcgctggtgataagttaaggaaacattataataagttggctggaaatcctaaatcgttggcaaatttagatcaagatttgcctaatgatttacaagatgtagtaccaattatgtcactgccgaagaagtggttgtggtgctgtacgtggtgcagcgaatttgataaggataacgcgctgattatcgatttggcaaataacccaaagacaaaagtgccaaaaattgaaatggcaaaagaatacattgaagaatgggaggatttggaagaggaagcaaataacattgctaatatgacttttactgttagttataatttgactgaaattagaagaaatcatagaaaattaattggtaatgaaaaattgaaaaattaccaaaaggaattataaaggaaaatgttattaaaattatttacttattaaatgtaaatttatatttattaatttttaatttaaaaatttttggaaactaaaatagaatacattttaacggtctctttctgttttgcgaattgttgaccgtttgaatgatcggtgttatggggcgctcctaataatgattgaccgttaaaatatacttaatgtctggagctgacttcattggacgtatttttaaattttaacatcagaggacgtcgtcataatgacacctgaagaaattgtatatgaaggttgtctcagagtttgtgatcaatccacgaatttgataattagtccagtaattgaaaaaaaaaatgaaaatggaaaagtcactcaaaagtcatatgatttaatgtttcttcgtggggaacaagtttcgtttattgcgccaaacctcaattctcaattacatagattcagtgaaccaattgtataatttgtttaaaaagtattatatataatttaaattagttgttttttgcaaattttactagtggattcattattataattttgaaaaaaattcatgatttagattttattgatagtttttagctctaaaatttaatctgcttttatctttccttctgcgtttggctctggaggctttatttcaggcttttctttctgttcttcttcttcttcaccatccttatcttctttttctttcttttccttttcttcgtcctctttcttcttcgcttctttttgtcgttgtctgttgtattctttgattgtgaatcgttttgtgaaatattgatatccccattgtagtaaaccaataaacgcaaccaatataattggcttccaattgttcagaatgtttgatttcgattcactttcggaaatttgttttctgataaatgttgaaaatgttctttcgccatctgtatatgtaacatgcatggattcatatgatgcaattcgaacatgaacaagaccatgttcttcgagatctatgtcacttgagacaaaaggaggtgcttttaatgtaaaattgaaataataaacactttcatagaatgtgatatttcctgataaatctttgtcgctaagattaatcaatgctgtgtcattgccaaaagatgcttgtaaatgattgggattttctttttctgaaatgataaaatcaattggaaaatttgaattatcagaagaataagtaatttcaccactccaatttcctactaaaatctgagatattgtacgcctagaagaaattatttgtaagaataatgaaaaaaacaaaggaaacatcgattgtcacttttacgcacaagtttctttggccaatttcaagcaaaaagaaaagagttgaacatttcccaataaaataagttgatattcgcttttcgtgtttagtttttattgagcttcttaaaaatttaatttttgacaaaatgagaaataaattgatatgccaatttttttttgaaaaactctattttttttaaagtgccttaaggaccaaaatgacataggatttgttcattacttattttacggaaaaacgaatcaagtacaaaagaaacaaaaatatgtcaattttttaactatgcagtgaatactctttaaaattttcaacaaatggaagataatgatcaaacaacattaattgattcaaaacttggtgacaacacgcaagcgaccttaattctttatctaactttcaaactacttccaattttttttcatagtattttaatttcatatttaccatttttcatattttcattactatcaattttattagtacttcttgatatatttctatgtagacgatattttagttataaacttgttggccttacatggagtcttaaatcaccaactgaagcgcaaaattcaaattttgtcactttttcatttgaaggagatccattcgtaccactttcgattaattcgaatttattttgggctacattaatttttgaatccatattttgggttggatcaagtatatataatttgtttaatgtaaaacaatttattttatctttgtgcattcttttgatccaaatttttaatttaattttatatttcaaatgttttcaacaagctaaaaaagaaacagaagacacattgcgaacagtaatgcttaactctgtgcaccagcagttccttaatgtgggcgaaacagaagatgaatcagatgaagaagaagaggaagaagaagaaaaagaagaaaaaaatgaaaattaaaaacgatttatattgatttttaataaaatataaaatagatagatgttttaaataatttttaaacaaaaaaatgtttgtacacataaattatttattacaattaaaaacatataatattgatatcaattgaaatttcaataaatccatttgttactatatttacaaatattacatcaaataattttaagaaatattatataatattttgaaattataactattaatgaatcggattcattaataatttcatctgtaatttttgttttaaatataacaaaatttcataattacttgattgaatacatttagttcctaattcttctagattattaattttgcacattttattttcataaactcagttgttgttcccaaattaaatttttggtgattcagcaaattgaatcattcgatgattgtatccaaccatacaaaaagtggaatttcatatctttacacagaaagacaaaaaaaatgaacttggcgcataaagtcgccaaaagaaatttttcaataaaaaaggagaggtctcgtgaatctgtgagaatcccgcgaaaatttatttttaaatctgttgaggctccacttgatttgcaatttgtagattatcttgaagcatatcctccaaatggtaagaaatccaacgaaataattaaacaaatgaaaaactatcaggaaagttttcgaattcttcataatgattttgataaagatatgaaagctgaaaatattagtttacatacaatctcaaaaattgtaatatcagaatatcttgaaaacaaagttatttttgcattaaataaatacaaaaaaatatcactaaaatatcatcgatctttacatgattattatgctaatgcttcgacaaaactttcacagtttgaaaatttcctgagccaatccattcaaaacaattctccttatatgataaaatatgacaaatttcttgaatcattaaaatcacgcgaagaaaccaacaagcatgttcaacttaaattcaagatgaaatcacttgagaattattgtcaacttcataaagatgattatcgtattcctatgattcatacagaagaacttattcaatctttacaatcagttagtgaacttgtagatattaaaaaacgttatgttccaatgtcttcttttgatgattgtttatattgttattgtattcggaataatctcattctcaaatttcaacaaattgtttctaaaatgccacaatatccaacaatcatctcacacaacatatttaatgagcctaaagtttcgcgtgctagttcagttggtactttactttgggctcaagctcagactactcgagggaagtcatcgatttcgaacagaacattgccaccaaaaccaaacaaagacatagaaaattttgactttgaaaattttgacacttttatcttaacgttcttcagcattttaagtgatcattttgctgaaaaccaaagtttatttttaattttaagatgtgcatccataagaattctttttgatttatattataccgaaaatgaaaacatattttctgttaatgaaaatcaagaagatttcattaaaaaatgtacagatataattgagctaactcccaaagatttaaaagttacagaagaaattataggaacagataattatttgaaaacatttgatgaaatttttcaagaaattaaatcatttgaaattgcatcacaacaaatttttatgctgcaattctatataaatcctattgatatgggaaatgcaatgtttgttgcaatagaaaacgtggaaaacggaataagaaaaattcataatgatatcaatttcttggaaatatcatttgatgatattttcactttgttgattccggtgttcgctaagtcaccaataacttgtacagattcgttggatagagtgctgaaaatattttcgcagttgaaactttcgatttctttggattacggaattatttcagttgcgtctgtcatagatcaaatcaaaaaaatgaatgaagcattgtaattgttattttaaaaactttcgtacgattttgtttttaataattttcatgtaaagtaattctttgctacaaaaagtatttatcacttaaaatttgtaatcaaaaataaaataatttctggatttaaagcaataaagtaaatgttgtatttacctttttgttttatatttttcattttctataaaaattattaatatggtctaaatcatttggcttaaattaaaaaaaatttcccaatttgtttaaaaaaagtacaatgaatttgacatttgtatcttcaacaaatgaatatttccttttttaagtaaaataatttagcaagaagataattaatataataatttattcatataaaatagtcgcgtttaaatatttcagaaaacaaagtaccttttaaacaacagtgctatttgttccatatctctctcagcgcttgatcatgcacaaataacagttccgccaatttcgacatctgttctctcaaagtcgctatttcatctctcagctgctcatacgaatctgtgtcttgtgctctgcgttcaatggtgttaatttggttctccaactttttgactttttctgctgaatcagatatatttgcatcattaaaaggtatgaaatatggcttatcccagctcacaatgatgtcactactaaacaaatacttttggaggcgttgttccgagcctccaataagaattggaagcagttcgtcttctttgaagtcatttccatcaaagtcgaagcaatcagcatcatcaaaaaactcgagcgatgggcaaagatgctttacaaactcaagaatttgattcgattgctcttgttttaaaaggccaatatttaaaaatcgtaattttggaaatagggaaatgaaacggagttcaattaaatctcgaattttattgccgcttacattaagctgctcaagatcaactggtaccttttcttcattttcaagaaaatctaaagatgaaagttgattattggataaatctaattctaaaagatgtggtggaaatgcacagcttattgactgaatttcattagatgaagcatttagcatttctaagtttggcaatttttctatgaattcgatcgaagtaatatgattattactgatatctaaaaatttgagatgcaaaatttcgcctagatttgagagatctgtgagctcattttttgcaagatttaaatgttgaagacttgtaaaatcttcgagatttggaaaaaattgaatgaagttttgtgatgcatcaatacttataacagtatctggttgtttaacttttggaaatgattttgcttttgtctttgatatatcaattgtgtcgcttatgcttcctcttctgtttgtttgcattgaaacgaccgtttagaaacaaatggaaaaagatgaagaaacaaaagcaaatagcttcaataatattgatcataaatacgaaacagagatagcaaacatgaaaaaacaaattgaggaatcatcttttataattgaagaattaaaggataaaatcaatgagattcttatcgaaaaggaagacttaacaattgaactagaaaatatcaaagtggaaaatgaagaactgaaacaagaaaataaaaaatcaatagaaaataatctccaaagtgaaatggaatatatttggaaagagcaatttgaaaaacttgaaaacgaatatggcactctaaaaaagcaaaactcactcacgctagatcaaaacaagaagttactcgatgaaatttccaatcttaaagaagttaatcaaaatttagaaatccaaaacaaacaaatttctgaatcacagttaaaaattgaaagcgaaaataagtcacttattcatcgtactgaagaacttgaaaacgaacttaatgaaatatggaaaaaatgtattacaatcgaagaatcaaaagacataaaacagaataacaaatttctttcagaagaaaacacaaatcttaaaaaaactctttcggaatatgctcaaaaactattacaaattgatgaaatcaaagaagataataagcaaaaagaaaaattaatatcgaagctcaacttaaagatatcagaaatggaacaacttatgaaaaatcaagaaacgacaacagaagaatccataaaacttcatgatgataatgtaacacttaccaagcaaatcatgactgcgcatgaaaagttaaaagatttgttacagcaaaaccaaattttaatacaacaaatcgaagatttccatgaaagatccgaaaagataactgaaattgaactacgaaacttagagataacaaatgaaaatcaaattttaaaaacagaactaaagaagaaaattgaagtatttgaagaagcaacaagaaaaacaatgcaaaaatataaagaagcttgtcaaggaaatgacgaacttacaaagtttataaataaacaaaatgaaataattgaagcgaatgaaatacaattacaaacgaaagatgaaaaaataaaagttttgatgcaaatgtgttctttattagaaaagaaactaaatgaaaatgaaacggaaaatgccgaattaaaagaaaggattaaaattttggaagaaatgaattctgttgattttattgatgatgattcaacagaattacaaaatcatattcacgaatgcgaaaaaataattgaaacattacaaaaccaaatcgccaaaaatgcacatgaaatggctgatgtagtttcatataaatcacgtatcgcagctttggaagcaagattaaaagaacttgaaaaattgaataatagtgatgacgaagtaattgaaatatcaatcgataataccgaaaacgaaaatagaatcgaagaaaaagaaataatcgtaattgagaacgatacggaaatttctgatggattcgaggaaattgaatgaaaaaaaatcgtctttactgaaaaaatgtcaaaagaattacaacagcttaaagcgagcaaataaaattatcatctgttgaaatgatcttaacgacatcgagttccgataatagtgttaagatatgaaacatgtttcatcggcagtattacgtttaatgttgaaggaattgatattaatgataaagaaatttatttaatatttattattatgattttatatatcaaaataatatttttaaataaggcgttgaattaagtccaaaaaggatgtgctcttaaactccataatatggaacaaaaatgtctgcaaggggtgacaaagcctcttaaagacccgctaaatttttttgattgttgacctaaataaaaaacataccattgtctaaattaactcatgaaaattttatcattatgtgaagaataattaaaagattcatgcggtactaacttttttggaaattttatcatctgctgatctttttgaaggatttttttaacgatatgatgtgagatgtagaagttctgtgctattttttgcagaagattatgggaacttttggaggtagttcgaaataaagaatcaaggtccaatgtgggtcttcctgtaagttcctcgcccatacatgaaaaattaaatttttgaacctatgaagccaatttttgatcaaaaatcctaggattttgaatatactttattgctattgatatatgtggtatacatatataccaaattatcatatatttgtttactgccttgtcctaagagagaacaatatttgatgatggttctttgttcccactttcggaagggataactaaaaagtgacattctaactttttttgactattaacatattcaaagttaaatgtctcatgaaaagcaaatatacccaaatatcataataaacaaaatcttatacatccgaatctttcaatatatatatacatatttaaacagtattcaaataattttacattacaacagattgaaaattgaaataaatttttgtaaacttgttaaaattgacaaggagattaatgtcgaaatagtttctaaaatcttttttatgttttaatttattttccaacaaactttatagttctttttgaagacaatttccttgtcttcttcgcaatgaagtaaaccatctgtttttgcattgtaaatgaaatttctttcagtaaaatattttgaaattatcttccaatgatgaccaatagctttaggtggcgctgttaaagcgaattcgcttgtatcattaatgttaatctcaaatgagataaaaataattttatcttttccaatgaaaataaataatgtttttgttgtaaaaagaaatgtcactcagcaggatcgattgtaaggagccttcggataagacctcttagtatctgataatgcactaacatctattggtaaaaaataaggttgtggcttttcattttaagctttacttcgaaaaggtgacgcgtgagctacgattaaaataatgatttcattaattacaatatgatgcataggtaccacattacacaattgtatgcttgtttatagctttaaaccaatagcatttgttcatttgatacgttcaagtgtaatatgatattttgactgatttttccggcaattttggttgaaaaccacatgttttttcacttcttaaaacaacatcatttgtttataatggcattcataacattcatcttataaattaatttacatggactttccgtgttcttttgcctgaacatcgaccccagaatttcggccggtacgttggtcgaacagaaattttgtgaagaaaccgttgttcacaaaagttgttattttttcagaaaaaaatcgtaaaaaaattttttaatggccattcccacgttcgtttttaggagaacaaaaagaattttcgacttgctaaaacaatttccacaatatttagatcaaatttaattcgtaaatgatgagatcacattaaaatctcaaaagaattggcaaaattagatcatcaaaaacattattctaaaaaacgttatattgaattttttgaatggaaaatattcaaaaaaataaaaaattggaattaaaaacataaccgttttgtttgagcacacagataaaatgacccaaacaaattggaacgactccccggggaatgatgaacctcaaatgaatcactcaatgtcagcgttacttccatctacattaagagatatgtgcgaagatggagaaacaaatcaatttccaaaaaaaaaattcacacttgtaaatccaaatgtttatttttcaaggcaagtaagttcccttccagtttcagctcgaaatatggactttccttcaaatgatgatgatgatctaaatcaacatgctgattttcaattccaaggtgaaattgaaacagatggcaactatgcaaaatcatgttactatacggttaaatttaacatgtatagatcttcttgcttttatacaaaccaagatttaaaaattcaaattggtgattatgttttaactgaggctgatcgtggatatgatattggagtagtagtaggaatagttacgaagccttccccacgtgatcaaagatcagcaaaaatgatattaagaattgctcaacaatatgaaattgatcaactccaacaaaaagcagaaagagagttaagagcacttgagttgtgccaagcaaaagtcatagaatatgctttgccgatgaaaataattggtgcagaattccaattttatggaaaaaagcttaccttttattatacctcgtcacattacatcgacttcagaactcttgttcgcactcttttcaaggtatttggcactcgaatttggatgtgctgtgtatcagaaaaaccatgaaatatttaatactaaaatagaagaacatacattagaaataaatcgcatttctctctaattttatttttaatttttttatcaaacaaaatcaggaaacatcgatgaacgtttaaagccgcatcaaaaaaagtgacttcactcttaccattgaattttaggttcacttttttgattcattttggatgtcgagtctaatttctctgcaaatcaaaggacttcgttcatatcatcctgatccagaagatccttctacacaaacaataacttttgatgggcctgttacgttgattagtggcgaaaatggaactggaaaaacaacaatcattgaatcattaaaatatgcaacagttggtgtttgttcaaaggagatagttgcagatccacatttatggaatcaagatcgaattaatggtgaagtttcattagaattcgaatcaccaacaggaaaaacagtcaaagtacaacgtggagcatcattagtaaagacagcacttaagaaaacaggggcaacatttggtaatcaagcatgtcatattacaattgataatcatgatggaacaacgcccattaaaaagactgcaaattcaacagaatccaacattgaaatcccacagcttcttggagtttcaccagctatcttagaaaatgtaattttttgtgatcaacaaaactcatgttggccattagaagattctgccaaacgacttaaagaacgatttgatgaaatatttggagcagagaagtatgagaaagcaaagaaagcacttaaagaagttgagaagcaacttaaagaagaaaagaatacatatgaaaaagagtcaagtatccaaactaagaaccaagaaagttatttacggatacagtctaagattgagaacaatcgcaaacgaattattaaacttgatgaagaacaatctgatcttcaagttcgacatgatgattatcaagacaagatcaatgaatatgatcaacatagtgaaaccatcaataacttaaaagggaaaattaatgctaatgaagagaagtccaaaatctatttaaagaaaatgaatgaagaaaagtcacaaatcattggcgacttacatacgacagatgaatgttatgttcttaaagaagaacttgagacgaaacaaaaagaattaaaaagaaaattagaaacaattaaatatactaatgtcgaacaaaacagaaaacttgaaaaattaatgaaagaatcagaaaaccttcggaatgaacttgacattaaaaagaatttaatgggcggcgcacaagcgcaacatgatttctatatgaaaacattagccgaatttgaaaaagaatatcaatcgaaagattacgaagaagttttattaaagaaaagagaagaatatcaaatgaagaagaaagaattcgattcatttgaagataaaactaaaaaaagtgcaaagaaattatcaaaagaaatccaacgaattgatggaaaatattttgaggtaagtagtaaaattaaaagttatgaacaacaaatcaatgataaattaaaagatttaaatcaacaaaaatatgatgaaaatgaaattaatgaaatccaaaacaaaattaatattgaagaagaagattataaaacatttataagtaatacaaaatcagaagaacaaattcaaaatgaaattaaacaaaatgaagaacaacaacaacaaattaaagttgaaactaataaatatatcgaattacaaaagaaatgtacattacaatcgacaattcaacaaaagtattcacttttacaatcaacgatttatacattaaaagaaaaaatcgaaacgcaattagaaaacattaagaaagttttaggtaatgttacagtcgataatattgaagaaacatttaataaagtttataatggaacaaaaacggaatatgaaaatcttaaattagaaagtgataaaatatcaaatgaaattatgcaaaacaaaatacaacttgaaaattatcaaaacaaattaattaaaggtgataaacaaattaaagaaacggaatcgaaattacaattatttattcaagatgatcaatttgaagatgtctataaacaaaagaaacaagaattaacagaagcgcaaaataaacttactcgatttcaaaacagtgaagaaatttataagaatttcgaaaaagaagcgaatgaacttcattggtgtccattatgtgaacgaaaatttaatgatgaaaattcattaatcgaattcattaagaataaaatttcattacatatccaaaacttaccaacgaaattagagaaatgtgaaaagaagataaaacgaacagagaaagaacttaaaacacttgaactattaaaaccagaatatgaacaatataagaagaacattgaacaaagagaatcattacaacaacatatcaatgaattaaaattaagtttagagaatttagaagataaaaagcaaaaaattttagagaagttaaatatcgttaatgattcatttgaattattacgtacattaaatccggagattaaatcatatttaaataataataatgaattaaataataacttaattgaagaatcaaatttatcatcacaattcgattcttctttaccatcatatttagaaatcactgataaagttaatgaaatggaatcaattaaaagtgatttatatatgaaacataaacaattaacagatgaatatacattatatgtacaacgaacttcaaagaataaatcggaaatccaaaacttgaaacatatgttacaaaagaacttagataaacaaaagaattataatgaaataaatgaaaaaattaattatattaaaaacgaaaaagaaaaattagaaaaagaattcgaacaaatacaaacagaacgtgaaagtattcatttaagtcattcacaattagaagaagaaaatagtcaaaagatcgaagccgaatcaaatatcttacgaagttatgaacttatattaaatgaatgtgaaaaccaatgtaatattttacgtaaatcacaagaagaattatcgacaattaattctggtgaattaccacaacaaattaatgaactacagatacaaattgatcaaaataaaacagaaattcaaacattacaaaacaatattaatatcaataatcaagaagaacatgaaattaataatgaaatctttggtaatattaatacacaattaacgtcaataattcatcaaattaattatctaaatgaaaagaaagaattcgatataatccaaaatgaaattcaagtctataacaatgaattaaatcaaatcttaagaggtaattcatttaatgacataacaaaaataaaagaagaatataaagtaatgcatgacaaattaatcgaaatccaaacttctttacgtaatgagaagtccgaattaaagaagaatcaagaagaactaaaactattcaatgacgcaaatgaaaaattaacagctgcaaacattaaacttcaggcaactataatgtcaatatcagacgtaacgaaatattccaaagttttagatgaaacgttattagaattccattcacaaaaaatggacgaaattaacgagacaattcaatcgttatgggaccacatttatttcggtaaagatatcgacggtatagaaatcaaagcggagcccgctgcaactggaagagcttcttataattatagagtcgtaatgcacaaagacggaataacgttggatatgtgcaatcgttgttcggccggtcaaaaagttttggcgtcgatcatcgtacgtttagcattggcggaaactttttcaatcaattgcggagttatagcattggatgagccaacaacaaatttggaccagccaaatatgcaaaacttggcattggaattgataaaattggtggagtcaagacagaaaaatgcaggaaagcctttccaaattattatcataacacattgtaaccaattcgtggaacaactgatgcagtcaggattctttaaccacttttaccaaatcacgagaaggtctgatggagaacatacatatagtcagatctcaagagtcaacgataatgtgttgaagtgaaatgttggggccccctaaaataacgattgtgtaaaatattcaatttaaattttgtatgattctcttaaaattttaacgtcattgtcagcgcacgtaaaattttgaaattgagagtttcattcaaaaagtacttttcaacttcacaacgaaacggttaacataaaaagtgctatttaaatatttaaacggacatttaaagttatgttcggtttcactgagtttgttttttgtttctatcgtttttatttctcttgcttttcttgggcttaagagccaaaattttgtgggattagtgactttaaataatttccaacccataggtttgggatgtgaaatattcattaaaaattattttcccataaatttttttacatgtaactaattttaattcaagagatcatatagtataaatatgatacctagttttgattatatgatgatcttaaaaaagttacctctgtatgacaaaggaagcaactgaagtttgttttagctaattttatttataaatgggaattgtaagatatcaaaaataataaaaatgccactttttcgtatgatggttttatgtaaatatctcaattttccacttttttttgaaagtataaacgttttttcttgcgaccctgtataagctctgtatcgtcttcaaaacgtttcctgactatagcaaatatttttatgattttattggatattatatgaataaattaaataattaaaacgccactaatatgggcatcagaaaatagttaaaatgatatagttaaaattttatttaaacaaaaaagaattaatattaacattaaagatatttaaataaataacataatgacttaatttatcattttgtgatcgaaaataataatattattaaaatattaaaataatatttggagattatttaaatcatagtatacagcactaatttgggcatctacatgaagaaatagttaaaatattacttaaacaaaaaaatattgatattaatactataaatatatatattgattaattaatatatctataaaattttttgaatttcgacataatatttaaaatttctttaaatctattaaaacagcactcataaaagcaattgaaaatgaaaaaataaatgttattaaattaatttcaaaagatgaccttgatataaatataaatgatattaaaataatttatatgaatttcatatcaaataattaaaatcataaaatataatttggaatttattagaataaaaaaaaaaacagctttcacacatgcatttaaaaaaggaaatatctatatcataataaatatattagaaaaatataaataaataatttatatgaattatttttctaaaattcaaaacattttgcatttttatacataaatacacaagaattttgttatcaaaatgattgaggtcaaaaattcattgtgtttttttcccataatttcaataacaattatatatgcaaaattacgttttaattacccataatactaaaagcttgataaaacttcattattttaaccaagatatttcccttatgattttatttctttttgcaacatcaatcgattttgataaataaaatataataaatactatattgagatatgtttgaaagcatttattaaaaatcaatgtatgctatttattatgttagtcttatgcattaatccaatgaacacttaatttatagcgttgaaaatgtaactgaatgaaatcattacttagatgaaactatttttattaatattttaaattatctatatataatttatacatatattctaatgaatattaatttcaatcaaaaaaatgtctatttaatttttgtggaaatcttcattcaaaaatgggtacatcagtatatcatatatgaaaatattattttcatttatatttgatgaatatataaataaaaatttttacggaattgatttaaagtggttccaaataagtttctcgaatgataggaacagttagttatttgacaatggggcaggtttcttcagagaaacatgtaaaaagaacaaagattttaataatgataagtaaaggattttcaaatcagcaaattgcaaagatacttggggtagatcacaaaactgtaaataaggttcgcaacatgttaggaaatggagaaaatatttttgtgggaaagaataaacttggaagatcttctaaacaaacaaaagagcttgtgtcctatgtcgaaataatgactttaaataatcgaagaatgactaatcaaaaacttgcattgatcattttgcaatcaaagtcaacagttgcatcaataagaaaaagcttaaagtacacacacagcacatctccacttcgcttcgctcaggtgtgtgcttatcgttactgcatggctcaactttactcactgcgttcgctcgataaaaaaataatcttgaacttatgatggggctgtttatatttcaatttgaattataggttttatgtgaatctttaatatcttttcgcccagagaacattcctaacgatttggtttctgatgttttgcaacgaaagaaaaggcagcgattaaacgaacgtaatcatttgaattcaaatggtcggcttttttctatcattttgcacgaaccttggaaatttcttaattttacatttaattttatacaaaataatgtgaactttatttttctcaaatttcagaaagtgacgtgataagcattcaattaccatttgaaagcaaaaaggaattttcatgttcctttttttaaatactctatttgctttctcatcatcatctagttattgttataaaggcgcatcaattgaaagctgtccaagtggatcgcaggaagttacaatatttgacgaaattcgaaatgagataaatccaactgtagaactttatatattagactcaggtttctcccttgactcaaacttctcttttgaactcacagttgatggttcattagttcaagataagccaaaaatttcattcacttatattttatcaaaaactacatcgatctttaaactcaaaaatgtagtgttcaatgttgaagaaagttctgaaacacaggtcaacgtaaaatctattacacttgataattcacaacttattttatcagaaagtaatattttatcagccgaccaaatcatttttaatgacctaacatcaatttcaggccatattgaagttgaagagcttaccataaatgctattggccaaatcatgtatcaaaatattatcactgccaaggtcacaactatcattagcacgcttcccttagttttcaaagaagttttctttggtaatgtaacatttatttttgactccatatcaactttaaatatatcaatacccagaatatccgacataaatatatacattaataacaccacctttgagcatatttccattattccttgttatgcccatgtgaacatatattccaataattccaatatcatcacaaccaatgttagcactgctagcagtaactcttacaatctcgtgaacagtaacttaacactttcacctggagataccaattctcttacacttgaatgtcagtcatcagtatatatctcaacatcacaaagcacagcaacacttaaagcaatcattctaaacaattgttcacttacatttattgataattccaccataaatgaaatccatacactttcatttcgatattcaggaccatcatcgatacatagtaattcgccagtcaacatttatactacatcgatgcaaaacgcacaaaattcaataatcgaatgtgactgtgaagtaacacttaaagggacatcaacgttttatatcggaagtccattaacaaatttaagtcttgaaactagttatttaaatatatatgcaaatcttcaaagatcaaaagaagaaaatttatatcaatttaagtcagttaaaatcgataatcttgatataaattataatgcgcctgtttcatttgagccaagttcttatgatgaatatgttaatttgaaatatgtaattataagtgcaactaattcattacaaattaatgagtatttaatcataattgatggtgatgaagaaaaaggtgatccatggtcaattaagcaatcaaatgtctttacaaaagaacgagttatttatgaatcaaacattgatgataatcaattgagtattacacttttggaaaatccattttacacatatttaagagtatattatacgaataaagaaacatatccatttatatattatgctgacgtcattagtgatgcagatcctatatggtggaaacatgtaacaaaaaatacaaaaggtgttacaatatatttcgaatcaaataacttaaatcctttaccatttccaaatgaaacatttgagaatcaaattaatttaacattttctccttcaattttcgatccagatgcagaaacaaatgtcatttcaataattttcgattcaacaaatgtcgataaaatttgtcattcactttttgtttcgaatggagttaatgataatgtaatgaaaacatttcattttaaggaatttaacttcaccgaaaataaacttcataaaatgcgagttgcatttggtatcttagacacgatcacaacattaaatggcaattatacatttaatgaaagtgtggttgcaggtggttattatgatgctccttatatcaaaaacatcgatgctcctgcattattactttatattcctgaaacacaatattcattaacactaagtaatgattatataacaattaatcaaaagacattacaaaaagcttcgaattattttatttatacctcagctaatattgtagaacattatttagtcgatattccagataatgaaagttatccttctttaatgttttatcgtttatactcttctactacttgtttctttatcttaaattcaccatataataaagaaaaaacttatttatttatgtgtgatgaagctaatcgtacatcagtaatctcaaaatctgatggaagattccctttaggtcttcctatcgatgatagtataacgcaaacttatttattgtattatggaatgacaaatgttactggttatatatatcctttcactgcgagagatataactttaactggtggtacaaattatataactgatgctaatattacttctgttgataatgaatttgtgacttttagaacaagttacatttacccaaattatttcattacgactaaagaaggcgcttcaattaatggtaattggaagtcattggaattaaatcattgtggtaatgtaacagtttcaagttatggttctgctgatcataatgataatgttactattaatgtatatgctggtgacgtatttacaataccaattgtaaaaatcaatgatgacgtgaaaataacaatcgcaaaatatgaagtagaatacacttataaagcattgagtgatgttgacgtgaatatagatctgctatccggagctgaaaacgtttatgagttctatcaaaaatgcatcgactgcgatccgagcattcatacagacatgaaattcgttaacaaatcactcgtcttatctattagacaaaagtatgaaactgaaactgtaacagaaacaacagctgaaacagaaacagaaacaacacatgaaacagaaacaacagctgaaacagaaacagagacaacacatgaaacagaaactgtaacagaaacaacgcatgaaacagaaacaacagctgaaacagaaacagagacaacacatgaaacagaaacaacacatgaaacagaaacaacacatgaaacagaaacaacacatgaaacagaaacaacagctgaaacagaaacaacacatgaaacagaaacaacacatgaaacagaaacaacacatgaaacagagacaacacatgaaacagaaacaacacatgaaacagaaacaacacatgaaacagaaacaacacatgaaacagaaacaacagctgaaacagaaacaacacatgaaacagaaacagagacaacacatgaaacagaaacagagacaacacatgaaacagaaacagagacaacacatgaaacagaaacagaaacaacagctgaaacagagacaacacatgaaacagaaactgtaacagaaacaacagctgaaacagaaacagaaacaacagctgaaacagagacaacacatgaaacagaaactgtaacagaaacaacagctgaaacagaaactgagacaacacatgaaacagaaacaacacatgaaacagaaacaacacatgaaacagaaacaacagctgaaacagaaacaacacatgaaacagaaacaacacatgaaacagaaacaacacatgaaacagagacaacacatgaaacagaaacaacacatgaaacagaaacaacacatgaaacagaaacaacacatgaaacagaaacaacagctgaaacagaaacaacacatgaaacagaaacagagacaacacatgaaacagaaacagagacaacacatgaaacagaaacagagacaacacatgaaacagaaacagaaacaacagctgaaacagagacaacacatgaaacagaaactgtaacagaaacaacagctgaaacagaaacagaaacaacagctgaaacagagacaacacatgaaacagaaactgtaacagaaacaacagctgaaacagaaactgagacaacacatgaaacagaaactgtaacagaaacaacagctgaaacagaaactgagacaacacatgaaacagaaatagaaacaacacatgaaacagaaacaatacatgaaacagaaacaacagctgaaacagaaacagaaacaacagctgaaacagaaactgagacaacacatgaaacagaaacagaaactacacacgaaactgaaacaacacacgagacacaaaccgaaacaacagctgaaacagaaactgagacaacacatgagacagaaactgtaacagaaacaacgcacgagactgagacaacacatgagacagaaacaacagctgaaacagaaactacacatgagacagaaactgaaacagtgactccagcgccaacaccagaaacatttactccaacaccaggtactgcaacgcctgagcccacctttactcccacctcttcctcctcttcctcctcatccaagcaaaaggcgattattggcggcgtttgtggtacagttggagcacttattattgttggtgcagttgttgcttttatattgattcgcaagaggagaaaggacttggagctctcccagaacagtgtgctcgaatcacagctcttgtaaccaaattacatttgggaaataaatatatttcaatgcatctgaaaatttcttttttaatagctacaagaaacttttcatttctgaagcattaaaaaatgtaataataagtgctacatccacgaaaccattttgtttctatttcaagaaaacaccaaaatcacaagagaactttttgtatcaaaccgaatgaattgaaagaacaaattctgacagcggttaatggggcagtccactgatcggttcaggaagcaaaaagtggcggtgatgttttggagtgcccgagaaattgtaacggccattctatcaaaaagttattgttggtttcccgggtgcccaatatccaaagtgcaaacaaaggataaggcaaaaaatcaaatttttttaataatacttaatcttgttcacatttgcttcatctttcaactaattcaaaaattagcagataaaaatactttactaaatttcgaaatcatcaaagttcagcaacaaactaatgggagtactttatcatctttaaatcaaacaaaacctaggtcgcttacagaagtagtactagggtatccatggaatcgttattatgtttttcaccaattcccagaagatcttagatccaagttttatactgatatttccaagtttactgagcttgagccatctgttccaattaatcctcagtgtacgccaccgattcttccaaatctttctgatatcaattgttccgcttatccgcgtgcttttacaggtgaaaagcggtcaaaattttcaaagattgcgcatgccattcaacttggatttgatgtagatgttttagagatacatttaaatgagctttatccagttgttgacaagatctttataatcgaatccaatcgtgctcataatgaaggaactcttaagccgcttatctgggaagatgtctgtaacacgccacgtttttctgtatttaaagataaagttgtccattttcttattgataatactgaaatgaaaaaaaatcataattttgacatatggtttaatgaagaatatcaagagaaagagcgttggcgtcgaattcttgaatggaattcgcaaaccaatttctttgatgatgatgatattattggttttggagatgctgatgaaatttgtagcatacacaacttacacttattacgttcatgcaaattaaaagggcctgttgacatcggcgtatggtttacgcatggaatgatggaaaggaagttttattccgacttcccgattaaaggacatcctgatacacttggtgacccaacttttttcacatttgcgcaagctaaaagccaaaaacgttatccaacacgaatgagagggaaatcgaaaaattatttgttgggtggaatacatttatcgttatatcaatatttgcctgcgcgaattattaaacagatagctcaaactgaatatgatgaagcaacgctgataaaaattagagaagaaatgaaaaaaggtttgagtttgtatgaaatagaaaataataataagaaaagaacaatttcatattattcggaaagattccctttgctaaaggataacgaaattggtaaaaatcaatttattgttccttggttcctaaactgtaataaagaaagatatccatctctgtttgagaatatgggttatgataaaagatatgacgcgaaaatttaaaaaatatttgtatatataaataaacatattttgaaattattggactgatagttttcgagatgaatttgatttaagaataaattttgcttttggttaatcggatatctaaaagaacagtagcaactgattcaagcacaaaaaagttataaacgtgcacatattgagttatataatgtaattaaacaatttgtaaatgatcctgttcaaattatttttcgttcttaccttgatattgaaggatatgacacatactatgtaattgttaaagattttcaatataaattttcggcagctttagataattgctgaattatatggaaataaaattttagttatttcacgttgcatgaaatatattaatgaacttcatgcagaacttaaaaaacatcaaataaaaacttctttacttttagattcttatgtttctgatgttgttgaatgaatccaaagttattgatgagtttatatatgataacgcagaagttcttattttaacagatacaattagtcaatgtgtacttaattatcttaaaagtaaaattactataatgacatcgcaaaggatttcgctggattaagaaccattatataggaaatggtatttcttaattcttaaatattaaaatgtatatgtgcatatcaggtaaatatttggacaccattgaaaaatatatgatagtttgtcagaaagttttttatttttaaaaattaaacatttttagagttgactccctactcacagctattaaaaacacccaagttgaattttcaatctcaacacactgttaacattaattgattattcagcttttttttttttcataagttcattgctttaaatatttacttatggatggtgttaaaatagataatacaggccaataagtagtggcaggtggaaatgaagaaatcaatcatttatgtgaataaaatcattcatcatttgaaacatcaactgaatttcatcgaaatgatgtttttagaagaagcacaaccaaagtcaatgtatattcaatatttgcaagtaacattacataattatttgaagtgttttatattaaaaaagataaatacgaaattctcaaatgtattgaagaaaaaagaattaataactatattatgaatcatcaaaaaatggaaatttgtattactcgttattatattatataaattccaaaaaaaacatttcagtttttgcatcagaaactgaaatgttgaacataacaagaaggaggtattcattcgttttatttattattaacttatttgtcagctgctgacatatattttgcgaaatgaggacgtatccattgcgtaacatcgtttgcgaagatcttatcgacctttgcagggtcatattcttttttaggaagtttagcgatctcttcaccataatcctttaagaagtctttagttgcatcgttcaagaattcgtttctaagtttcatgaagtccttttttgtgatttctccaatctttgatacgactgaacaaattctagattctgttacatattccattttatttccgtaaatttccaattctttttcagtgaagtttgactttggatcagatttctttggcttctcgtgtttcttgttgattttttcttcgaatatttcatttttgttcttcaaaataattcgttgttcatcatatacaataggatggactggctttataacaattccttcaatgatgttgttttcgattggtggaagtccataatattcaacaccaattggatcaggtgtattattaggaactgccatacattcatcaaatgtaccaatctttacaacataatgagatgtcatttgaacggcattacaaacttcagttactatattatcatcaatgtagacaaagttaccatctttctcaatcataatgtcaaagcaataaaaatgtattccaggggcatattgaatccttgattgaattcccttaaattttgatttgggaacatcaggatgattataacttcccccaaataactcaccgcaaataataattgtggagctttcggtaattaaccctttctctataagtatattccggatttgtactgattttggctcaagattatcagcttttactgcttcttgataattgtaaaaaccttcattttcttttaataaagcatttctacgactatatcttattttcccatctggataaacataaattgaaaattgtgctccatcaactttaatacttgcagtccattgaatcgaagggtctgtgaaccctttttctttgatgagatcaataaacttttgccttgaaactaattcaatctctgaataagcgcagaatttttcagacatgttttaatttagtgatgtgatatgtgtcgacacatcatcatttcacttttttagatacgataaaattacaactgtgtgatggtgcaccccaaagtcatatttcttttgctcgatcattaactcatcaaatagaatgttcatgtgatttctttcgaatcaaatagattcaaataacatataaataatttttgaaatatatttatttttgcttcttgcttgaatcactcttataaaatatatagcttaaattaatgataagtgctgttctaaatatttaaataatttccaaatattcttatgaaattccaaaatagaaaaaaattaataagatataaaacaaataaatatcttttgcattaatatcaataccttctgttcgagaaggaattttatatgtatatattacctttccaaggtacattcataagttctgttgtaaataagtataatctatttccttcaatgatatttcaatgattttgtagaaattaacacaatatataaatcaagaacaatggtaagcaacagtaagtccgaatacaaatataaaataaattattgcgtagttttgaaaactatttataatccaaaatataaagcggccatatcatttattagtaatatttcactaataattttatgctcaaaactaaattagttattcctaatcagaagagctcgaacttgatgaagattcatcatcgtcaccttcctcttcctcacctccttcttcttcaattccatcgtcatcgtcgtcatcatcatcatctccttcgtcactttccgtttgtgtttcagtggtttcactttcttgttgctgcgggtcctctttatactttggcattgcgggtggtggaggtggaggcggtggcggtgcagcgccattgttatcatcgctgctactactactactgctgctttctttctttttattcttcttcgcttctttttcttggcgtttcttttctgcttcttcgcgtttcttttcttctgcttcgcgcttcttctcctctgcttcgcgtttcttctcttccttttcgcgcttcttacgttctgcttcttcgcgtttcttctcctctgcttcacgtttcttctcttccttttcgcgcttcttattgtcctttttatcttccttctcgtcgagatcagttatgaaaagattctctgagtcagattcgggtttagatttgcccgacttcgatttacgtgctgcacaacaattctctaatgaaaggacacagacatatgcaacgataatcactacaatagcaggaacaagataaatgataaagatgatgtcgtaatagtgtaacccggcaaatgaatatatggtttcatcttcgcgggctttgacggcataatatttgtcgcgctcaactgtgctcattccagctatgtcagaggcttcttcgattgtgttgttgtagacttcgcaaagatattgtgaaaataaacggctgttccatccaccaacacatgttgtaatatcaacagaatatgtgcatggattggtggaattcaaagtggagttggtaagatcaaccatacatgagccaatagaaacaggtgtataatctggtgatatataggatacataaaaatcaggatgtttggcctggaattctgggtaagtcattccaagagcttctgctaaagtagcaagtgaagagtcgctgtaattatcaacatattgcttaaatgaatcagaatcattgtaataattataatactgaggtacgacagaaccaccatactttgtccattcaatcgcaacacccatacatatgataagacatatcaataagataaaattgagcacgttgaacgttacatcaagtttacgttttttaacacaataattcgtaaagatagcaataattgctaaaacgttggaagcaattgatacgcaaacggaggcaattgctatattatggacattggtattaattccgtactttaacgctgtatactgattctcgctcatgaagaactggatcattacatcagcccctaatgcgcctagaatgacgcttatagagccggctcctaaaaagaagttggctacttcttctctgcggaaattcatattgtaaaagtgccaactttttgacagcatcaacaatgtaaacacagaaaattacgtcagaattttggcagctacatagtacgttaatttcgttttgtgtggcgacgctttgaaaaaaaggtttgttggcacaaatttttcaataaaatgccaaaaagccagaaaaattttctacagatcaaaaacgataacaaatcgaatttttctcaaaaatcttgtagtgatctgagattaattaaaatataaagtatggcttccctttttatacatttgtatattgaggaatttaactatttgtaagaattgattaatctattttttctataaagactttatgtgtttcccacaattgttaaattcgaatgagattatttcgagtttgatgtagcaaccttttttttatgcttatcttctcaatcttttgaagttggttttacagatgttcacggaataacgttcttatattaatgtggttcgtacgtttaaatttattttttatcgaaggttcatcgaatcatgtaaaaatataaactacaaattaatgttaactactcatataaattaaaaaaaattagaagtatacaacaagttatagaataaaagattaaaaatttcgttgaataattaaaattttaaattctttccaagtttatcaaattgctaattaacaatatagttgtattaaattttctttaagcttttgatttagcttccttttgattatcttatttagtaacaatgccaactaaattaggttcgaaaaatattattatgatttaattcttcagagtgaaactacaaatgttttatgaatttttttttagaaattttaagcattctttgaatatgtcatattgtcaaaaagtgtattaaataaaaattataaatatctataacatttatattaattccttgttcaagaagaagtgccactatttcagtgtgaacatataaagataccattataagtgatgtttaatcgatattttgagaaataatgtaaaccattaaaataaaacgagaaaataccttgagcactaatgccaatatctttttgtgaaagaagtgaatagttaactatttcagtttatactttggcatgtgaaaaaaaaaaggtgtttcatcaattttatataattcttaaattctattaaaacttaacaaaaactctttattttgaacccatttgcatcttattaataccagcatcattatataaaacgaatgaacatgtgggcttgtatcacccattttttgaactgtgataaggtattgaattttcaatggaacagatcaaatcacttttaatttcttttggttgttttgaaaaatatttttgaatgccaatggtatgaacgatatgatttttgaatgctttacaatctcaaaggctacgttggatgtcttcgatttatcttaacaatttaccaaagacagcaagcgtagacatgctaaaagagaaattttcaacatacggaacaattaaagaagttagaattcccagagcttatggaaggagatcatatggatttattgattatgaagaagaagacgccgctcaaaaggccatcgatggaagccaaggtattgaaattgatggctctactttaagtattgaaataacaaaaaataatcaaatttcaagagatcgtgatgatagaagatcttcaaggcgatactcccgcagatcaaactcaccagaaaggaggagaaggagatatgaatatgattattctgattatgatgattattatagaagaagaagatatcatagaagggatgattatagtgattatgacgattttgattatgatagaagaaggaggagaagcagcagaacattttcgagaagaagaagagattctccaccacgttatcggcgacggagccgatcaccacccagctattcatctcgatctccttcgcctcagagggaaaaaagcgatgtggactcaaaataaatcataaataatgttattctatctaagctatgtgctattaatatacacattaaggcttgaggaatttaattagtagcctgatagaaaataaaaatatgtttcaagcttaatattttcagtaaaaaataatttgcataagaaaatcaatcacattgagcacttttgaatattttcagaactttatttcggttctcttttcgaagtttacagatgagcgaaaacaacaatgaaggaatagaccaacttttatctaactctgaagaagtatctaaaaatattaataaacatggagacgctctaaaggcacaacttgatgcaaaccaaccatttaatacacaaagtatcaaaaatgaattagagacagatctaaatcaaattcaagattatgtaatgagcctttcaaagcgctgtatgacccagcttattgattggaataatatgcttattggaatggatgctgaaatcaatgaagttgaaggtcttattaagcgtgtaaaagcagatgctggctctcgcgttgtttcgccaatcttatgtgaaggtggacaagatacccgtggtagtgattatgaattttctcaattatctgcactatacaatttcccacaatatacatttgacatcaatatgcgtgctttagataatgtagggtatcaagtagaggagttagaaaacccagaattaagcaaagataaagagcctctattaacaaaaattccacctggagaagatccaccaatattttggtccacaacacaggacttcttcacaccagcaatgcacttgttgataacagtaggtgatgaagccttccaaacatctttttcagatttttataagtttgatgcggttccacaaattgttagagaccaaagagaggcaatggaaaaaaagtaaatattttttttagcacactttaactattaagatatgaattttttgtcaaatctaatttcacaattctttaaaactttaggtaaaaagattttcaaaatttgagtaataaataattcattgtttttcatgaaaaacatacactataaacatacagagaaagattaatcttaatgcagataaaatttacccaaaaacagtaaaaagtttcccaaagttaaagcagacaaaagaaaaaacggcaaataacgaattattttaaatatttgttttagaaaaaaaaacataaacagagtatctattactttattaatgcaattttaatcgaaaattatggaaaataaatgcttattttgaataaatagaagatatatcaaaaaatttcaaagcaatggcaaaaacaaaaatgatggccatgagaaagagcagtagcggagagctagaatttgattttttttgtaaagatttgatttcatttctatattgaagatattgactactgtattctgaaatttgcttccaataatcatttgcacaaattttcttttcgcctatctgtatatttgagttttcgtctcgatagttttcttttgaagcagatttcattttctgtttagaaattgacatatcagttaattttttttagtcaatttgaacgaagaaattattctattataagctttaaaaatttgcaaattttatttactccttcatgttaaagatatgcagatgaaatttttttaatcttctatttattagagaagataaatgaattttttccaataacatttcataactttacaaatacactttttattttggttcttgaccaaatattagttcaaatcacataagtaaagcatataaaaattatgtaaactttgaatttgactagttcaagaaattgtctagacatcccaaaatgatgaaattgtatgtatatatggtcaaacaagttctgtggaaccgcttgataaaacattcaatatactttacaagtaaaatttgaatttgttcaacaagttctttaatgaatctgacaattctctattttgcaggaacaagcctttcaagaagtccatttttggcatcaaatagaaacatatttattaagcattccatatttaattcttttttttcgaacgttttatattcatctgtattcaattctaattcattaaaaaaaatatctagtacaacatttcaaaattctttatcaaccccaatacgtattgatagtgaaaacattgaagggcaattaatttctgaacgaaaatcttttcgcgatttaactagtacacttagtatttccaaatgcctattcataaattgtcgttctgctgctaatggtggagctgttgaagttaattcagcatcttattccgtttacattgataaatccggatttacaaattgtcaatcagaaggtcttggtggctcattctatatccaatgcactaactttgagcttacactttcatgtgttgatggttgtagtgctagctcgcactcatttggatattatcgccaaacaacattgaataacgctgcaacagttgaaaatgtttacttctcaaactctgtttctcaagacagtgattccgttacctatttttcaagttctaatctcaaagttagattttgtaattattcatacattaatcttccaaatgcaaaacatatttttgaaggaaacaccataaattccatcagcttttcgattttttcacaatgcaaatgcaagaacattttttgtatttataaatctacagatgcaatcaccaaaattaacttcgtcaagaacgaaggtaccgaataccttctgtatgtcggtaacacagaaagtgatttcacttattgttattttgttaacgataactcgaagaatgttatcaataaatatgcaatgtttgcaaattgcaagttcagccacaagagaactgattacactttccccacatatgtgtatataaacagtaactgcgttttcgaaaatggcgatgaaacattggatatcgagaatcgaccatctgaattttgctggcagctgatgccaacgtcaacgccaactccagaacccgaatcatcatcttcgtcgtcatcttcttcatcttcatctgatgaatcatcatcaagttctactcctgaaaaaagtggttcttctgcgacaactatcattgttgtgatccttgttgttgttgttattattttgttagctgttattttattcaagttcttctgtcaaaggaggagacaagattctgagcttttaatgatgtacgcacaagtttaattaaacatttttttaactttacaagtattttttttcgttaaaatttaatcttttctgatcaaaactatatctcatttttaaattcaaaaatatgttatcatttaatagaaaattacatgtaatgatttgtttttataatattgcagccagaccacaagattgatcgatcatgagcccacaaacaattccattgaaaagtacctttatcacaaatttttgtatggaaaaactgtaaaattacgaaaaaacgttattgtaactcaatgaaggttcaatcaccagaaggttctattctagcacagacttcattctcagaaatgaacacattgataagtgaagttgaccttgaaactacacaaaagaaggattccttttttacattatcgttattatttgatcaactggttgcaccaagtgctgaagacaaatatcttatgatcttaaaagctatagttgttatcttacaatttattcctttaataccttgggcaacttttccaggttttttcagttcagataatataattggtcgaattttgttctattttgatttttttgcactttatcaatatggccctgaaaacaaccttagcattgtaagactattagttccattttgtatttttattgtaatgttagtatacataatatttatatatttttgggtgaaacttaaaggcacgttgaagccaataatgagtttttttcttaaattcttttgtcacattgttttattattccaagtaattccattaacatttgcgttcacttccacattctcatcattacccgagaaaaacccaattgccatagcattttttataatttttattccatgtttagtcatcagtatcttattagtatattataccacacaaatattcaatgggtcacttacacccagttcacatcttaatccttatgacagctcatgttttacttacctatatatttgttctggcattgttatattaggaaatggattttcagtattttttgaaagttggttcaaaatcatcataatcatcttccaagactttggggcgatcatttctttgtattatgttctctcatttccatttctgagcctttttaacaattcattatttgcgtcaattccgacatcgattattgggtataatgtcatcaatatcattgctttgtatgtgcacattccggattacatcaaaataatcattgcattttttattgctaatgtatcgttcatattctatcgaatcttttttgggaaaaagtcacaaaagatattaaacttattaaatgaagaagaagagaacattaaagttacgtctttatttcaagccaattccattattcatgttggattttctaatttacacatgaaagttattaatggtattatacccatccaaatctgtaagcaaatgaagaatgatatgttatgggccaaatcagccgcattaattgctattataccatcgaatcgaatccaattacaagaatgtattgacgcattatcgattaatgcatctcctggattattattaaagttattacggaatcgtttaattcatatccaacaaaatcgtgaaacatttgaaacagttggaatgacacaacttataaatgaaatggaaatcgaaactaataattcaattgatattgtacgacaattttggaaagaaattgcagatggagaaaacatattaaatccatccacattaacatttttatatacgaacttaaaaagtcttaaaattaaatggaaagaaatccttaaacattatccaagtgatccacgattagctcaaatgtattcacgatttttaattgaatgtttgggtaaatatgaaaaaggtgtctattggaacatgaaaagtaaattacttaacaaaggttatcgtggaggtaatgatgaattattccattcatttgttatcttaaatccacgtatttattatgagaaaattgttgataaaaatgggaacttattagagaaagctgatgttgatagtatattatctacaataatgtctacatcgactacacatacaacttttatggaaagtgtacaacaaaaattagcagaagaaattggtaatggtgaatcattaactatagcttctaagttattttcaatgccacgattacgttataatttagaaaaggctacaaagaattatacaccaaattattataatatctttaagatattaaaaattattatattcatagtatggatcatagtttgtatagtattaatattcgtagcaactacaatattaaaaggtatgataggttcttatgaacgaaatgatgctatagctaatattaaaacaggtttatcatatttaaagaatataatatatttgaagaatgcaaatttaacaaatatattatttacaatggatgattatgttaatttattaacagaagaagcaataaatgaagataatttagcaattgatttaaatgattataaatcatcttatgaatattggagtgatataattattaataataataatttaatatattcttcattaacaaaatactttttagaaggcgatgatttatttggtgtattagatgctttaactttaaataatatatctaaagtaggagtaaatatatcattacggaatgcattcttaaatatattttgggattatactaatgtatatcaattagatattgttgatgattataatttcgaagtaatattaacttcacaagaaagtatgaatcgagaaactatttatattattgatgatttaatgagtgcgcctgaaatgtataatagggaattatcaagttattcaaacattataataattatattaggatgttatgcttatcttatagctttacctgtttgtttaatccagttttatatagtttatagtgcaacaaagaaattctttaatgctattgatacattatcaacagaatataaagattctgcatctaaaccaatatgttatgaaaatgatgaatcgaatactaaaaacaaatcacgaattagtaagaacagaggtaatttaattggttatatgatagcatttggtattatctttgcattattctttgtattatttgtaattactgtaataattactcgaagtgaattaaacaaatctatgaatatcattaacttagcgatatatggatcttatcgagaatcaataattactgaaatattaagttttgtccaaattaaaatgtataataaaataaattcgatatcattttcaacagttactgatgaagatttaattaatttagttaatgattattcaaatcaatttactgaatttcattccaaattttcaagtggaatttattcgattgtatcagaaatcgaaagtttacatttagatttccaatgtagttctactgattcagataatattcatttatatttcacttgtaattcacttgaacatttatttgatttatatttatcttatgctaaaattattattaatgatgatacttctaatttcttaacacaaaattatataagtctattacatttagctatagctgaacttcatcgaggttttacaagttctgcttcgatgttatcaaattattttaataattatataactactattcgattaactttcattttaatacttttgacagtattaatatttgtaattattttatggttcttaaatttatcaattgaaaatcgattccaaaacacattaaattctgttttgattttaattagacatttacctccaccagctatagcagagacaccagaattaaagaatttattattatccgtaaaaactaatggtaaagatgaaattttagatactggtgaaattacttttaattcaacagaaatccctataatatgtataggagaaggttatattattgagtcttgtaatcaaatgttccaaaaaactttcgattatttaagtgaacaaattgttggtcataaattaacacttgtaatagaaaacccaaatcaagatgatactgaaatgtctattgaagaacaaggcgcttttcatatgtatgataagattaaaactatgttccaaacaaataatgaaatgcaatgtagttatcctgtaaatgttattaatagtaatggagatttggtttcaacttatgcaaatgttttccctgtaattgataagaaacataataagttctctaactttataatttcgttcactaaacaaaaatcaaacgctgaagaaactaaaagaattaataagctgaaagaaacttgtcaagaaatggaagaacaattaatacccaaaaatctggtcgaaaaacatcaaaatgaagaaatcaacttcacagtgaaaaccgtaaccgtcgtcgccattcaaaatctgttgaacgtttacgatgaagaaacgattaatattagtgaagaaggttataaaagaattcatgaccttgcattaaaatacccgaatttggtgaaggtaaactttatccatgatactgcaatattcgcttctggtgttatcgatcaagaaaatgctgaacaaaatttgaaatcgattgttgattttactatagaatccgcagaaataattggtagtggatttaagatggctttgtttactggtggacctttgctttgtgcaactgttgtttctggtggttgcaaacaagtacaatgttttggatcagtaattaacgacgtcattttaatgttaacaacgacagagaaaaatgaaattactgtggacgaaaacacgaaacagataatgggcgagaaatatggacatatgttaaaagaaaaaccaaatcataatcaatatgttttaagtattgatttataatattataagtaaaataaacagcaatatattgttaacttttcgataaacatcgaatgaggtgtttatttgtaattaccagacaaagatttcattaataaaaagttttaatattgcataataatataatatatctcatggctttgttatgtttaaatatgcctcgaggcaaagatattttttgtgtatcgacttaccaaacaaactttattgaccttacgagatcaaaaaacatattattatcaacacaaacaaaaaatgaaattttcattttttgggcaaaaattcattaaatttttttattaaatgaaagtaatttttcattttttagaaatgataacatttattgtgtttttgattaaatttcatttatcaaaaactttttgctacctaaaaacattaatttgtttttagtgttttttgttttattgttcgcaaatagattctcaacttttgataattcaactaaaatactttctatttccaattcaacagattatgatagtagaatgttatatagaaaggaaacaattaatcttattattggaggttacatcactgaaattgaagatgaatgtttttatgagtagaataatttggaaagtgccaaaatgattcaatcaatcactgcaattgcaaattctacatttacaccatgttctagtttggaaatagtttttattggagaaaatgtggaaagaattggaaataatgcattttataattgaacgtcgttggtaaatattacaattccaaacaaagtaacagaaattggaaattctgtattcgcattttgttccaaactttaaatgattaaagtttccggcgaaaactcaaattattccaattataatgaagatgggattttatataataaaaacgtcactaaaattatttgttatccatgcgggatcacaaacgaaacatatacattcccaataaatgtcactgcaattggtgttaatgcattctctaattgtatctcattgaagaacatcgaaatttcatgcaatataacatcagttggaagcaatgcatttgcatcatgctgcaatctcacatgtattttttattatggcgaaacagtaccaacgaatacatcgaatgtatttgataataataatttaatcagaagtgtcataacaatcgattcatataggggccaaacattctgcggtataaatgcaagtcattgatgaatgtctcccaccaacgcaatcgttcacatactcaaacacatttaccaagtctaatacatcaatgaaatcaaatgcatatattaaatctaatgcatttacaaattcatatgaaatttcatttgttgtaacaaattcaattactttttcatattcgaagacaataacattaacacaatcattatctactactcaaacaataagtatttataaatcgacttattcgaattgattttctgtttctatttttaattctgaattaacatatgttttgagtgaatttatttattaagaatatactgttgttttatattctacttatcatagtaatttctttacaattatatatcaaaatgaaaatattaaagatgataataaaaacacaattataaatacaagtgtttgcgttgtagttgtcgttattataataattgcaatacttatcatagttttggtgcgaattcataataagaaacaaataaataatgaacaagaagcaaaaagtttcgaagaaaatcaaaatgaaaaagaaaataaatttgcaatgggaacatcaacaaataatattgatgaagatccatttgctgatgattttaaagaagaaaaattcattaatcatgtttagcatataaatatttgattattaattaagtaaaaatcggtaaaacttaaatttattagttgaataaaatttttatcatgagatatgttgtgttttttatgtaatatcactgctaacctgtgagatttgttttaggattcaattcagaatttacttacaaaacttataagtttgcagaaatattattatcttcttcaatgtttttttgtagaaattgttgttgaattattcattgaaatatcgcgattccaatctattactttcacttcgtcatcttcttcaatattcttatgctttttgtttctcattaacaaaacaataattactaatataatcatgactacagtagtctattctaattaaaaatgtttttttgttgttggcagataaaaagtgacaaaaatttaattgagtagtttgttcgaatgtgttccttcaaacgttttccattcaaatccaattgtttacaaaaattcatgtcaattttcaatctatcgtaatgtcgaattatttgaaccggtttattatttcgctaaagcacatgactaatgatgatactgccataaacataggagaccaacagttgggtgatctgtcaacctgcatgaaattcctaattgagcttgagaaaactatattcggtttaactgaagaaaaattccaggtgtcagttaaaaaaatattggaattattcgattcaaattattcctacacatataatactattgtaagtagcatcgcttataatgcattttcatcaaaaaagcgtgtatttgatattttcttaaattttttaaagacacttccataatgaaagaagaagaaattaatcaaaacatagttaaattaataccaatttttatcaaacgtatatctaaaattaacacacaagaatcatattatttaatcgaacaaatgattgaacaaaatttaattgataaaaatatcactaaaaacattaattcaaaatattttgcacattataaaccaaaagaagaaaaccaaaaccatttttcatttgggtttaatggaaatgatacaatagaaaaatactttttggatcattatgaagaactttcaaagaatgattgggaacttcataagaaatatattaaagaaggagttaatccaagagaaattgcgaaaataattcgaaatgatgaaatcgaaaaacttcaagaaatatcatcacaaacaaactttgattttaatcaaacaattgagccatcactatatgaaagatgttcatttattaatcaagaaaatgttacattaattgattatgcagcattctttggatcaattaattgttttaaatatttacttatgaataatgcaaatgtaaataacacaggtatatatgcagttgcaggtggaaatgaagaaatcattcatttatgtgagcaaaatcattcatcatttgaaggtgcatatgaaacagcaattgaatttcatcaaaatgatatctttaaatatctttatgaaaataatttagaaaaaacacaatcaataccaaaaatgtctgaagataaaacttatgatttagtaagtttttgtattaaaaaggataattatgaaattttagcatttttggaagaaaaaggaattaatgttaatgctaataatataaacgaatcagcaagaaatggaaatttatatctcgttaaatgcttccttcaaaacaatcacattccaaaagatattttgccatttgcttcagaatcagtaaatattgaacttgtgaaatatgtttttgaacaaaaaggaattgatgttaatgcaaaaattatccatttgaataatttgaaatatgttttaataatttggaatatgttttaatagtttttaatatgctttaataatttggaatatgttttaataatttgtaatatattttaataatttgaaatatattttaaaaatttagaatatgttttaataatttgaaacagcacttcatatagcagttagaaataataatatagaaatagtaaaattacttttagataaagaaggaattgatgttaatgcaaaatatattcatttgaataatttaaaatatgttttaataatttaaaatatgttttattaattttatatatgttttaataatttagaatatgttttaataatttggaatatgttttaataatttgtaatatgttttaataatttagaatatgttttaataatttgaaatatgttttactaatttgaaacagcacttcatatagcagttagaaataataatatagaaatagtaaaattacttttagataaagaaggaattgatgttaatgcaaaatatattcatttgaataatttataatatgttttaataatttggaatatgttttaataattttatatatgttttaataatttagaatatgttttaataatttgtaatatgttttaataatttagaatatgttttaataatttgaaatatgttttactaatttgaaacagcacttcatatagcagttagaaataataatatagaaatagtaaaattacttttagataaaggaattgatgttaatgcaaaatatattcatttgaataatttataatatgttttaataatttggaatatgttttattaattttatatatgttttaataatttagaatatgttttaataatttagaatatgttttaataatttgtaatatgttttaataatttggaatatattttaatagtttttaatatgttttaataatttggaatatgctttaataatttggaatatgttttaataatttggaatatgttttaataatttgaaatatgttttactaatttgaaacagcacttcaaattgcacaacaattaggttacacagaaatagtaagtttactccttgaaaaaagtacaaacgaaaattctaattcagattcctcttctacaaaatcaaatctttatttttaagaaatagtgaagcatatattgctaataatcaaaatcaactcaaagatcgaatgtatgcagaaaacaatctaaataattgtatcaaaacaaaagttgatataaacacacaaacatatgaaaatcatcgaaatggcaatatacaacataacaaatatccccacaaagcaaaatgtaaataaataaacacaataatattataaagtgcattataagaaaaacttcaacaaaaaattttggaaacaacattacaaagataatgcaaaaatattttataataattgctttgggttcaactgaatcgaaattttgatatctgcaattgttcaatcaaaaaaataatagattcgaccaaatatatattgaattttaaagagacaatattctgagaagtagatgaagttcactaaatttatgtctgttcaggtacaacaaccaagcgagaaaacacttattttatgaaattaacgtacaatttttgaccgtttatttatccgagcatgtacttagtaaaaaaaacgagtaaaaactgtcacaaaacgatagggtgtacataaaaaagtggctaccgggtaccctatcggagggtaccaattcattcataattatcaaaaatttttaggagccgtccgaaattgaatgcaattgagcatatcgttttttacgatatgtatttgttttttttatttggtcatatctcaatatcataattttttttaacaaaatctgacgttttgctccatctattttttatctaacaaatttaattacagcaaaatgacatctaaattatttttttgctactaaaattgacaaggtttgtctgtagcaaaaaacgattgcccaaatctttgagtgaattttttttaattaatttttaaactctaaaaagaaattgaactaaatgtaaagaaataatccaaataaaatcaacataaataatattttattacattttccaatcaataatgaccaaacgaattatttcttaccaaattccctttaaccttatcataatactcagatagttcaatttgcttcgaaaagaattcgcttgccatatccttatctttggatatgcacttgagtatcataccttcgaacatttgccaataattactttcctcttttccccttaatttcgtgaagtatgtctctttagcgatgagcacgtggatttgtacgtaacttttaaggagtatttcaccaggtgctttcttcaatatatttctcatttcattatctttaattttctttgcacttgatataatatgcatttccttcattacttgcatgatcaccttatatttccgtagcaaattcgcctcttgtaatgattttatttcattgataatttgttctgagtatggtacgttttgaatttcaatattcgaaaacatcttttcccatttctctccaaattttcctatttcttcaaaccttttcgaaagctcttcattgattttacttttggttgtttgtacgatcttcgatatgaagcataaaccctgtaaccgatttggcattttttccataattgtggggcgccccgaaaagaacttcaagttcgattcgaccaaaaccgatagacaacattcggcaacgtttttccattcaaaaagtgccttctgcttttgctttaatgccatcaaactttcaaatgaatttgcgccaccaattaacttatttaaacattcgttaaaaacgaagttatagaaatcaccattaccagaatgttgtaataaaaacgaaaagtctctattgaccgaatacattgcattgaattgtctcgaaaattcgggattatcaatctcattcactttataattatcgaaaacaattcttttgcttagcttaattttgttttcttgtggttttgatgtggacgaagttttaggatatgcatgacaccaaaaccatgtgaatttgtaattacgttcgatgtctttgaaatcagaaatgtcaactcctgatttggataaaagattttgcgaattgagaagtttcgcaataagtaatatgtcattgacacatacataaagcataatggatgacatattaaagtcttggaacagaaatggcgtgccaagtgtggaacgcgtgtgaaataacgcatgatagaaattgcgtaaaagatcttttttgatcccaacactactaataacgcgcttaagagccgcacgatgagtagtacaatgcgacgcttcaagccagcgaagggctgcaggccatataaaacgaactaggacgagatttgcaaatactttaggtgaccaatttttggattgtatggcggtaaaaagctgtagaatttgctcaggaaggagactgacagacgatgtgagatagtcgagaagaattggagaatatttttctgataacaaaatcatctcttcttcggttttaggtacggattcaagtagaaactgatcaaaaaatcgtgtaagagcagattcaagaaaacgaaaacttgcaacacttgtgagaaatggttcaataatcattgctgcaaattcttggtctgttgcaagatcaacaatgttgtaatagaagcaatgtgcataatcaagttgttctgagctgctaaaaaagccataaaatgatggaattgaaacaaaaataatatgtttgaaatggttccttcgatttgaaactttcgaatagtctaaaacagccttggcaaaaacgtctggattggttagtagataggataataaaaaagacgcattttgtgagagttgagaaaccccaataaaagtattgacttcagtatgattaaaaatcccatctgaagctctctgatctgagaggtcagggtccttgtcatctcgaatatgaacaagagaataattatataaatttactattctatgtttccgtattatttcttttctggtttcattcaaagatgaattgcatgaaaatgtaacagattcaatatttgaaggaactgttgaattaaggaaatggaatatttcttcatttttgcaatccatttactggaaaccgtttatataatcaaaagtgtcaaaatgatctaagtaacccaattgcggttttaagaacttttttaatcgaatatcatcggaaccaaataaaaagaagcaacaattaacttactgatactactaatccggtagttttaacgattgtttaaatgccataaaattgaatataagcattttttaattttcattttttttctatccatgctttctacgattcaagtgcacattttttggatagttattttttaacatttttttgaaaacaaaatatatctttctcaaaacttccgttttcattttttttaattactatctacttttccccatcagcttatattttttgcatgcctgagttcatgctgtatacaatacattactacatcttgagaatcatggtcaattggaagcaggctttgtccataatttaaaattaatttttataaaagttcatttttggaagtgtggaaactgattaaagttttactcttattccattagttttttcatataaagctaatgagacatatctgggaggttggggtaacaatacttccctatttggatcttatcaatttacaatttcaacaaaaaatttttgcgattttaacaaatctaactctattcaacatgtggaagttttattgcgggaagaaagaaacattatctcatatcagttcaatggcaaatttgattcgacgaatttaatttttaatggattatctttctttgataataatttaacaaaaaatttaatttttgaaataaccaatagcattccaaactattctttggatttatttttaaatttttaccataatttaaccacacaacatctaattgaagtaaaaggtctttattttcaattttttccaaatgcttcatatccagatagtaactatttttatgatccaatagaactaaatggtactattttttctttacaaaatccaatctctttacatggttttaaatttcgttaattcgattatcatgttgaactaattctcttcaacactatatccaatctcttcttaattttttctatatatgcttggaaatctcttgcttttcctcataaaactcattcgctatattgggaggtttccatcattgggatcgttctgcattcaaattttgaatgcgcctttcggccgatatttctgggttgtaaaacgataaccgaaaccgtttttgacacgagcggttttctatattttttccctttaattctttgtctttttggaagtttttttgtgctttttcttattttttatagaaaatttgtttggaggattcaacgtggtgtggctaataaattgataaaactatgtttagctcttgctattttatatactgtttcattatttgttcatgttcttttatttttcttgttgtcttcatgttttaatattgttttacctatagtttattcgtttttcattccacaaataatatataatattatatatccgaataaatataaaaaagatttttggtttaatacttttataactataaatcgaattttttatcttttttacttcggttataggaaatcaaatgttttgggatgtgctcacccattaacatgtacattatctttgatttatttattgttacaatattcgattttaatttgtcaacacttcttcggaggtaattttttttttccaaataagtacaaaatgaaaaaatataaatataaaacagtcacagatgaagaagtagattgcccaatttgctttaacaaggtcaaaagggtcaaattttgatgattacgccttgtaaacattcgtttcataaggattgcttgtcgagatggctggatgataagtttgtatgccctgtttgcagagctcaaataccacataacgatgattgattttaaaataatcatttttaaaaattcatatggtcaatcagttttagaaaattttttacttgttatgttaaaaatattaaaagcgttttaaatatgggggtattttgaagtttggtgtatatcaaatattcaactagatgtatcaaattaattggtattatgcaatcatgactcgccgattgataaccgtcaaggctcgaagaaggtgtaaatatatcaaaaagtcgatctttgacttggataaattgaataaataatacggttatcgataaaaaatgggcgatgaacttggagagctcattcatttcatgaaaaaattaacaaaaattatattaaacttaaacgaagagaacattgaatcatcagttgaattaacctatgaattaatagatgcccattatccatatacatttaatcagattattttaagattaatatattcatcttttgtaattcattttaatcatgcttataaatatattgaatatataaataaaatgataacaaaatttgaaatcaacaaaaataaaattaatcaagaagctttttttaagcctcttctggaattgaatacccaagaatcatattatctccttgagcagatgattgaaaataaaataattgaaccaagttttataagtgatgtcagaagcttatattttgcgcactttcaaactaaagaattcatcaaaaaattcgataaaccctatctaatgaaaccattattttatcaagaatttaaatttaatattgaagaactatcaaagaatgattgggaactccataaacaattaattaaagaaggacataatccaactgaaattgctaaaataattcgaaatgatgaaatagaaaaacttcaagaaatttcatcacaaaatgatttcgattttaatcaaaaaattgaaccatcactttatgaaagatgttcatatattaatgaagaaaatgttacattaattgattatgcagcatttttttctgctattaaatgttttaagtttttattcatgaatggatcaaatataaaaaatacattaaaatatgcaattgtaggaggaaatacagaaataattcatttatgtgagcaaaatcattcatcatttgaaggagtttacaatacgattattaaattccataaaaatgatatttttcattattttttcaataaagaaaaaattgattttcaaaaattgattaatctaggagtccgatgtattagatttgataattatgagctattttcatatttgatatcgaaaatgatggaaataagcaatgatattataaatgaatttgcaagagttggaaatatattctttgtaaaatatttttttaagaaaaaacaaattccgcaaaatattttggtttattcaataaattctggaaattatgaattaattcattttattctgaaacaagaagggatcaatattaatggaagaaatatttatattttaatgtttcaataaaactttttttgaaatttattttaattttatgaaacaccacttattcttgcatcttcaaaaggttatgttgatatcgttaaatttctacttgctaaaaaagaaattgatataaatgcaaaagatgtacctaaaaaaaatttgatatttgttttaaaaatacgaaattaattataatcatttggaccttatttaatttgtattttacagcacttatgagagcatcttggaatggttatatagaaatagttaaattacttattgaacaaaaagaaattgatattaatgctaaagatatttatttattttatttaaaatttatttaatttacttgattataataaaaattttttgattaaaattcatatttggagtttttttataattgtatcaaactgcatttattttagcatcttatagtggtattattgaaattgttaaaatatttttggaaaaaaagaaaattttatttaatttaaatgaaaaagatatatcattatttaacttaattgttaattagatatttgaatatttttaatgtatatttggaatttatttcattcattgtttacagctttaatgttttcttgtcagaataatcatattaacgtagttaaattacttcttgaacaaaaaggtattaatattaatgaaaaaaatacatgtttgttttgtttgatttttattttctttgtttaatatttattaggatattttggaatttacttgaattatttgatactgcatttatgattacaactggacttggtcatattgaaatcgttaaattgcttcttgaacaagaaggaattgatattaatgctaaagacaaaatttattttaataattttatatttcaaaataatatttggaaattatttaaattattttggacagcacttatattagcatctaaatatggtcatacagaaatatttaaattacttcttgaacaagaaggaattgatattaatgctaaaactatttatttcttttatttgatatttattttaataatttgatatatcaatataatatttggaaattatttaaattatttaaaacagcacttattagagcatctgaaaatggtcatacagaaatcgttaaattacttcttgaacaagaaggaattgatattaacgctaaaactatttatttcttttatttaaaatttattttaataattttatatttcaaaataatatttggaaattatttaaattatttaaaacagcacttatattagcatctgaaaatggttatacagaaatagtaaaattacttattgaacaaaaaggaattgatattaacgctaaaactatttatttcttttatttaaaatttattttaataattttatatttcaaaataatatttggaaattatttaaattatttaaaacagcacttatattagcatctgaaaatggttatacagaaatagtaaaattacttattgaacaaaaaggaatagatattaatgcaaaagatattaatatattttaattaatattttattcataaatccgaaattctaattaaatatttggaataattttatctcattatgtacatcactttttttagcatcttatactggaaacttgagcattgttaagttgcttcttgaacaaaaaggaattgatattaatgcaaaagatattaatattttttaattaatatatgttttaataattttatattttatttatctgtttgaaatattttaattttactttatacaccacttctcattgcgtctgataatggtcaaatagacgtggttgagttacttcttaaacataaagaaattgatgttaatgcaaaaattattttatagatttttttaatttttattctctcgttttaatattcgaatattccatttgaaatttattaaagatatttattacagcacttatgatagcattaacaaaaggttacattgaaattgcaaaactacttgatgaacataatagaaatgatatcaatgcaaaagatatttttttgtttcgtttaaatttatcccatagacttggaatttattcacattatttcaaacttcactgatgagttgttgtgttataatcacattacacattaataaacaatacgtttaaaatttttagagagatctaacaacattaaatttaaatctttttcatgataaaattataaagctttaaaattataaaaccttatcaactagaaacaataattaaattttttgtttttattctttcgtgataacattaatgttcaatcgattgaatattttgtagctaaattacttttaataactttcgaaaaaaaaaattgattatgttttgtacaatttattttaagattttatcatttttttttttgtcgaaatgtatgataaatcattaaaaggaaaacgaataacaaattcgatcaaattttatttattcatttaatggtctgaacaaatccccgaacaattctatatgcgacaaccagaacacagttttagcgttatccacgtccatcaaagtaattttaataaaccttgccgggtccaacatatttagtactggccaatagcactcttggttttgtcttttataattctctctattaatattcatatcgaccactgtataatttttatcatcattcgacacctctactttccaagacttaaagaaagcagaaccataatgcgatctcaatgcgtacaaatccaatttcactttcatttgtaggaggtctattttgatccaagtttcttttcctcttggcgatctccaacaagaagaaccttccaccaaatactttgggtcacaagaacttgttatatctattttaccaagttcgtaagggttcccttgttctattctcgttatataatcgaagacgcctttattattattatttggtaaaatcctttcgttttgtaaaggcaaagtaccaaagaattcgacctcaaacaaaaacatacaataattgcccgacccgtttttatctatttgagtaatttttatatatttacatggcttagatacatcgagtatagcccaaatatgatctttcgtattcattgtacttcttctttcatctaataagaaccaatgaataccatcactagagccatctacgcgccatgaatgcatactcggaagcttcttatcaaagaaagtacgcatcatataaccagtggggataatttcatattctttaaagttaaaacatacccatgaattagggatatcaggcgtagaccaatacttttgcgcgttatgatcgacgtcgttatctttttgcttggagcgacttactaataaatgtttactattatgtgacgtgatacgtattaagttaaaatcttgcggattaccattacaacttttacataaataagagaaaacgccttcactcggattatcaagtttttgatgacaattaatgatttgataattcccaatgttcgatttaacatctttgtttaaatatgtaacaagttgattacgaataatgttaatgtttatgttggaattttggattaattgcattgatatttgtggtgttaatgaattggaatccataaattgtatcattttgtttcgttcgtttggattaatttggatataatcatatagccaactcataaaatctggtggtaatggatctttgatatatttcaagtgataatataatatggagttaactaaagttggctgtaattctgtttgaagtgatttgtcttcaattaactcattgatatgtgtgcttagatatcgaatatgtggtcccgtagaaatgtcaatggaaattaaatcattgaataactttaaagatgaagttaagtttaattgcggatataataattgagaagatgtattgatcaagtcttcaatcccaaaatcacaggataataggtataagaagcgtgagttttcgggagtgacttcgatttcttggccaagtaacgtactggcaattaaatcaaaaggtccttcttcggttattcgggaatgtacagaagtcaaaagattgttactaaggtatagatgttgaattcgagtggaataattatatgaaagatataaattaaccggatacattaaaccacaatggattaagttaaggtctaaaaatttctcataaaaattggcgtcaagagtgggattaatatggttgaattgaaatgatattcctgtaacacgttctggataaaatggaagatctggctttacaatttcaaaaggtgaatcaatggaatatttaaatgaggcttcatatgaaaaaaggtcaacaaatttgacaatggcaaagcctaaatgttcattggaataattcattttaacagaaatttctgaagtgcgaagtggtctaaagcgtgctttaaggtattctttggttactttctcactagaaaaaaagataaatatcgataaatcaagttttgtatctggtcttgatctatgaatatgtaataaattatttttaaatacaatactatgtttttgtgaaatgcattcctcttttgacaaacgtttagcaaattctataaaaccaaatcctattggataatcataatctttatatctatgagtaataattttgattcgttttatagacccaaatggcttaaataaatgatacaaatctttttctgtacactctggaataatatttccaaggtaaacagtacaattttcgttcatttgttgcttgacgacggttttaatcgtcttttagcaaaaaaaaattttttgcacagatgataaaattcattaaaaaaaataataagaaaaaaatgttttacatgacagatgacattcgtagttgaataaaacgaagttcaaaaatattaataattattgagtaatgtcaagaataattgaatctatgaagacatcaccactatcttggttcaagtctttgcatgtgattgtcttatcatttatatcctttacatttacaattgatgttgcaggtactcccaaataattatctttacacttcaactgtgggtttatcattattgcgtattggcaatgtattggtctgatagcatttgaaggtacaaatcctaattggtttttcttattttttgccaaaaaccaacagaacccagattcatgttgatactcataaaggtatatgtactctcctttttctaatgatagttcgctttggttctcccctttaaagttatgaatagcgacagcaaagtaacacggagcactttttggtaagagtcgcggccgtttaaacgcttttgtcaatttatgttcttggaaagagaacttatatggcttgaaatagctttgggagatatcggtacgaacaataccttctcttttaacaaattcaacaaaagagttcttccaagaatccgagaaatgaactttaaaggtatctggtatttggattttgacccctttacatatgtcacaaaacattaaaaagatattgagtaagaacgcacgcttctcgttttccatttgtttgatcgtgaccatactttttgaaatagtaatgagatgtcgtgaatgttcattattgattctacgaacaagggatgattgaagtgtgagctgaatagcatagtgtcggaatttggattcaatatcttgtgactttttaggtgaacgtccttgttttggtttggaacttgatttttgggctgaaataagttggttataaaggccatttatagtttcattggactttataagcttttcatataatgatttgtaattttcgaaaatgccattgactttttgtatttcagaatcaataaaagaatcgaagtcaaaaaacatggcaactcttttggtggtaaaattttctttgaccatttgagcaaattgattaaatgtattactgattggttgaaatacagaaaaaaagtcagaacagtttttggttatgaaaccaggaactccaggagctggtggcattttactaattgctgcttcatcaagagcgaatttaggaagaccattaataaattctaatgatatttggtacttatcaaggaaaattgaaataatttcttggtgctttgaagagactattaaggccttttgtataaatgcatcgtatttgccttttaaagcttcgaattctgctttttgttgggcaagttttgcctccatttaaaatttgtctgactaacgtattcaaaacagcaaaatgaaaaataggttaaatcacaaatttaacacactttcttcattttgattttaaacacattcaagaatccatttattagaaatgacttttactaaatacaatgtttaaaaaattcacaagattgattgccaatgaacaataattcatgctaaaaatgaatggcattggctggttgagatctgcattttttttaaaaaaattaattagtataaggcataacttattttgatcgatatatcttaataaacagcaaaaaaactaagatcatgcatgagataataagtgcaattactttttttttagttagtactttttcgatattttggaaacctttttcaaatgcaagtgctgttttaaataatttaaataatttccaaatattatttttaaatattaaattattaaaataaatctcaaataaaataaacatggatttttagtattaatatcaattcttttttgttcagaaagaaatttaactatttctatttccagactgtgatgcatttataagtgctgtttcaactgaataaaataaattccaaatattatttataaatttaaaattattgaaacaaactttagacaatataaaaaaagttgctgctaataagaatacatgtcattagttttgtacaatcattgaaatatggttatgtttcattcgtataacttccagtggcatatatgattaaaagctttttcttaccaatacaagggcttccagttgaaacaaatcgaactgtttgggtggtacttttagaaatgaattcatttatattaacgtgcgctctttgtgataaaagtgtcaaaactccacttttatttacttcatcatggtaaaaccgttttcttcattgaactatgtaaacggttatcattcaaaagacaataaatttcaattagtttacttaggagatgtagcacactgtcctgcagactggtggatttgactttgtgcagagcttacggcatctctttggcattcttttatatacattttcatcatcatttgcaataactgaaatgatctttgaaccaatcttgataaccttagtaacaaccttgataacctttccaagcttcttgaagaacttcttaagtctaaatttgttttcaccaagttctggggcttcttcgagaacatattcaacttcatattcatcatcatcttcttcatcgtttgtaacttcatcaattacatcaacaaccttctttgtcttgtcaacgacatctttgatcttcttaatgactttcttaatcttgaatttgttttcgtcataatcgtattcatcatcattttgaatagaaactggtgggattattggctcagttgggactgtcgttaaaattgttggctcaagtttaattggtatccttattgagcgtaaagcaaggagagcaaaaaacattttggcaatttgataccgatttaaatattttttcaactcacacaaactttgaattataattcaatattgaattaaatttaattcaaaaccaggccagcgtttttttacaaacggtttgaattgttgtaaaaaaacattttgaggggtgaaaaccgtcgtcataaaacaagagctcctgggtggaatcagaggaattgattacaggatggtaagtaccccacgtgcaatgccgaggagttttgttgcagaagctgaaggcctgctaacgcaacccctcatttatttttgcacatggtttttttaatccccaccaattcaaaacgatcaatttcaacacaaaaacgctaaccgtcgccataaaaagacgataagtattcaatccttttcaattcaatcttaagattggttaaaaagtccttcttgtttttcattttgttgaaatttcatttctttttagttactcacggcttgagtgaaaatttccttcatatacaagaaattaaatttaaatgaagatttgccccgttatttttagtgaccactcattaaactgtattataattttattgtttattgatattaattaaaaaaaatatatttcaatgataaagattgctcttatttcataatttaactatttctgaatgaccatttaaatatgctttcataagtgctgttttaaataatttaaataatttccaaatattatattgatatatcaaattattaaaataaatatcaaataaaagaaataaatagttttagcattaatatcaattccttcttgttcaagaagtaatttaaatatttctgtatgaccatatttagatgctaatgtaagtgctgtataaaataatttaaataatttccaaatattatattgatatatcaaattattaaaataaatatcaaataaaacaaataaatatctttagcattaatatcaattccttcttgatctaaaatatatttaacagattcaatatttcctgattcgactgaacatattaaaatattttacggaattggattttctttaagaaaatatataatcaaattttgtttgtgatgatattttttgaagtttttcgacttcatcatttcgaatcatttttgcgatttcattcggattatgtccttctttaatatattttttatgaagcttccaatcattctttgatatttcttcataattggcaaatattttttcaaaactgagtgcgtgcttattcttttcaatttcttctttggtcatataatgtataaaaaaagggttttgatctgttttttaatatttctgtatccactgtattattttctatcatttttaaatggggacaatttacttcttgattaaagtgaagaataaattgagaaaaaaacatcaaaaatttttggtttgatcttattactttcttgaagtgtctggatttctttcataaaatcaaaacatatgtcaaaatcattcaatccaacaaaattgtaggaaaatataaattgacttattacttgattaaaagaatatggatagtcataatcaaatttggcaataattgattctgattgagaaatgttttctttgtttaaatttaatataacttgttgaattgtttcaataatttccaattcttttatttttggctttttatcttctttattagaattgcttgttttttccatttaaaatgaatcaattgataatgtcacttttaatattctttttaataacaaagaaaaggaattttaactttttgaacattttgacagcttccaatcattttataacttcacactagtgtaaagtattcattctgctttacgacaacgatacagatttttgagatagctcctgctgttttttaataatatcattttgaagggtctaccaaggatcatataaatatcaaaacttttatgcaaaatctccaatttttttattagacatgcaatgtaaaactttagcaagtattaataactcaattttctataatagagaatacttacagatatgaatgaaaatgaactaacccctgttgcactttttcgaaaaaaacaaaaatatccttatatctacttattcaatgagaaaataaactaatatgtttgttgttaatttttattagattttattgtttttatgtttataacttaatattgtcctcagatgaagtgatatggaaattttcagaaatattgatattttcactttttttcttcacacatcagatattttaaatatcttgtgtgtttattcaaaagaaccttctgggaagtattccttggtaataaatttttacttggtgtttttttgttcttgatataaatttgattcatcaaaattgatgtttcatatttcaataaattcgaatgaatttatcactttttcctgatcaaaaatgattctccttaagttatcatcaagttcagacataattccagctctcgcgaagctagcgcgtacatttgtgcgtgtcgtaacctgttcataagcccgaaatattttttcggttaaagcagcaacatcattcaaacttttctttgaagtaagtctattttttacattttttagtccaccaaatattacaagatcaagcatctggaaaatgtcggagatatgaggaggaaatgtaatcacgagctaaaaatcaatttttagcgagaatttccaaaatctcggggtcacaatgtgttgaatgatcattcattagtataactgcgaattcatttgaaaatccatcaatactcctttgacgacttacatatggtaggaatactttaattatatatccatataatatcttatttgttacatagagtgaattagatttcgatatttttaaatctatatcttccctcacacctgttttaaaaatttgtttcgcttgggggctggtagcaataaccattgcacaattgcatcccctgctgcgctaacgcatgccattaatgtttgatgccttactgagcgctttactggaaccattactggcttttggcataaatttctaggggcgataacagtttttatcttcttatcttcccactcacttgaccccatttcataaatgttaaacacaagttcagcagctttcccaacaacatatttctttatattttcaatatgtttgttcaaaaaaaattcttggtacgctcactcttgtgttatcttatggaattgcttttgtggaactgatttgtgaaacatttcttccaaagaatcccgagagccatccttttgttattacttgatgaaactgctctcttatgtagtgcagaagttcttgttttgtaacaaatttgtttttatctgctatatcaaatatatatttcaatatttgttcttcttcttaatcatcaagatttttgggacgtcccaactctttttttatgttttttgccttttttctaatatttgcgattacgccatgacttgtgccaaatatttctcctaatcttttgttattgagcaaagtatgacattctaattcgcaatattcgcgcataaaaatgacttgttcgtttctagtttgtagcttcaaaaaatcaggatttcttaataaagctcttcgatctgataggcttaagctagtgtgatttagcctttctcttaagatatcaatcgagatagctggagctttgcgtagatcgcttgttttttgcatttttctcaaaaaagtgaaaagtgcaacaggggttagtacatttttattcatatctggatatagtttatttataaaaatatcgaaaatttagttttgatcagagaattttcataaataacacataattattatatctagaaattttatttctcttcatagaaaggtgaacaacacaaaaaataaataacatttgtgatcaaaaatttgaacatacatgaaaacttactcatcatataggcggtatccaaaaaggcgaggaacaaaccgttctggattgccttgaggaacaacaaagtgattgtatttttgtataaatatatgaacccatgaattaccaaaaaatgatccatcaactaaggcatcatctgcattttctgggtaatatgtttcattacagtttgggcaaaaaaatgctagtcttgattgaccaaaatcattagattgcccaaatggtaaacattgagtttcatggcaaagaactcttggacaattttcaaattcatggtttttatatttttcgtacatttttgatagaccttcgcttgttaataaataccttgaatgaatcaatccataaagaatcatagcatattctccgatgttatttggccactcagcaggcatttccgattgtggaatatattttccttgaattaattcataagcgtatctaaaataaggaactttttgcgcgagtccatataaattaaagctattatttaaataatgttcatcaacttttacaaaatatttcccaattggttgggataaaaaccaatcaacccaagagtaatccatccaaaccccctcctgaattgtgtgatcaaaatcaattgaatatttttattcttttatgaactcactttaaatagatttttctcaatcaattaatcatatttgttaattttaattgtatttatctattaggaaaattatttctttttggaaattgcaaaattaatttattggaatcaatccttattttctattttggtgatacatcacaatcatacctaaagcccccatgaaaaactctctactactatatacaacctataataaagtatatatgtatatatttgtagtatgtgcatttcactctcaatgcttttttaaatgatctatcgtttaagggatcttcattttttacaacaatcttctgtatttttggcaataagtattttctgttacaaggatcattatatattttcccaagcatttcttttcacgatagtgtagacagattttcactgcgtctttacaccttctttaggtatttttatctaaaaaaaaaacaaattttaaaagtcacatcataaggaatgctccttaaaaagcattttttccataaaaaaaaataactttcaaattaatattttatttaaaatttgtcttcttcaaaccacaaattattcgaactttatcgactcgatcaaatcagctgctctattttctcccatatttctcaactcctttaaagccatttcagtataacctaaagctgccaatattgcgtaggtctggtccttcattttcatataatttagtgtgtcaattagctttgatgttaatctttctttttcatcattggtaagttttgttttaaacaatactaaagcaccttcgatatcattaacagacaacagatgttttgccgcctcgaaataatcattcaccaaatgtaatatatcaattgcgtcttcaaacttttccgagttaattaacgatccaacggctagcatgacacttttttcatcaagtttcgccgataccaaaccggccttcaaaatgttctgtgtaaacttctcattatttgaaggagttgagaacaaaaccgaaaacgcgtcatcgtcttttccgaccactttcatcaatcgaatttttcgtgaaataaattccaatgaatctcccactaatatcatttcatttaaatgttttaagaacaattcattattgacgttaacaccataagcagaaaagtcgaatgaatcctttataaaaggtttaattcgatctgcaatataaaacaaatcgaattttttcgcattttcataaacatttttaatgcttaagtcattagaaatgatttctttgaacttatcgaaacttaaatattccgatttcttgaaattattccgaatgggctcgaaagtagggaactgaaacaaaacaaaagaactcattcctttaactaatgcaataacaatttcattcgtcaaaaacgccaaatttttaaattgatatttaatttgatttgttgttatgtttccattttcgtcagtcttacatagaagtggtgaaccagagtcaaacattataacgcaagaaaaccaatcttgtgaagaaatgattgatttaattttattattagaatttgatattaaactcattttttcggaatctatataatatatttcaccaatagttgatgtacataaatatgtaccacaaccaaattgtataattgttaaaggttctcctttaatactttgtatgagaatattttgttgtacttcgaaattcggtaatgaaataatttgaataacatttcgtaagaaaaagataacatttccatcacaagtgaaatatgttgaacatttccgtggtaataagaaatgtttaaataattcaggtttagatcctttttggatcatataaaataataataaaaatggttcgatttctaatatgaaatatttaccttgttgttgaggaatgattttgataggtttagcggaaagtgactctatctgtggttttaataatgaaataatttccatcgtttcgaaatcaataaaatatattttatgatgttcattaattgtcgtacatgaaattaccatttgagtgttggaaataaattcggtttgattgatcgtggtgatttgttctatatataaattgattcgtttctttggaattatatttgaaattgtgttttgaaatagatttatgtttccatctttaaatgtaatggagacaaaatcatcattcgatgctattaaatgtgtaggttggtctggaatagattgatataaacttgccacaaataatttctctttatatatcttgataagcattaattcatgtgttaaacttgaaataataaacgttcgctcgtctatcggctgaaaagtgccaatgtctttgatttgaatttcatgaattgtttcccattcacttgattcattaaccttggtaagacatatggaattacgctgtataattgctaaaagatgtgtgcaatatgtcggttgaaaaataccaagcatttcagaaaaattggtactaaattttggtgcaaagatacaacgatctttgatataaccaaataaaatctttttggttgagaggacaaagaatgattctcgtgcatgagaaagaaatccacaatttgcaagttcacatttatctttgtctttaattgtgtcaactgatattagacatattggatttgtttcatatatgttattaagaattcgtatttctcctttctttgatcctacgattaatgaattatgattattttcatcaatatctaaaaaatcaattgaaaaatcatattgagtagaccacatttttgagatgctcattaacgtgtctgaaagttcattagatttggttaataaaatgttgaatattcggccatctgcagttcctaaaaaaagttgattaatataatcacgtgaccatgtgcactgtgtaaaatatgtaccggtaacggaatatttggcaattattgtattatctgaaaaatcaataaagcaagaatttccatctttaaatgcaagaaacaaaatatcaggaataagtgattcttgcttatatgctctgcaccaagcagcgcaagttatatctgaattaagcttttgtgaacaataaaatgaagatatatctgagttattattaattatcttatatgtaaatagattctttctggaatataatgctacaattccatttcttgagcacgctaaatttattgaagcaccattttcatgagaataagtccataaaaagccatccattttttacacacaaaaagttatttttttttctaaacaacgtagaaaaaattgaatgcaccgacattccttacaaaaagtcgtaaacaatcacttcgtttccgcacgccactgccagtgtttttgttccaggcactatatctattgcactaacacatttccctttcttatctacactttcttttgcaggtgatctaaatatattttttcgagattcttttcctactttgaatttttcaacttctcctgttttctttgcaatgtataatttcccattgtaaaatccagtgccaatggattcatcattaatccatgatgaccgaaagaattccttaccagatttgttgattttattcatcttaaaacctttactagatgaaataggtatatgagaaaatggttcacttgtgtttcgtacgtcccaaaaaagtaaatcaaagaaacttcgcgtgaagaaatatgttccatcaggtgaaaacttgcattcattaataaaagttagatcatttccaatatttttagttacgtctgcacgaaaatttggtttgttttgttttggctgaattcgtaaatcaataatgttacaaaaacctgattcatcgcctgaaagaagaagatcatattgtgttggatggaaatcaacacgtgtaataagtgaatcatttgtataaacatttaaatgtggatcgaaattatcaatgcgacgaataaatacatcattgccttctgaataacaaagtgtgagattgtctctacaaatacaaatggagttaaaatatgaatctgagatgggctggaaatgttcaacttcttttgcagttagaacacacttttctggaatagaaaatgatggaaattctaatccatttgggttatatggtgaatttaaaataggtttgggctgttcagagatgagccaaataccaattttgcgtgagctacaacatgctaaaattggcttcccttgatattgaaaaaaatctgtatctaagatgcaaccgttgatttgtttttgaagtgctggatctacttcgtcattagaaccgatccattgtagtgttttattccattcaccattagatgacttttcaaataataacatctcgccagattgagaacctgcgcataaaacgtcacatttactggaaattgataaggatgtaaacctgctttgtgatgtttttggttgactaaatctatatttttgtctgatttttttctgttttttcattaaaatgacgatagaagatttggcggttaattttttagttcaagttacgttaagtgaccgtttatttattggcttcgtttttttttcacttttcttatgctttcaaaatgatttggctgtgcgcatcgtttacagtttaatgtcaaatgaatatcgtattaagtatattgataattgcatttggcagagatgcttcatgtgttgtaaataattcaagtttacatcaatcaatttttaaaatttcgaaagatttttttcgattcttcaaacacaataaaacacaaaataatcttttagaagaaaaaaccaaaaagctgtatgataggtatattaaaaatttcttttctaacttacaaacatctaatttaaatgaaaattttcgcttaattttcaacaaaaataatgataaaatcgatgacactgatatacaaatgaatgtgaggaacgaaaaacttcttgcgtcagacgatacaatttggtttgagcttatttcttatggaagattccaaaacggcgacaaatttgggtttacaattgttgatgcacccaggagtgacatggaatttaagtacataaataagcaatgcacttggagtagtgatataatacgaactggtatttattttgaagatcgagatgaaacaataacctttactgtatattatccatatttttcagatgtgaattcacaaggatataaaattattaatactaatgtagtgcaaacatcatcggcaaagaaacaattaaacatcattgcagaaacatcagaaacttattacggaaaaccaaaccctcaaattcaaatgtatactataacgccaattcttgaaattacaattcaacttggttctggattcgatccgaatgaaatatcatcaacgaattggcgattttatattagtggattaaagcacgaaggcacatttaatgttaagacacatgcagtcagtgctgattccaatgcaagtattattaatgattatgaaattacgaatggagaatatacgaataatgtttcaagaggcacaagagtttataatgtatatgctcttgaacaaaaatatgaagaattaacaattaaagcaacaataaatggagaaacattttataaacgatatgattctgctgaaattaaaactctaatgatacgtcattataattttacattgaatagaccaacaaatacatttactaaatcaaatacatttactaaatcaaatacatttactaaatcaaatacatttactaaatcaaatacatttacacaatcaaatacatttactaagtcagattcatttatcaagtcgaatacattttatgaaacatttctaaacagtgaatctttaacttattcatttgtattaattcaatctgtaacaaatacgaaaacacttcttattaatacatttttgtcgcaatcattatatttaacatttagtaatttaaatagttatttcaagtattcagaattcatattttataaatatacaattattcaatatttaatttcatattcattttattcaaaatattattttatcatcaaagaaaacgaagaaaatgttcaaaatgataatgaacataatattcttataattatttgtgttgttattattgttataatcattgtttgtttgattctcattatttatatttatcgacgaaaacataaaaaaaattcaccatcatttgaagaaaacgaaatgaacgaagaaaatgacaaaaattataaaaatgaaggaaatgttatcgatcacaaaatcataaacattcagatgaatcatattgaagaagatccatttgcgaatgatttccaagataatgaatttgataatcacattcaaatataaataatttttaattatatcattcatcaatgtttatataaattttgaatttcttcatttgacatttctttacatcgtcgaattcattatcatttttaattattttttactaaatgtaacaaattctttttaatttacatttaatgttaacattgaagaataaaaatattttcccatcaatgatcacattaatgaatccagcaaaaattttatgcatcctaaagaattcgattgttttctcttcatgcaccaattagccatcacgataaaatcttcgtaatgcattgtacataaaatactttttgttgtgaagatgtttatcaactcttaacatgttcaaatgcattctgaagacaatatttaaatttaatgataaataaagaaatcaaactcgtttagatgtgtttttctattttttccgtcttatctgtgcacttgttatctttttaaatgtggcttcctttcaataatatcgcaacgattgtatggaaacataaaattttatgtatacgaaaaaatctcattaattacaaatcatttaattgattcaaatgaattcataagtccttgcataaaagatgagcattctatcgttaaggaacttctaattttattagcacggtagaaattttattcgtaatgtaagggaacaaatcaattaaggtgaattaaatatattcaatttagacaaaaaactaagttgaccaaaaaagaggaaaccagaactcgaatcagaactaataagtttgactatagctaatagaagaatgggaattaaggagttagcaaatcacatgattttcagatatatctgaaaatccaaatttctcaaatatctcatcatgaatagtacactcatacacacaaataatgttggatctgccccatggtggtgcactaatttgttaaaaaataatttattcatttatattacataaattaagttttcggttcgtcactcgattgtgaactttactcatacgatatatttctatgtaatttgatcggcatataaattgagtatgtttgtttgggaaatcttctgaactggtttcgatcatttcagatacaaattgtataaattagtaattaataatatttcatattttaaataattattggatacaggaagaggaaaagaaaattgctaataattaattttataatggagatgtaattaatgtatatttttaagagcaagagaaagatgtagaacaattcatcatcacgacttgcacgaaatggcttcacaccatgtgcccaaaaggggaaaacgggggattttgttcaatattgttgcgagttttctgggttcccagcccaactgctaaattttcaaaaaaataggttgtccattcttcatcaatgtgtcaaagacaaaacaaggcttccacctctcctccttggatgttaggcacaaccaccctacaattgatacagattttattatcgataaaaatatcgaaaatgaaattcatgttcttcatgccgccgattgctccatccacccataggctctcctcttgacataagctcttttaattcaaataaaaacaaaattcatacaaaaatttttgacaattgaattgtggataatattgattaacgacattagcagttgactcacttgataacacattcacaaccattcaacttgaaactttaaaggaccaaggaaaccaaagtctactgctttaattttgaaattcgaattttccactttttttaccacttttatgtaaagtccttatctggtgcggacataagcgctttcaaatttgaacttcctgttcataaaatgactttcttttttcttcttttttcacattctttgcagacatacgatagtaaaacaaaaacgcttacaataaataatccaagtgaatttaatgatgactaccaattaagtactctacatattattattggagaaggaatcaaagaaattccaaaaaatgcatttgaactgtggataggtgtactttctgtggatatcggtaattcagttactttaattggaacgagtgcatttatgtcgtgtatcaatttgataacaattatttttgggtgaaaatttaactacgattaatgccactgcatttgcagggtgtccaataacaaacattagcatacccaaaatctgtttcttcaattaactcagattcatttatgaggtgtcataagcttaatcacattgcaatatctgaagacaacgcacactattccaactttaataacgatggtgttatatatgataaagacatcacaacaattatttttttcccatctgccaaaaaaaccgaatatcaaattccggatacaatcataaccattggcaaattatcattttttgaatgtataaattcacaagatttaataataccaaataatgtcttaattattgaagcgaatgcatttatgttatcaagttttaagtcaattacaattggtgataatgttaaaacgattgaagctgcattttcatattcggtaattgagaacataacaatttcgagttctgttacttcaatatccgaaaatgcatttaaagaatgtaatcatcttcaatacattaaagtttcggaacaaaatccgaaatattccaattatgaaaacgacggaattttatacgacaaaaatgtttcatatcttatacaatatccacaaggaaacaaaaacgaaatatttaatataccaaattcagttgatacaattcgaaatgaatcattttctggctgtaataacattaaaattgttacaattcctgaatcagttacattaattcaacaaaattatttcggctcttgtaaaaatcttcgaattattaacatatcgaaatcaaatccaaaatattccaattatgaaaatgatggagttgtttatgataaaaatattacgaaattaattgtatatcctttatttaaagaaatttctgatttaattttaccaaatactttaattaacattggcaaaagtgctttttctaaagtcaaatttttggtaaacttaacaattccaaattccgtaaaaataattgaagaattagcttttaatgaatgttataatttaacaactctatatatcggggaaaatgtggaagaaattcaatcattagcgttttctgagtgcttcaaactacaatgtatttatttttatggtgaaaataaaccaacagttgctgagaatgcgtttaatcaagttcgagcaaaaattgtaatgacatcagaaacatataaaagtagcaaatttggtgctttagatgtagctaaaggaaaattaatcgatgaatgcaatccaagttatggtgtcgaagataataataaatggaaaattgttgttggagtttgcgttccaattggagttataattgtcatcggagtgattttgatcgctaggaaaaagaagatgaatcggaaaaataatttatcgagtatttcaaacgaatacgaaaaattaaactaaataaatttaataattttgaataaaataataaaactgagtgaaatcaggttgaaacgcttcaactaatttgagatttactgtatcctgaatagaattttaacatataacagtaattccatctgaataaataaataaatggtacagctgtttgctttttgtttggcttgctttacaaaattaaatatccgaaaagtgacacatctacaaaataaatcacttgcttaacaaaaatattgtcttgctttggaaaagtaaatgtctaaaattgagaagtttacatatgctatacaaaaaaaatgtctatcctatcaaaaagattctcttgcttcacaaaagtaattggcaaaaaagtgacgattataaaaaaaagtgtcttgctttacaaaagtaaatatttaaaaattgaataaaaataaatttgacacaacactttatttgaattatttgtgccttaattatttttttgccctgtaggggtacatatgcgatgagcatatttactttttctctccattttcatgagaatacaaattttgcttaaaatcaataaaattgttcaaaatatatttaaatacatacactgttcaaatctaaaattagttaactaaaaattcaacacattttgatcaccttttaaattgaaaagataattggttgaatgtataactgcttacgattaaatgcaattcaattacaaactctataacaatgaattagggtgccctaagacattatctcaagtttcggagttttctccaatatggaagtcaaagccatgccaactaacagaggaaatctccaaatattacaagatctagaaaaaattatatttgatttaaatgaaaataatattgatcaattagttgaatcttcattaaattacatttcttgagaatttcaatattctattcttcatatcatttgtagaattatttattcatattttgtatcacgtggctatgaaaaattatgtctcaagtatttacaaacaatcgaaacaaagtcaagttataatatcatcaacattttcactcaattattattattaactgatagtcaagaatcaaattatcttcttgaaaaattgattgaagacgagataatttaaccaaaaattatccaaacatattttatgcattatttcccagaaaaagaaaacactaacaagcaaatagaagaacttaaagaaaatgattttgaactgcataagaaattaattgaagaaggacataatccaaatgaaatttcaaaaataattcgaaatgatgaaatagaaaaacttcaagaaatatcatcacaaacaaattttgattttaaccaaacaattgaaccatcactttatgaaagatgttcatttgttaataaagaaaatgttacattaattgattatgcagcatttttttcttctgttaaatgtttcaaatatttacttgtgaatggttctgatatagaaaatacaggtaaatatgcgaatgcaggtgggaatttagaaattcttcatttatgtgaacaaaatcattcatcatttgaaaatgcatatgaaacagcagttaaatttcatcaaaacgatatctttcattatttatatgaagaaaaaatgtgtaaaaatctaagttatctaaaatttattaagattttctgatgtgattatgttccatagaacagagtccaatcttgacaatgattgactaaccattccagttagtgtagtagattcaaatcgccacacactatcaactggtctctgttatgtggcttttgagacagaagaagttttggaatttctatggaagtgcattttctcagatgacaatgttggagctttaaataaggttatcatcactgatgaagatcaagcatataaatcggttatagcgaagctattacattgaccaaggtacatattatgcgccttgcacaaatctaaaaatttttacatatatttaaaaatgagcgattttacaaaagaaaaagagcatgagagttaaggagcatgagtgttcaggaatgtgatatttcaagaccatgaaaattcataaatgtgaaagttagaagcattttcattcttagatcaaattggaatttggcgccaaaaagaatatacaattttcaatagcaatataaattttaggtaaatccactttttctatactatgccatgccgtacaaatgatcctaaaaaaaatagggaaaattatattttcattaatattataaaagaaaaatccttgctttatctcgattttctcccattcttgttctcaaatcagattcaattcgtgtcaatttagaaaaccctcgttctttttgtaaaaggttcggcgtttttgtgatatttgggtgaatattgcacgattgtacgatcgaatttccgatcatttatagggttaaaatgtttccagggtataacggtggcccctattgaattattgtatgatttattttttcgaattttttaatttttactttataaatgacgctttacacaagataaaattaaattaagaaaatcgaatagaacaagtgtcataatatggattatgggtaaattattctatcgtatcatatattaatttgaagatatttactaatgtaatatatgaaaactccattatcaactaagtaatattatagaaaatcatgaaaaacaaaaatgtaataagttcaaactatttcccctcaattggtttgtgtttttttttttttttacctacatcataattgtttaaaactgtgttcatttcatgaatctctagaaattattcacttttttcatcaaattttattaaatgctatacctggtatatttaagttttgtaattccatgttttatgacaattgttaataatatagggcaccccattttatcgaacgttattggcagttatcgaaaaaacaaaacaattgaagaagttcgtttgccattccatgaagggaacgagaacagaccaagaagacattcattcagtatcttcagaccaacttcaaattgatgatgaatttaatcgttgttacagtggcgaaccaatggaaccaatttttgagctaaatgatattgataacaaagaaggattttgcatctttcctaaaaatttaattcttgatcacaggtaccaactaaaagaagtcattggacgaggtacattttgtcttgtttggttagcacatgatctcatattaaaagaaaatgtagcaataaaaattctcaaaggcacatctgatgaagaatatgaagatgaatttataatcaatagttatctttgcgataacatgtcttctgatgtcaaacttgttaaatttcatcgacttttccatcacaacaagcatgcatgttttgtatttgaacttgttgcccacaacatccttacgtttctcaattattttgatgccacttatattcaacttccaatccccctcatcaaaaagattgcaaaagatacacttttaggacttgaatacatgcacaagaaaggtgttattcatacagatctcaagcctgaaaatgttatgtgtacatcacccctttttccatacaaaggatttccaggattatcgcaaaaagtatttcatccacttgaagatgatcctaatttagttagctttaagcttggtgacattgggaatgcatgttttgttaacaatgttttaaatgatttgattcaaaccagacaatatcgttcaccagaagttcttcttggtcttccatataacacttctgccgacatatggtccctagcttgcatgacattcgagctcgcaactaggcaccacctctttgaccccgttttcgaaggagaagaggaagaagaagaagaaaccattgaaaatcgggcggtttttgatgcgtttcacatttcactgatcgaaacggttatggggccgataccacatgactgggctcttgaaggacattgttatgatgagttatataatgagaatggcgagctaaggtataagacaagcgaaagtgaaacaacattgtttaacttgttggtgggatataatttgacaaaggaagacgcagctgatatagctgagttcatcgagccaatgctggcaataatcccgagccagagaccatccgcagaagaactgcttttctctccatggttgaataagatttgatataataaaacaacttggtgttattgctcaataacaatttataatttatagattttttaatgtgtttaatatgtttcttattatgtattcattattcagtgatgaattcctataaaaatttgactgcaagaaaaaaattaaaaattgggactccgcggactcgaaccacgtacctcacgatcttcagtcgtgtgctctcccaggtgagctagagtccctgttgattttaacaaaaaaagagtgcttgtattggatatttttctataaattaaaatattcgctttattttgcgctgtataatattatcaatatatttcgctgcataatgagacacatgaaaaaataatgaaatatctccaaacttacgcacaacgccctaaaaaagatgttcaatttaaaaatataattttgcttcattacaataaaaatttaatcatcaacaaatataaagaattcacacaccaacgataaaatctgtacacgataagataaaccgaatgaaattacatttaaaacatgtaaaacattaaaaaagtggaatctgaaggtgatgtttatccttcacgaataagaaattatttaatcgaaaagatcatcgaatccaccagctaattcgacaacttcttcctcttccttcttctcttccttcttttcttctccagctggagcagatgcagcggctgcagcttgcatcttagcaagtgcctctggatcagcaagaagtgcttggacatctgcgatttgcttcatttggtagtcaatggcaacagcaattgatgcaatatccttgaatgctgagccaaccatatgtggagcagatgcagcattgacatagccaattccaatggaaagaccagcaacgttcttgagggctgtggcgaactttccagaaaggacttcatcggaaatttcaaggatgcttggttcataaagatttccattatcgtaaagtttgacaagtttaagggtgtacttgaatggcatgatgttaaggagaccgagtaagttagcttctgaggcaccaaccttttcaccttctttgataagaagtttttctgatgtgatttcaatggtacccttgaagatcttggattggatgtttaaggcgtgaagaacggaaacttgtgttggtggaagggttgtacgcattggtggaacaacaacatcacatggtgagatagcaccaactttagctggtgaacccttacagtggttgtcgatgacatctttgatctttgagaatgatccgtttgtgaagcagaagccaacgccgtggtagataagtggttcaagaacttcgatgttcttaagttcgctcttaagttcttcaacaactcttctcatgagtgagttcttaccgaaaacaatttcggcaagaccttgaagatcgtgacggattccaagaagttgagaagctgtaacattctcggcggaaacaagggcaagcttgttatacttgtggaacatttccttgaatttagcgcagaaatcaagcttcttttgtgggattttcttctcgtgatgcatcagagataaaggacggccaaggccaagtcaatttgcggcggttagttgtcatatggtcggggaactttttgtatatggatatggggcgggccaaaaaaaatgaataaaataatttcatgtaacatgtccgttttaaaccatgctgcgaagaatttcaaagattgcagcaaaaaatgacgataatacaaaacaaacaaatgcggttaagccaattcaaacaaataagaaagttgttaataaaaatataacaaaatataattatcaatcatattcttccaaaaaattccttttaaatacttataaaatttatgatgactttcacacaaactttcaagtaactatttttaacatattatctaatattaaccaagcaaatctttttatttatgctgattatttctttaagtctatattacctcaaaattcccaatacagtgagtcgggtattgtcgctacagtaacattcacagaatcagatttacaatattttgcaaatgcaattattcaagctgtttatcgaagaccacaaaattacagttcaattgccaagtttgtttcgattttcttcaatttccttagtgaaaaatcccaatttttaaaagaattatttgataattcacctgatcttcaaccaattttccgtggctttctttatcgctacagaattctccagccacctccacaaggctgtaccaattctctaatttattattcatatggtaccacaaataatgatgatgatattctttccactttcaacattccttctgatataaatttgaagtcaactttgactgacaatgaaactgccgtcttcagttcctacacagcgcttcttaacgatgattcgcaatatcttatcagcactagtgatcaacaaattatctatagttatggttcgaatcacattgttcggcttccgctttgttttgctgctgcttattttggtgctgagtcatgttttaacatgcttaacattaaatcattttcaacgaccatatcagaaaacttcgaatgccaaacaatcgaagaagctgcagctgcaggtggctccataggcattttagaggctctaaaatcatcgggacatgcttttaatgaatcatgcatcaaatgcgcaattcgtcatcatcacttaaacgcgacgagttggctgctggacgagttaaatatcgattttagaacaaacggaaacgttttcttgaaattaattggaatcactgcaaaaattggagcgttccatattgcgcagttcttgtgcgatgaattcaaaaatgttgacgacgaactcaagaaaagaatagaatacgaactgcacttctttccgatagtactacagatatataataagcaaataaaaatataaattcttaatgatcaagatttcacttttttcccatagaatagatgtgaatttgtttgaaagtataacaaaaaaaaattgttaaattaattgtagatcagatgtgagtttatacaaaattcgatgagagtgattttaaagaacgaatgaagaggtacttgattcagaataagaaaagaataaacaattatggcatgggtcaatatttataattaatatttcattcgctaagaaaatggtatttcacttctcataacattgggtgagttatatacatgaagacttttaaatgattttgataatctatgaataaattaatattaaagagtctaaattaccacgacataactcacattctttatcaccataaacattctatataaaaacaaggaaaatttatgtcatgatattttttatcttttgttaaaaaattataataaatacaaaactttattcctggatttgttctgatgtgtgcttctggtcatgctgtccaaccagaaatgttttatatgtatctaaatgttccatctgttcttatttgtgcgaaacatttaggataaccacaatcgatgattacatccccgcttccttttgaagtattacttggataataatatttaacaaaaaaatcattgttttgaaggatcaattccaagtcgacgaagttctgaaaaatcaactttaactgtttttgtaactggagctttcttcagttggacaagtccaggatgctggtaatcaacacgaataagattcctaatttttgatatgatgcaattagtcgagttttcatttttcgctttagaaaaccatttcactaattgaagtgcatctgagattgtgtctgagtcaggttctgcactttcgattacaacatgtggagaaggacgatttttcaaatgacaccaaataaaatcttgatgagaatgtctaattagaaaaccattttctttctcattctcaccaaccttgatatgtataccagacgaagaaacaaactctctcataaaaatttttgtttttcacatgtggaatggtcacaagaaccgaaatccaattttcatagcaaaatttttcacttttcaaaagtttatggtataagaccgtttaatttgttgtgaacgaaccgaaaaaaattgaatgaaaagtttgcatgtaaactttataaactttaggctatttcatgaaaatttttctgtaaaaatgacttattaccgaataagttttatttcaataaatttattccggaataagtctgtttcggaattagtattaaatttagtacattgtctgttcgaaacatgggtacttgtttttattgtaataaaatttttatgatatacaaattaaagatatattttgttcattatcttcaaacattttcaaaacatttcatatggtttttttatttctcaaaaaaatatgttttaaaattcattatcttggtttcattttttctgtgatctaatacagggggctgaaaaagtatccaacccacctttcaaaaatgctaaaatcttaatattaataaatttagttaatgtttttaattaatgtattcaccattgtttctaatgacatcttccaatcaattaatccattcatggaacacattttgaaggtcttcgaaagtaagattgtcccatatttctttaatggcactttttaactctttttcatcgttaaatgatttacctgcgaacttgtttttcgagtatccgaaaaaccagaagtcacttggtgcaatatcgggggaatatggcggatggggtgctcttattagtccgcttttttttatacaatcagtggtcacttttgaattatgaatgcgacagttgtccatatgaataaacatttccttaacctttttttttctagtaccaattcgtccatttttgacgatgctggataaaatgcatccacaaaaatgtgttgaattaaattttaaactcaaatctaaaatcttaactgttacaaggccaacaccagtaaagaatattgtaaccatccgtttttttgtattgatactttgtctcaaccttggtgtaacagaatctggatttggtgcccattgaaatacatgatcataatgcatattaaaccaactttcatcaccagtaataatattggcaaaattgtttggttcatctgccttaagtatctttaaaagttcttctgattcttggtccctttttaatttttgttcattagtgagtaaatgaggaatccattcttttggatattttttataattcattactaataagtttctcttaacaaaaaatttatcaacgtggaaagcttttgccattaccttggttgatgcataaggttcatcattgagaaaatttaaaattaatttcttaatatcgatttttggccttccactccttgggagatcttcgcctgtggttctaccctccttccagcttttgatccaaaattttatttggatttcagagtatgcttcctccttatacgtttcatctaattgctttttgattttcctgcaaccttggccttgtagcattaaaaaatgaatgacatacatttgctcaatagacataataccaattattttaaacgttcgaaaatttaaacgtatataactttccactgaatttatattttttaaaaatttgtatatacttaaatacacaagagtttatacttatatataaataccattttatgttttaattcattcttaataaagaattacaggggtgggtcgggtactttttcacccccctgtaaaatgatttctatgattataatttcacaaaagttgttgtaagtcgaaattatcatgatacaaaatttttcgagatctatcatcgatgaaacttattaaatatttttgttcttccccttaccttttatctaagtaatgaagatcagtgtttcaaatctgattaacaaatggcgcaacaaatctaagtttatgttcattttcaggtttatattctttttcaaacataaataaatcattactttcataaacctttcggatctggttctgagaaacactctatcctttacttagagaaacatctgtcatccttttgtaaccaactctgaatttttaagtgtattgcaaaatgatatcgatcgcattttgttctacattctttaaatgcctccctcttttgagttttggatattcaatattattcttttgaaaaactttctgaaatgaagtgttggaacacctaaagtgagaagaaatttctcgcatagtaattcgctcttcttcaagcaacatatttattatcaaaatattaactttagagaggagttcaagatgatttccaaaattgaacaagatgttttcttcggaaattttagttttcacttccttttcatttttcgtgtatactaatgaattttgaagagtttcaactagatgctcatcaataatttctctatcattgatttttgcttccttacaaaacaagaaaaatgtgtgatcaaaattattgaactttaaatatccagcaataagtttattggccatctcacttgtcacagtggtagtaagacaggattgatgtggaggatatttaataaaatcaaaagaatgatcacctgaatcaatgttaccatttgcagcttgactaattgcatttgtgagtattaaaataatctctagtacgtattgatgctgttggtctcgattaaacataaatttccatcattgtttgatgctctggatccatcgattgtatatattttgacattaccactttttcaattgattttgatcgttctcgaaagtggagtgacatttccgcgcaccatagctgtaattatttttttaatgtcctctatcgagttaaaatcaagtaaagtattcaagttcattggtcacttcacaggaaaatgacgttgaaacaaactgagtagggagataaaaatttcaaaattaacaaatgaacaaattaaatatatcaacttagattattaggaaacttaaatttaaattcgaatatggatgtactatgcgatttatggaaggctttgaaaaaaacatgcgaaaaatattcactgaaaaggttcatttgtcatagacacctcattgaactatttaacccataatcattggcagaatttctaataacgaggctctgtcaaactattaaaaagaaaagtaaattaagtacatttaatagaatagctaatttagtcgattatgtgatagaatctcatagaaatttcaatgggaatggaaaagctggaataataagaaacataaatagacttcgaataaaagcagagtttcgaattataaaaagagaaaatattcaaaattttacaaaggatgattgcacatgtgatgcaaaaaaaattaatgagcagagatatggatcaaaagacgctgattgccttcacacttgcttatgtccttatagaaatatagagggtgatgaatttgttcttgatcattttaatatcactgatccgatcattagatatcaaaaatcaaatctagaatggccagatgttcagaaaaagaaaaaattcaaactttatcaaatcgatctagatgcggaaaacaaatacatatcgactcatgttaaaatgctagaaacaattgaagagatcaaaccagagattgttgtaggacacttggagctacaaatattggaaatatatcgagtggttatagaagaggaaaaatttgctaatctggatggtaattctcgtgaaattataaagaaatggaggaaacgagtttatgcttctattttccaggaggatttctttcaaaaccaagggaaaaagtaaaaattaacaattaacgatatatttctgcatgaaaatctgaggttattgctcataatatatcaatttttattcgacagttatttattatatatatttgttttcaaaaacaactgcttttaatttttcagcgaccatttatgaacagttatgaaaaaagcaatttcaaaatgatgaaatcatattccctttagcttctgtgtcatagtcattcattcgtatggaaattaagtattatatatatattattgtagagaaatttgattaattttatcatttaacacatatataacaaatacattatattggtacataattaacaactgatcaattttatcttttttatagtaaggtctgattggtgtgaaaatgtctgaaatgaagtgaaaatctgtcactctgacatctatcggcccttctcaaaattgaatgaaggctaaacgtacgagcaattttaagccagttttctgggtgaaaaaatgtagttatcaatgaataaacaatatccattcaatacataattttttttcctttatgaatgtatcataaaaactcaaaaatcatcaaattttaagaataatttcgattttgaaaatctgtgtaaaactcgagttttttgatataattcgattgaaatatatgagcgcatttataagcatacaaaattttgtgaaaatttcctttactgattcaatttcacttcatttttatttgtgagatgaattcaaattctattccgacattgacgcaatgctgcaatacttttggttttggtgatggcatgaaggtccacacttcatgtcgtagtgctgaatttcgttccgaaaaatcattactcattcgcattaatttaatcaaaaaaattcatccaacaataactgtaaatcaattgtgacaagttctcggcatatctacgcgcaaatactatatagcgcatagaggtgatgatgtcaacgttataaaagaaaaaattccaccaccagcacaattactaactgaagaagaagtaattttcatttattaattctatttttaatggacaatgccacaattcttgtctcacaggaaaagaagtcagggatattgcatctgaaatatataagaaaaggacagttatagatcgtgatttcagtcgagattggtgttttaattttcgtaaaagacatcaagatcgaattacaaaagtcaaagttccatgcgtagatgtagaaagagcttcaattgatattgctcaagttcatcaatatattgccaatatcgagcgcattttgactgaccctccaaatccgcattcattgataaatttcgatgaaacgggtttcagcaagcgaccagataagggtaaaacaaaaagcgtttttatatgcaatgattgtgaaataaaaccatactggagggcaacagtcgaacagcatcacatatctcttgtagcagcaattacagcttcatttctatcaatacgaccacttttactgtctaccaggaagacttttgatcaagatctcaaagaaactttcttttgtcgatgggggacatgaatttatactcctaagggatatatgacgcaggattcgatgctattttgggtcaaatattaccttgctccatatgttaaattaattcgtgataacatagaaggaaacaagcattgtgtaataatcgctgatggatgcacggcacattttggacccgaaattgagcaagcacttaatgaaatcggagatatcgaatttattccaattccgtctcactcaagtcatatagttcaaatgcttgatgtgtctttgttctctgcactgaacagaaaatattcaacaatttttgttgacaaagcatattccaagtttactcaaacactttaaaaaatcaaaaaggcatatcaatcctctgtcaatgaggaattgattcgaagttcgtgggaagctgcaggatttaaattgaaaattcacaatggtcaagtaattgacattgaattcgaagaagaatttagggataaattaataagagaagcaacacatgaatatgttgcagataactaaaaatttatcaacaagaaatgaagtgaaattgaatcagtaaaggaaattttcacaaaattttgtatgcttataaatgcgctcatatatttcaatcgaattatatcaaaaaactcgagttttacacagattttcaaaatcgaaattattcttaaaatttgatgatttttgagttttcatgatacattcataaaggaaaaaaattatgtattgaatggatattgtttattcattgataactacattttttcacccagaaaactggcttaaaattgctcgtacgtttagccttcattcaattttgagaagggccgatagatgtcagagtgacagattttcacttcatttcagacattttcacaccaatcagaccttactataatataaaaaatagattcacagaataatttttaaaaattttttcaagtgcgtgtcaattttctgcttcatcaaagtatggaatttcaaaaaaatgttttttattcgaaattttcattttcgcatttttttaaaagatattgtgattctcaaaaaacgaaaaaaattaaatgtatcgttcatacaaaaagttgtacgaacgattatttttagtttaaaaaaatcatagctttatcccatggatgtgaccccattttttttaaatcatttaatcacgtgaacttttcgcttttaaaatttaaaaaaaaatagataaaacattaaaataaaaaaaaatttgatttgatgaggatattttgacggttatgctgtcaattttgaatgcatttaattttcagagctgaaaaaatgtcattcagaaaacataacatcaacatgtcgactaactacactttagcggaatcatagctataaataaatgaaacgaaccacatattgtcttacactaagcagatcaaaattcgatattttacgaatgtcatttattaatattattaataatgtaatgttgtgcataatgttatttacaaatgttatacataaatgttattcattaatgaacataataataaatgatcagtaataattaataataaagaatgataaatctaatgtttaatgatgactattatatttaattagtaatgataaatgttaaaaatgaattatgatcaataataataatgaatgaataaaataattaataaagaatgaatgcatatattagtatgtattatttataataatcataagatctaaatttcgaatgcaatcaaattgagattaaaaaattcactttaataaaattaatgaaactttgatatgatcaataattattaatgtttgttaatattataataattctgaaattattaattcatcatttataattcagatatttttattacaaacaaaatatcacttttgagttgaatatcgtatgtcaaattgttttgaatgtgtcgtttttatttacggtttttccgcgtattaattgaatactcattcaataattgaatacgactcaatttttcaaaaaatatcatcatttcttcccataaatacaaattattttaatcaaaaaaaacattatagatatacgttgctaaatgtgtagattcgattaatgctatcggaatttcaaaataaaaatatttttttaaatcgatcttattctattttataattaattttttgaagatttaatatcaaattatttaattactttatataagttatattatgaattaattttatctatgatctgtaagtttgatttacgaagtttagaaaaaattaaaataattggaattttttatgattgaatcggcatgcattcaaaaaagtaagtatttgaatggtttattacgtaaagcgcgtataaaagtgcgtatgtgaaatatgctcccatatgaataaaaacaaagcatgaataaaaaatgaaactcataataaaaaaacaataataattattataaaaaatccaaataaaaataaataaaaattgattttctattcatattgaatatctttgagtgctattagaaaagcattcaacaaatttttttttttttcgtctttcctaaataaatctaaataaataatgaccttctatatatttttgatttttatggactgaacacagtaacatctgataccattccatattccctcaatggtattggtatgattccttcatcggatttaaatccttcgggatggtctacttgtttgagtgtaattacaattgtaaaaatctagatttttgtttaatattcgattgctggcatgtatgcacttcaacaatctgtatatattattgatcctttttctacatcaaaaaaatcatattagataaggtttcgatgtttctattgtttaccttttgtgcgaaaagtttcttttctggtgttctttctactcctcccatgacccatgatccttctactgacatccactctggatgtcctctatggtgctcatttttcccaaaaaaatctacagaagatacaatgattttattgaaaatcaaattgatggtatgataatggagaagtttcgagagtttttatttctgactttatatttcaaactttaactaatcttctcaaacttatgccaaatttctgacttcggaaaaatctatttggagatggccaaaattctcaaacttttgccaaatttattttacggaacttatcaaaatttgaatacaattttacggttattggaaaattcaaaacaaaatttctagaataaccatttattattttataatgacatttacaggtatgcctaaaaatactatagtgagtttatatttggaaaaaaaattgctattgataattataagaaatttaagaattgattatcagtatcaatcttttgaacttcaaatgataagttcaaatgaagggcaattggaattatggaagcaaaatactgatttgttgaaagaaaagcaaaaaagacaataaactagacaacaaataaaaaaatacttggaattttcaccgaattgttgttgatattgataagcaatttaataattgattattaatatccacctcttgcacttcatataataagcgcaagtgagaaacaaatggaataatttcttctgaataagaaaaaaaatatttttcaatttttggtttagtgcatttctggaaccactggatcattttcagtcaaaaaataattgaaaatatgaaagtttgttaaagcactacaaaagatatacgtcatttcgtatctatctaattcaaaggataatcttgaaaacatgattttccataaacttttgtgtctaccaaaccatctttcaacaatgactctatcatgattgatattttaattgtaattttgttgttgtgttgttaatccgtttcttgttttcttgaaggtgtttctgcaccaggataaatatttttaatttctatatatcccttatcaaaaatagctgttggagcaaatttatttgggaacattgatatgtaacgattcatttcagataaatagatatttagtaatccacttttttggaacattttgaagtcatgtgtagaacctttaactgatcctcttaaatcaattaacaatccttttggaccaacagctgcttgcattttgatacaatgtttcttatgttttcctgaataccaatctaagtttgattttgatacttgtacagaagcatcaatagcacgtgtagcaaatggaaaatgttcaaataaaatcccatctctttcattttctttttgtgaaatccatcgaactgcaaaattgaataaaatgttatgacaaattgaaattgtttgaaagacaattcttttcaaataggaattgtcataaccaaattgcatttgaaggaaaacaaaactcaaagcatgcttacaagagcatagtgctattaaaaacattgttttaattgaaagttttggttttcttccacttgtatgagcattttccagataaggttctatgacttggaaaaaaattaagaattcttgacatttgaaatttgtcaatgttttcatcatgtgatcatcttcttgactaataataaaatctgcatcatatttcatttaatcttcttcatcatcacttgatattcaatcaatagcaagattaatttcctgttaaaactagtttttcattttcttcgaaagtttcaagattaaaattcattagaaaaatttaaaaaaattcatgttttcaaaattgaataagttcacaaaagttcgtaaaattttgctgaagtttgaaatatttaacaaaatttgaattaatttaattaaagtataaataatttggcataagtttgagaacattggcttaatttgaatgagtttggtttttatttctgcataacttactaaactttcaaaatctttcgaaacattccaaaccatttctctgaaaaagtgggatcgttcgaaatttatttttcaaaaatcgattgaaataaattggaaatttggtctgcggttatgtaattgatccgtaatacattatgcccaactactactattaaggttcttatattaattcttaaaaaaataataagatgtatctgctaaaaaaaatacgattgcaactagttattcaaataaaaaaaatagaaaaatttgtaacgttatgggacgccccgttctacgaaataggggggtgacaatcggattcgaacgaaaaacgttcaaaggaataaaaaagtactgggtgcgtcaaaggaaccgcttgcaattgaaaggaattgaacatatcggattttcccgataggttttgttcgatttttaatcggcaaagggtaattcctcgttgtaaaaaaacgatgggaaatttcaatgaaaataattcaataaaaaatgcttaacatttatgacaatgatttttgtgtggatatggtatgtgtcatggtgattttcaataatatgtgtcaaaatgttatcaaatattgtcgaaataaatgaattacactcaaaaagtattagaacaaacgaatcacattcaaaaagtgtcagaataaatgaaacacattcaaaagtgtcagaataaatgattcacattcaaaaaatataggaataaatggatttaaatttccaagcaataagcagtcttataagccaaggatttcattcttcatatattactcaaattacaggtgcatctttttctcgcacagagatcgttacttgcaaaaaatgccagaaatatatgaaatttaacatacaaaatatgaattttagatgtacaaatcgattatgttttacaaccgttcatgcttattctcctctcccttatgaatcagttaaagctgatatcaataaaattctatttatattcgcttgcttttgtgccgatttttcgattcacactacccacgaggttgtcggaatgtcaatgccaacaattattcattggtttgacatcttccgacaagaaatgataagaaaaaatttaaatgaaatgacaagcaatcctttaaaagattatatgcagatcgacgaaagcgtttttacaaaacgttaaaaccatgtgggaagaattgtcccacaacaatgggtatttggaggttgcgatgggaacaaaggaggaagagtttattttttttctgttccaaacaggaagatataaactctccaacccattattaaattaatgattgctccttcatcacttattgtaagtgatgaatggaaatcatattcttatttaaataaagattcttattcccatttaacagtaaatcattctcagaactttgtggatcctcaaactttagcacatacacaacgaatcgaatctttatgggctgcggcaaaactttggcgaagaaaaaaaggttactcagataaaaataaattatctgattaccttcacgaattttgttttagggtcaatcatggaagagatttcggatatatttggaaaaatcttttcagataaaatcaaacattaattagaaattatttttattttattttattattattattattattattattattattattattattattattattattattattattattattattattattattattattattattattattattattattattattattattattattattattattattattattattattattattattattattattattattattattattattattattattattattattattattattattattattattattattaatagagagatgtaacaataggtttacttaaaattctgaatttttgaaaaaagaatatcataataaagaaatctttcatttgattgatataatttgatatttgatttaataaaaattatctttcatgtatttttatttatatatatttatgattaacaatatgataaatacaatatgaataataatatgattaacagaatcctgttataataaccaatatacgattcatttattctgacattatttgataacattttgccacatactaatgaaaatcacatgacacataccatatccacacaaaaatcattgtcataaatgttaagcattttttattgaattattttcattgaaatttcccatcgtttttttacaacgaggaattaccctttgccgattaaaaatcgaacaaaacctatcgggaaaatccgatatgttcaattcctttcaattgcgggcggttcctttagcgcacccaaagtacttttttcgaaatatgtcacttttaacgataaacatcagctttttccagaataaaatctttttccgaaaaatatcttttaaattcccttttaaacccttgtaagtactctatctgaaggacttcttttcgttgtaagtttttatcataaatgtaacatcctaaaatatattggtcatcatgataattaataaattggtttggcagagaagaaatattaattaacaaaaccatttgtttagaatataatcaaactttgtttttattacatcaagtttagctggttatgccattcctgccacttgtcgaacaaatgcatcgataacatcaccatctttgagattaagatcatctggtgtttgttcttcattgatcctttcaccctgatggaaaaatctcatggttgttggatcaattcctgtacgtttacaatacacgttgaataatctccccatctttgcccttttcttaactctgaaatatatctcttctccttgagggtcttttattgttaagttaacagtttcttgagttgaagaatcttgtgatgggtcaggttttggtgaagtttctgattccatttaagttttgaccatagcgcacgttatctggtgtaaagaattcaattttatttggttgcaactatcggggcacccccataaatttatcgtatgttttccatctcatgtttgaagattttaacactctttttttattattttttaattgatcaatacaccatattccataaaagcatatatttctatcaaattaacaaataaacttacttctgcacgatatttattgtattttgtattacgttgctctttaatatgtttatcctattactttctagttgccatatggtgtttcctgttcaataatcttttttatgagtttttcaaaaaaaaattcagtttgctttgcttcttaaacgacgctaattgcaggcttcttgaacaaaaaacaatatttttaaaacaaatttgtatgtttactaataaataaataccttatttacgttttgaatgaaattattccattcttcaagaacatcattatttttcggtaaaacgaaatgatcaattaatgaaagcaaactcagccagccatttttaatgtattcgcagtaattcatcaattttttcgattgcgaaatcaacggcaccgctgttgtcaggcaaaagcagaagcattttacgaagctaagtttacactcatcgcttaaaatggacacaaaagtattatacattgcaattttctttctttccttatcaaacccacaaaatctcaaactcaaattcattacaattatcggtattttcttaattatcattttccgatctttttcgaatatttttttcaaatgatttttcattttttcgatttctttttcaggcaaaaactcttcgtccgtatttttcaccaatttctcagcaattaatctatagatcttttggtttcgtggcatgtttcgattttcagtttctcgccaaaactttataactttcgtcggttcatatttcttgttttcgaatgatattaattcgattacattttctttcgctcgtaataagatatcatttaacgtgttattgaaatcttttagcgctaaagcaatttcataatcgcaaatatgatcaatgtatttattcgataatttcttcagagcaaaacattggaattcttcatctcgaataagtggaatttctttgttgagtttcttgatgataatattatgattcgtagaataaaatttcttaaataaatcaagtacactgtacttatgtattaggccaaaatgaagaagtgcgcgaaatcctttttcaaattgagatatttgtgcttgagaatattcacatcttaagtcgaattctttcggcatctcaagtaaaaattcttctttaagtcttcgcttggactcgattttctcttcttcaggaaaattaaaatgaaaatcaatgtaatatatgaaattcaatttttggatttgtttgtcatcagacttcaattttaacatcttaactaatatgggaacttcatacttggatagaaaaaaatgtattgtagagttggcataagctttagcagtggataaagagttaagatacgaaaaaccgccgtaaattgaatacttatttggttgggtgaagcggttgttagtaaatgacttggcaaaaagaacaaatgatgggatttcaatgttggatgagataaagttcaaggcgttaacaagggttttagaattgttccgtatttttacatgtgggataagaagaagatcaatgaaagcaaatgcaaatagtcgtttatcttgattataacaaatagatgcaatttcggtgtgttcgggtgtgaggagagtgcacgcgtgttgtattgataacatgaaattgttgaagcatttaattggtaatggattattttcaatttcaagcattagttcatcatattttgcgaataaagaactaataaataatggataggattcaaagaatgaacaaacaaaatgtcctgagatatgtggtaaggtttgagaaatcaatgattttataatgggaacagccatgttgaatgtcttaggaaacataaaataagaaaaaatagctggaaatgttacgtgagaaaataaacataaatcacttaaaccattttggaaataatttttgatgttttcagtcatctgctgtacatcgtttttctgaatgatgtctgttagtttgcttttaatgtttgtgatcaaaccagagcttgttgaataatatttcataaaatgaaagatttctttacctggtatcttcttattcggcctaagctcttctccaaatctaaagtttaccattaaataagaagagatttgaaagttttggaaaatatttttgaattcattctccgtagttttgtactcattttcagtgtttgtatggaactcgtattttgtgtgtagttgtaaaacattttcatacaattcggttgtttgcgtgcatttcatttagtgatttgctgtggtattcaagccgctttttgaataaactttttaaatatacacgatagaatactttccttattgtttttgctcagtaattacattgtaattttaattttacttacggtagcatcaaataatcaaaatgtaaatttcataaaaccagaagaaactttcatcaaagtatatccttcctttaaaagcaaactaaacacaaatttggtaatgatgtgtttaatattccaatcagtgataacaaatgtgatatcttaattataattgggataaaccttttaaagatgattttactcttttcaatggcaaaaaatgattcatcagttttaatatattttgaataaaagaaacaaattttataattattatatatttattatcatattaatttgttttagaacatcgtgatgattattttccgattccccaaacttctaaatcaattactttaaattgcacttttgatgttaactgtaatgaattgaatgctttacatttttcgctgaagcctttcatcaagtttctatctaagtaaatcgctgcagcattactacttccgcacataagctcatcctgggaataatatgtaaagtattttgcagtccttgcccatctataacaaacaaattgaggagtatatgtaaatacaaaactatcaccacttccataacttgatgtagaactgacagaaacgccgttcgaagagaaaaatccaattgtatctcccgtggaagtctttatcagaattacacatgaacgaattcttttaagtgttgaagaaagagcttgatatgagacgccatcacgtgaaagccgatacttcaaaaaccatttgagtgtcttgaagcgtaaaggtagagaggagcgaagcggaattgatgatgagctatcaagtatcgatgattcaccatctgaaaaagcaggcttctctatggactttttagacttttcgggcggagtcatgaatttcgtaagtggtggaggtgtatagttaatttctgcttgtaattttgcagcacgagtttcaagaactttctgatattcggtaagctcagatagcttgccagtaaaaacgtatgtatcaagagatgtgtcatcatctaatatatagagaaaataaactgttagtaatgatagtgaatcttcgctgataacttcatctggaaaactaaaaagttcacatggatgtggttctatagtggatgcaacaagacccttgatgtcaatagtgattggttttattgattttgaatatggatcaaaacgaatacattcatcaagtaaaagtaataatccattaatcggcgctgggcgattaaatatctgtgagtcaattggattcaaattatttagtgttgaatcaagttcaatgattattttatcaccaggaattacatcctggatattattaatttgcctgatagaaaaaattggaacaccaaatttgagggcaattaattgaagggtatcatcattctgaacggtgtactcaactttgttcctttccattcagaatcaaatttgataataggaaataaagcattgaattcaattcaattttacaattctcagattttaatatgcggtttatatcaaatattggatactttacgtttataattacatcaacatctgttcattccgatgtatcatgtttcatatcagttatatatcacatagagaaaaacaaaaacagtgaaaaatctcaacatattcccaaatttatttatacagtaatttatatataccatatattaaagaatttattattgaaacataatttttaaaataaatcttcaaaaatttttaaattttacgcaacaaaatatatcaattaactttatcaaaacaattattttcttactgcatttctttggttcacaaacccagcaattctttgcccatttctttgaggatataccatttgaggtcttgactttttcggtgacatagtatgtaatgttgcaggtcctctaaatttcgcgagtctacttggtctttccgtagttggtgagtgagctctatttgcagcagttgccgcctccattttttgcatttcattttgtatttgatttacgtctacttgtatactttcatttgtatttaatggagatgaaagtattgaaggagcgaaagtaaatggtggtggaatagtgattgcatttttctccactttttgagttgtttcttctttcttttgaaccttatcgtcttcactttttgaagggtttacatgctcatcaatttttgatgtgctaattacatcagtatttcttctaatgctaactttcggctttggaatagggccatcatgtttactttcgttacttattctattaaatttatgtcttacttccttacttaaatcatcttttgaaagacttgttcttcttctagttctagcttctccattatttcttctcaaggaaggcggagatttattttggaaaggaagtgaaggaggaggagacattggtggtacactaattgaactttcattaacattttgttttcttattcttaatttatttcctttattagcattaggaggcaacggcggcatttcttttttcctttttctaattctttcaccattatcatttttatttaaataatttataattttttcatttctaattatttcagtttcattattaatattatccttcaatacaacagcagctatatttgataaaaccttttcgataacaatagcatcggacacgtcaatatttttcttaccacaattaatttcatttattgcaaaattatcagttgtattagacattgtcgaaagagataatcttcttattgcttgttgatttttcatttcttgtgaatgtgatcttcttaaagcagataatcttctggagtttgaattctcagtcaaattctttctattttctactggcaaataagttgttctacttgctattattgaatgacaacaattcatattaagtatattactccacatttcttgtttgaacaagttattaattggtattttaggtgcatctgattgttctatttccttaatccaacttgggcataactttatagtatacaaagtacttaaaggtaatttacttttgaactcgatacctccatatattataatatccaaattatctaatactgcaccacttgcatatcttaatgactctggaaagttaccattatcttcgacttttttaacatttaatccaaacaaatcaatgacaaatgtattacaaattggcttatctgatattccgccaattattatcatttctttccctaatattaatgatatatgagcttttcttgcattaattgagtttaatatttgttctttcttccattcatttgtattaaaattaaatgaccataaatcattcaataaacctttatgacctttgcccccgaaaataaacatcttatccctaaaaactactgctgaatgatcgacacgaggttcagggaaagcgccagaaaactttaattgttcaatcgattctttcgttggatctaagacccaaatttcggaatttaatccttttgctttagttttacctccatagatatataatttgtttttataagttacacatgtatgtccataacgataaaattggattcggatacagaactgacgccatttttgagtctgcatatcgaatcgcattatttcgggtatttccttaataccgacgaatcctccgattacatataatgaatcattaagatatgaaaatgtacatcttcttctaccaatgataccactttcgattgttgtcatttcagacaatggataattatggaaatacttttgatgataagtcgaaaaatcggaatatattaatctttgtgatgttgatacaccgccattaaatattattgacttaccattagtaatacaattatgttgacaaatcgatggtaatgaatccgaaatagaatttaatgaccaaatcattaacttcggctttgtattttgtttgaatgatatttcatctaagagacgttgtaagttatcggagaattgcgtcttctcttccaacttagaaaacgtaacacataattctcgtcgctcgaacttattcactttcgaatcgcgaacaaatggtattaatatcgaacgaaactctccaacaattggtaagtaatgaaataccgaaattgatttctcgaatattaacttcgctgttttccctcgatcaatatatatgaagacaatatcattacagagacataattgcgcattttgtgaattcttcttatcaactaatgtgacctcaactaacattacaattcgacgttgtggatccacaaatttaatgtcatatttccgtaacttatcttcgatcttcttcaacacggtcatttgtttcgcacgttctgtaaggacatctgcatctttgttaatgcgctcaatgacttccgttgctaatggtaacatttgcgcgtcgggatgataatgcggagtaattttgaccagctcgcgaagaaataataagtaacgtggtaacctttggattggagtgatcaaatatgacatcagatctcggccatcattaacttgttgaagttccgaaagaatcgacgaaaacgctttgttcaccttctttaatgtcaatagttcggtgattgtcggatataatgatatgtaatgaactgatgaacgaagtttgtcttcatactcaaggaaaatggagctgacacaggccgcgtagttgttacgctccgactcgcaaaacgcggtgtagaattctgtatgtgatttttggatgtcggggaagtcatgaaagataatgtcccgctcattgtctgtgagaatccccttcgatttgagttgcggatgccatacgtctgtgagatatttgaggtcatcgataaattggagttccgtttgtttgacttcgtgtaaaagattcgcacgtcgttggaatttacggactgacgactccgggaattcgattttcaccgatatttcgaccggattctcgaagtttatgtatggcgcgatgatgatattcttcgagatgatctctttgtcgatcatcaagtatttgattgtcatctcgcactcgaatgtgctttgtattttgttgcagatgtcttccgctgtgagagtattgagtaatacgatacttaaattgatcggaaatttcggtatacaaaacgctgtgttatgttttatggtgagaaataagttgaatgtgtcctttggtatggaaattgtttgataaagataatattctggtcgatcatatttcgactgatgttgataacttaaaagctgtggatacgttctgagcggtatatctttcatggacaaaagatgcataaaatatggagtacatatccatacgggtaacgaatcatctaatattcgtttgtcaatgaatttttgtatcgtaagccctttgcatttggattcctcgaggtatttgttggggtggccatcataacatacgcaaaaataccgaggtgccatgtttgggtttagcgggtatttttcctttgaattttttcttgttggatttcaatggagcccaaaatcagtaacgatagaaatttgtgtggattttgatacgatgggctctgaaatgttctgaaaatgactttcgaaaagtaaactatttcatctatctaaatataagtaatttaaagttaaaattataataaatatctttcctaaatggtattgtttctaataatatgatttattctatgacaaaaataattggaattttatgttttggtaggaaatttagccattaacggtctctttgtgatggataattggaattaaatactttattttttatgttgtgggtttttggacaaaatcatttgttttgtcttactcttaaatagatgtaaatgcaaaaattattgacagtgataaaattggtgaagtaattcaactagttgaaaagtttctcaattatattgatcatttttctcagaattttaataatgtgaagcatttggttttgtaacatttattagatgaattgttaactatttttatctttctttttgtgtatgcacaagcaattcaacaattttagtgtgaggatattgagatgctgctttaagtgctgaaacaaatattttgaaataaaaaatgattaattttaattctatataagttaaataaacattttttatatttatatcgatatctttttgttcaataagtagtttaacagtttcggtataacatttttcggatgccaaaataagtgctgtatatcaaatgatgtaaatatttgcctttgattattttcaaacataaaatttttaaataaaacatcgagataaaaaaaagaacagttcgattattgatataaattaatttttgttgaagatgtaatttgactatatccgcatttcctttttcagatgcaaaaataagtgctgttaaaattgatttgttgatgtattagtggtaaaattgaaatatcaaatatgaaaaacaaagtataaaatactattagcattaacatcaatttctgaatgttcaagaagaattttaacaatttcagtatatcctttttctgatgcaatcataagtgctgttacaaatattttaaacaattcccaaatattgatttattaaaataaatatcaaataaaacaaataaaaatattttgaattaatatcaattcctttttgggaaagaagtaatttaactatttttatgttaccattataagatgcataaataaatgctgttctaagaaaactaaattatcgccaaatattactcataaacaaattataaaaaacattaattttatataaaatattactaatgttgcatataattcctacttgttcaagaagtaatttaactattactgtatgaccattgcaagatgcttcaataagtgctgtccaaaataatttaaataatttccaaatattattttgaaataacaaattattaaaataaatattaaataaaacatataaatacctttagcattaatattaattccttcttgttcgagaagtaatttgttgtacatctttcacaactttttgatatcctgttgaaaaactgggtaacaaccataaaccatagaacaatggatacccgtttttcatatttcaacatttcgtacaattcttttcatcctttgatgtagaaatgaatatgaaaagaaaatttatcaaaattggcggcgttataaatataatattttaaatgttacaattgtaattttttatagaacaaaataaaaaatgtatctaataaaaaaagccaccggcgggactcgaacccgcaaccccaagattaagagtcttatgctctagccgattgagctacgatggctgtcgaatagagaaagaagatataatataaaatagatttataaaattaagataaatgtaataacatctctcaaaaacaagaatcaaaaaatttttttgacgtatttttcttaactttttaaaatattttttaattaaataaggaatcatgaaaattcataaagcattacacatttaataatctttaaatccattgatcttcctcttttaatgcgtaatttttgatctcttcatcaataaattcaatgtgttgttcatgtggctcattttttacagcaatgtatgttgatgattttgttgattgtttattgttttttttatataaaaaaattaagaaaaatccaataatgataaaaattattcctgctggagcacatacagcaccaataagaacttttgttgatatgttattttgtttattattgcaatttgataatgaaataagataagtataaaattgataataagttgaataaatgatagtagtgtagtcataccaaatatatctggttagagaataagtatataatgaattaattttggaaataataaatgaatttgttataaatgaattatgaatagaaattgtatatgtaatcgataaaatatatgttaaaacataagaattggatatatgtgaaattggatttagttcagtaattaaactactttgagaaaatgtatcagaataaggtaaagattttgaagaatatgtaatagattccgaaaatacgttcgatgcagtaaaaatacttgattgttcaaatgtttgtgttggcattggtaaacatttatcaagtgttcctttggttatattgaattttccgaatttttcaccttgatatgattcacttaccataatagatgtgaccgatgtttcagaaaaactattaatatcaattgttggagaggtttttccataaaaatacacacatttaagtgaagtacaatgcccaaatgtgttagctccaatatatgtcacattttttccaatgaaaactgtttctaaatgttcacaataacgaaatcctgatgattgaataagtttaacagagtttggaatcactatacttgtaaatgcacaacttataaatgaagaatctttaattatacttactctgtttccaaatgaaattgatgataaattagtacatgaattaaatgcattattttcaattgaagtcactgaatctggaattttaaatgtttccaatctatttcctggtggataactaataagtttcgtaactttcttattgtataaaactccatcattttcataattagaataatgtgaattttctgatggaatttttataatttgaagactagaacagtgaagaaatggattatttgatattgaagtaactgatcttggaattgtgacatttttaagattataacatttctgaaacataagtgatccaattgttttaacaccatcagagaaaaatacagtttcaagactatcacaaagacagaatacattttgaccaatttttgtaaggggacttttcaatgttatattttttaatgcggtgcaatatccaaatgcataatcactgatatttgttatccctttaccaaatgaaacatattctaaactagaacaattttcaaatgccttttctccaattatagtaactgtatcattaatcacagctgtaatcaatgatttccacatataaaaagcttttggtggaatttctgttattttacttgaaatgataacatgttttgtgatactttgatatgtggttgtaaattcactcgaatttgttatagttaaagtatcgttattaaaaatttgtaaagaatgcgaaaacaaggatataagtactataattgtaatattaatttttgtcttcttttttatttgaagaagaattaattcaagtttttcttaaaaaaaatgatttattttataaattcaaaaatataaaaacaacatttgaagacatgtctcaacaaatttaatttaaaaaatattattctaaattggttttgaatttcttaaattagaatcaaatagaataaaaacataaatgaatagaattacaaattttatattgaaataagcaacctaaattgattataaatcactctaataactgtaaaaaaagtgaacgataaaattcaatcatcggataaaatatttttttctttttgtatattatttatataaaaacaatgaaaatttgttttataaatttcattctgttttaaacaaattttttagcgtaacgaatttttaaacaaaaaaaaatttagattcttaataacaacaattttaatttaatatacatccgcattttttaccagttttatattctcattgaaagcgaactgatcacaagcgacgagtaaacttgggaacattccaggaacgaattgcacgaagttaaacttaattttgaactcatttcccggctcaagtctttctacaattttcattgcgactccgctcaccacaaaacacaaatcttccaaaggcgacatcagagtaactttcatgtcagtaagcacataattcgaaatatttcgcacagttaacacaaacatatcctttccgacatattcatacaaacaaaaaacgcattgattaaaattatccattggatattcaacataaccacattcagtcttaaaccaaaagctaagtttcgacttacttcgaaacacctcaacatattcagggagtttcaatacctctctttcatgttttcttgttacaaattcaacatacaatttatcattaaaaacattttggacaaacatcgatgcattataatcaggcgaataaatgcctatcggtttacacccatccgggcatgaaagctcatacgaggttcgagttatgacgtgattttgcatctcgaatcgggagacgttaaaatcgtacgatagaaatttgtacaacggttgatgcgaatttgatgtccagaaaggaaacaaaagtgtcaggttaaattttccttctttgtcggcatggattgcaaacttaagctctatttcttcattcgatttaagattaggtaaaaatgtttgcccacaaatttcttcaaattgtggatcataaagaataacattaatttgtgattgtattaaaacagctaaatgttgtagtggaatttctccattaataattttaacatttaaaagaagtgtttcaccgacaaataatgacgtactaataggttcggattgaatattgatttgaggtgcttggtcttgaacattatattttaatgtgttttctgtgaataatgactttaaattaattaggccagcaaatgaaaatgaaattccataaatcgtcaaaactcctgtttcaagtggtgtaaatgacagttctattatatcctttacagatttcttgtttatcgtataagaagataattgaacatttttgattccacttgttaaaagttttatatcattaatagggtaccccgaaaccgcagacgataaacttaccttcaagtaaacggtctctccgacaccgcattcaattttaccgaaatttttaaacgtaaagaattttccttttgtaaaagagccgaataatttttcacatattaataaccaatttgcgtttcttaaacttggaggagggaacatcattgatccattatttaacgatatatcgagattacttttcataaagccacaaatgaaataatcatttgatggataacgttttaagtaatttaataattcgtcgatataataaatttgtttcgattccattaacttacccaaacattgattaaattcgacatctttcggcaaattcttaaacgacaatatcttcatcaacaaattcgtaatgattaaattccaacttgaatacgaacaaattaaattataagagaaccaaaaacattttaatgcaaattcatcgttaaatttaatgtcgtcgaaataagttgcggcgattccatacatcagcgcttttttccgattattattactatttaatgacattgctatgaactcataacaaaatggtttaattagttttaatgttaatgagttcttatacaatgtaatgattttaataattggagcaacattcgcattcgttataaatgttcgcgcccaaaagtttaaaagataacatttcgttcgacttaatgacgtcgttgagtattccgatgctgtatttaaatgttctattgtttgttgagtgactttggaatgaataatatcattaatggcaatgtaataatgcgcttgcgtaagaaaaatgcgtttcgtcggatttaaattgagaataagttgatgataatatgaatgcgctaagctaaaatgacactgtgctaaatgaatatcagcataaaactttaacgtgatgagatcaacgtcggattcgctcttgtttccgattaattcttggagattttgtcgccagccaacccaatgctgttggtaattggattcgttttcactgagaattgtttggtagcgcttgaataaaatgttggaatggtaattgttgagtttttcttcaagttcttcatcgctgatttggaattttaaaagattggatttgacatgaggaagatatggcttcatccagttgggaagatgcgtcgtgttgataacatgcttctcattgtctaaaactaacgcaagaagagagatgggaatatcaaaaaaggaatatggtgtcatgtaatcaagactaataagttgcttggtaagacgtagaagtggacggacatttagtttggcattacgtggattgattttgaaaaaatcatatggttgagattttggattgagtgaataataatcagacatgttttgcttaactttatttagatctggtagctgatcataaaataataaacgaacagggaaatttgaatcagatgtaactttattccaaattgaaagaagacgaatatgataatcaggaaacttttcaagaataactggtgaggcaaaacatagaacacatggtgaaatttgtgattgaagaaatttttgtatatttgacgaacttgatttcatttttatgaaatttaacggtcgaaattgtaaattattttcagagaaaatcggcggttattattcaacatcatttaaaaaaaatgaaaactaatttatttaatataagtttgtattaaattacgttgttcgattcgcaaacatacttcttatataccatacctctatagcgccaacttggaatttatttctgttcgtaagcattggagaattaaaagtctcgcattgatccgaaaagccgtctcttaacccatttgttaagtaaatagctgcttttgcattacctccacctataattaattcttcttttgtgattgatacaaagtattgatttgccttactccaccgatatatttggataaatggcttaaagttgaagacaaatgtttctcctgttccagaaaaccctttcgttggcttcagcccgcatgataaatatgcgccgatacgaattctgtctgttgtatttatgacgatcaaaagtggcatcagtttacttgatgcaatggaaagagaatttatagaaaagccatcaacagaagtgttgtaaataagttcccattggtgccttcggactctagttggtaacgcaagacgaagagtattgatttcttccatagtaaggatttgagatgtaccattgactaattggaatttttcatttactttcggtcgtggattgttgactttaacttttggaggatcaaacataactcttttcttaagttcatctgaggttttttcaattacgtctttgaattcttttaactcataatttaatgctgaaaagttaagtgtggttagagaatagttgtcaaataaatcatcaagataagccaaaactatggtagctggagaaaagtcttcaaaaggaacatcatcgcttatgcttggatgtggaattatttgagtgtctaataatcctgtcatatcaatgtcaatcgttttgtggtccttaagccacgcaaagctttcgctgataaagccttgatcaagttcaatgaaaatgtgttgatttctaagataaatccttgctggacaatcttgatcattaagtgtgacaacaccaaccacagatgcttcctcttcttcttccgcaaaatcatgtggattgttggggttgttttctttgtccattttctcttttctgtctaaacgttcacctcatttaccaaaattttaattcttttgactcaaaacttttgagtaaaatggttgtacacaccaaagttatgcaaagtatttatacatttagcaaaggttgtatcaaaaagcgtgtaaattgaaacaaaataatttttgactaaatgtgatcgagaaattgtttttgatgaaatttcattaatttcaaatttttacatcaaaaatataatgaaattttatttttattgtatcaaactatgtgttttatatcagttgtctttctgaacaagttatgatttcggcttttcaaaaattcaatatacaaaactaatatagccgaagaaaacatgcaaatcaaaacgaggacatttcctttcaaagttttcaaattttgtttttcgctttcattttcattcatttttgtattttcaatatcataaccgtgtgttgggttttcggcttcaaaaccgatttggagactttcaatttccatatcgtcattcaaattttcaatatcgtaaccgtcggtatcgccttttgtttcaatttgaacttttctatactgttgtgtgaggaagtcattcaattctgggatgtcaattaaaaattgcttgaaattatcgatgtcaacactgaaactcattgaatttgctatttgatagaacctccagaatttttgtccaatcaaaattgaattcgaccacatcgccatgtgtgcgaaagagggaactttttccttatataattgatcaggataaaggccgtcacttttgattggcattatttccacaattgttgtgtccttcggagagaagaattgattataaaaagcacctccatgaacgccaataattgcttttgctttcccgaaaagttttattgtttcttcgagagtatgttgtgagtgatcataaataaccaaattctctccgtatagagattttaatgtcgaaattacatcttcttgattttgtataaatcgttgatgataatacgaattcgatggctttcgacagagaaaaattattacttccggcgtggataactcgagctttaaatgttcccgaagtttatcaaaaaacatcggatgtacacgcggacatatttcaatatatattaatgtttcggcagtgtatgttcgtttcgcagataaaacttctttgaacccaaatcgatcccataactttggtacatttggatagcgagatgataattcgacaactgccgttacttcgttaaagttaatgtccggaaacgcaaaggtaaataatccaaaatgcgttccaatgttatcgaaaaaatgttggaagaaatagccccaatgacctgttaatataaccattgtcttgtagtttggcgaatcggtttgctgtggtgggcctttatcatttatgtaatgagtaacattttcatatgaaggtaatggcaatttgacgcttccattatgtacgacacgtacaacaccacaatgatcagaaacattggtgtctaaaaaatgtctcatgttttctggttgaatccaaaattgtgaaagctgattttccttgataccatttggaatcgcccagttaaaaggcggcaaacatatccttatttgtttccagtatccatgatcaattgtttctatttttggatacaattcttttgcatttactaattttgtagaacatattaaagaaaacataattaataatattaagtaattccttaaataatggaaaatcattttttgggctatgataaattattgggttttgcccaagaagtttctatctgttttgacttaaaattggaagcaaaaatttgaattgtcaagctatcagataactatcaaaaaccttatttcattgcctttttttattctatagatttcgtaatcaacagttgaataaaaaaataaactttttcaaagaggtaaatctcgtcttaaactatttaaacggaatgttaaatattgatgatcatcataagttttcttaaacaacttaaaaaataaaacagaactaaatgaaaaccgtatacaacagctcctatgttttgctgaaaattagattgaattcttacacaaaattgaaacaccttatataaatttaaagtatgatttattataaactgattccgaaatagttattatagtaaacatttcacaaccaacaaaagtgtttccgtttttgatttcattttttacttacgatgattcattttgagaaagttaatgtgtggttttgtcttcgctaaataaatttttcgtaatcctttcaaatatttatttggggcctcaattgaaagaaccaattatcaaaagtggcaatgacgatagggcacccatgccgatggttgactttttgcgtttagggtaccctatgaattgataaacgtgcataattggaatgaggtcactctgggaagatcctttttcaattgaccagacaacaaagggcacaaggaaagtgagcacaaataaccttaaattttcaagaaaaatgaatatgatgaatgattatagacaatattcatcatcaacatcaagttcttctccaacacccattcaaaccaaaagaaaacataaaaatatggctcacaagaaaaagaaaaaagaagcaattgaaaagaaaaaaacgcaaaaaagtagtcaagtaacgccaatatcaagaaaaggatcgacacagatgatgaaacttgagcgtgttttattttcgattataattgttattgcgatatttatttttttattttcaccactgtttggtattttcatgttttttgttgtgttttatgtttgtgtacattttagcaataaacttaccttgtaatcctctcctttaaaaaataatgatcatttttttacaaaagttttcattaaatctatataatcataaagttcatctctttaaaacagtttcatgaagttcttctttatatttcacaaaaactcaaattttttccgatagtctgagcttgccaatttattggtggcgtcacttttccatgcaagcctttttagaccttttatccattgaaaaacgagcggtctttcttttaaaaaactggatttgaattccggtgtattcaaagaatatataattctcagaaaaacttgagtcacaaaaatatgattgatcaagaagatagctacgactcctctggaagcgaaagttcaagctcaagttcaagttcaaactcaagttcatcatcaacaaaaaacaatagacctaatcacggaactgtttctttcgctccaccaccatttgaacaatcagacgataacgacaacgcaaattggtgggatgaaaacgtagcaacacctgctgcaagtggaatttcggttcgctttactaatgctggttcaaaaccaaattctaatagacaaaggtcttcattcagaaatacaccaaagacacacgcaaatagcaatagatcaggaggaggcaacccttcacgaagtagaagcactacatttgctgcaccaaattctcatcaaaacccaagagttagaagcacaacagtttcgggccaaaaccccaatcgccaaggaaattctcgtgctatacgccctcaatcagttaatggcagccgtcaaaatcgatcaagatctgttcattcagcaaattcctcaacaagaggcattcaaccaacgacacttattcacatccaagcacctacaccacttatctggaccgttggaacaactcttattatgcttttagtatttgtatgtgaaattcttcaaagtggtggatttaaatccatgtcagtcaaccctatgtttggtcctgatgaaagtactatgattcaaatgggtgctaagtatggtccacttgtaatcggaggagacatttggcgaattatcacagctattttcgtacaaaatggtataatttcctttgttatcactgttattcttgttattttcacacgtaagattgaacgcgacgcaggattttggaaagcgtttattctatttttcatttctggtacttatggctatattgcttcatgtctctttgtttcatctgctgtttcatgtggagccacaggtacaatgttaggatatgttggcatgttacttggagatttaattgcatcttggaaaactactaagaggcccgtcttgaccctcattggaatgatcttagcgatcataatactcttagctgttggcattacaccttacgttgataacttttctcatgtcggaggatttgtaatgggatttttgttcgctttaatgatgttacccaacttaaacttcggcaaatgtcaaaggttttgccatggagctgtcgcatttttggcatttccggtgatgtctgttctttatatggttacattagttttattcttcagaaatatggtcgatgacaactggtgtagaaactgctaccttttgaactgtgtaaatatcactggttggtgccatcaaatcgactgaatcaggtgatgtaaatgtaaaatgaataaatagaactgtttgtaaactattgttttgactttttgaatggaattcattgggaaacgatcaaatatttatcgtttggagctgtaactgatgtaattgcaaatctataatatgttgaactgcataaggtataacagacaacagcaacataatcaaaaatgggatttgaggtttactgatattttgaaaatagtggcatcacaatgagtttaagtcattatgctcacacccatttcaagtatgaatagtgctaatcaaaagatatcttttgattttaaatgtgaaatcttaaataaatgaagcatctgattttgcttatttcaataacatgttatgcagatcgtcactcaaaaattttgaattaaattcattggaaatccagcatttggaagttgttacaacatctgaaatatatatcaatttttatagaaatacagagccaactattagtgtaagtgcattttatttatgatgttagtacagcaataacatatcttacatttgcagacacaaaatttatttgtaatgattcaatccataactggaataagcaacccaataccaacccactcatttttcaattcgaatacattttcacaatggaatacattctctgatgtgataacaaaatcattttcttatacgttaacaagtacgctatcagttacacactcattagcaatatacgaaattgagatgaaaacgcattatgcattcataatcttgttaatgtgttagtttaatttttccttaaaaaaaaatattattcataagcaagaattgaaaatgaaaacttgtgagaataatttatcaatataactattgatattgcattcctaaattaatttaaattgagtaaaatatttttaaaaaaattctatattatggtgtatacaaatgtttgttgagacattttataaattcatcaagaagttaaagatatatttattatatttaaaaattgtccaccattttgataattattcataaaatacattttacttttattgcagatttaattttgttattcgagattttatttttattttttgagtattcaattcgaaattttttatataacatgtttgcctgatttagataaagtttttttgaaaggtgttgaacagtaagcggggtgccccaaaaccatatttatcgcgccgttcattgaaaaccctaaccgaaaaagttcagaaatggacagtccaggcgaaaacaccaagcttaattgcaaagtcgtactcctcgggaattccggcgtaggaaaaacttctcttgctgtacgttggtctactggtgtgttttccaacttgataaatccaacaattggtgctaatcatcagcgaaaaacaatcaagatagaaaagtcagaaatggatttatacctttgggatacatcagggcaagaacagtttcaatcacttacacctctttacgttcgatctgcttctgctgcatttgtaacagcatcaattaccgacctggaatcattcgaatccctaaaaatatggatggatctattaaacaattcatgcgaaaaagtaccacctgcaattcttgcggtaaacaaaattgatcttgaagattctgcggttatgacaagagaagaaattgaagaacgtttctcagatcagttcaattccattttctatgtttctgcgttttctggagagaatgttgaaaatgcatttattcaagttgctaaacttgcatatgatttcacaaagacagtcgaaaagacatctacccaggatataacacaacccattaacaccaaaaaatcatgctgcaactgaaaaggaaaaaattttcaatttttttgaataaatgtaaaccattaaatatttttgagaattttaccacggggtgcccaacataaaaataaaattgatttcccatcgtgaaggattttagttaatattatatctcaacaacattcttttatgttttttaagagaaagattttaaaagaactttatttaaaaatttgatgaagttcttctaataagggttcaatattggtatttgaaagagcagatacttcaaatattttatagtcaaaaccacttaaaagttcactacattgtttcttcaagtcatctaatgtaaaataaagtttttcttttatatcacacttattcataagaataataatttgagatgatttcactgaataacttttttgaatatcaactaagaattttaaagaattaatgtgttgattgtcatcagggctgaccacacaaataattaaatcagcatcacgggtatacattggaattaaggaggcatagctttcacctcctggagtatcaactatagtattttgattgccaaaaatgaaatagtttgatttgttttctccggaaaatttatcacataataattcaaaaagtgttgtttttcctgttgcaccaaatccaataagaactgctctttttggttttgtctctattgtttctatatcttgttttttatctttatttcttctaaacaacttcattttgaactgccgtttcaattgatagacattgttaaattttcattttttggtaatgttttgtatttaatctttatcttctatgctatatgcaaattcttcatcaatataattaaccataaaatatcattgacatcaaaattaaaatcatcagcttggagaaaacatatggataatataatttgtaagttctggaaatttgcaattttttcttaaaattacactgattaaatatgtggatataaatttatttgtgcttatgttgttttatgattttctctattgtttttggagtgtgcttcgttacaaacttggggtggtataaataaacttatcaaaattagtttccaaaagaaacaaatgaatcttactcttatatcattatctctgtcatctttgaataattatccatttacttctctaccacaatccaaagttacacataaccttaaatttcataatcttcgatgtgttaactttttttccacatttttttattcaacaaatcaagcatgctccaaagcttctttctactcctcaacattctcttcctttttaagtcgtgtaataaccacagaatctcaaatactatcatatcaaattttatctcggcaattcatgaattggttcacaaccattgaggttgaaaaatgcacattttataaaatcatatctacttcgaccaatggtgctgcactttcttgtcttggtgatgcaataatccgaaataccaaatttcaagacataagaggttataatgggggagctatttattcagccaatagcattggacttcaacattgttgtttcattaatgtttcagggaatgaagcaggatgcatcactcattgtgccacttttaatcaaaagatgaccgttaattttacctcattttacgatacgaaagccgtttattttggcgtttttcaagattcttccacaaaagattcatacacaatattcaatttcaacaacttcactcaaccatatgcttccgaatgcgttggttgtggcgaggttcatttatccaatttttatatcaataattgtatctttaatcaatcaagtgcacgcgttcataatgggtgtatggttgtctatagcttgagtagctttctttgtcagaacactttattctacagatgttcacatcatacaaatattaagccaactgctgctgtccttctgtttgagactaataatatacgctccaacatgactgattgcgcttttgcttattgtggtatgtccgcaacatatacgcttacagttacaagtggatatcctcttgttgttagaaactgctgttttagcagcaagaaaatttatgaaatatcacatgaaaacaaccttatcgttgtacaaaattcacagtttgagaaaaagtgcgactccaaatttacggagaaaagtgacatggagattggatgtgtagaaacgggatatatagatgacttcgataagaaactgttcataagaaaaataataattcatacgttatctgttgtgatttctttaatttttgcgtttttgtttatgatttatatgaaaaattggagatgcgacggagtgaaaaaaccggctgctttagaatgaaaattgtttttatataaataaagtaatgttttgtaaataatttaaattttgatctcaatcaaagtttggatttcaatcaactcatcttgataaggaaaaacttgatgaacaaactgattttttacgaatcccagaaaatcaatatacagataatatgcaaacatcgttatgttttttctttttaagcgctacaaaaattttggaaaacgatagatacgcgaaacattttcatgtacactaatcccgagctatagtaaaaacaaaacattcactcgggacggtaaattttcgaaattttcagacctttttagagtaaattttctaaaatttcacattttcactcgtttgtaggacaattagagaaaaaatgtttatatataaatcaataagaatatatgcttaaaacaattaattggtgataataataagcccacttttattattttatttcatttataaagtaagatattttcatttggggattcgttttttgctacagacaaaccttgtcaattttagtagcaaaaaaattgtgtaaaaaaaaggggaattccccggggtttttggaaatgtgatataaaaaaattgttctgaccaacaaatattgaagaaacaacacctgttctctttaccccttttatagactttttagacattttcgtttttaatttcaacttctagtgcagcttattaaatcatttggtctctcccatttgtgatttagtacaccaaatttattcatatagaaattcaatcattttatcaatcacatttaggctttcaatatacacatatagtttcatatctcatttaatcattactatctcatttatctctttatttcaaacatctgtgattcacttaatcattttttgcatttttgtctattttgtttaattttttagtatatattttaaaatagtttttgtgtttttaaatctttagttatatgtttgaatttgtggtttaacttccccagtttattgtttcagtttttgaatataaatccgatgatttttcattcatttgattctatcgttggaaatctgcattgagtttattaaaaatatccttatactaaaaggtgtacacccttttttcccctccaatattattttattattattctttcaacagatatgtgggtttaaatatattataatgttttatttattattcataaatctttgattctttttctttttcagaatatgatattaataaaatttctaattaattgtaattaatttgtaattaaaaataataaagtaaatttatttttgaatattataaaagaaataagaacatttgaagagagtaataaaatcaaatccaatatatttgatatatttggtcgatttcttatcaataattatacaaatgaatcatcttatctacttgaagctatgattgaacataattttcttgaaccaatcattgtaaaaaacaaccaaagcgcttattttgcgcattatatgtctaaagataaattagtaattttaagggaacatgattttgtaaattatgaagaactttcaaagaatgattgggaattacataagaaactaattagagaaggacataatccaaatgaaattgcgaaaataattcgaaatgatgaaatcgaaaaacttcaagaaatatcatcacaaaataattttgattttagtcaaaaaattgtaccatcgatttatgaaagatgtgattttgttaataaagaaaaatgttcattcattaatgaagaaaatgttacattaattgattatgcagcattttttggattaattaaaagttttaaatatttacttatgaataatgcaaaagtaaataatacaggtaaatatgcagttgcaggtggaaatgaagaaattattcatttatgtgaacaaaatcattcatcatttgaaggtgcatataaaacagcaattgaatttcatcgaaatgatatctttaaatatctttatgaaaataaaattgaagatattaacaaattaaaagaattaggagaaaaatgtgtttcatattttaattatgaaatttttacatatttagaaaaagaaggaatgaaaattaataaaaatatcattaataaagcagcaaaaattggaaatatttttcttgtaaaatatttccataaaaataatcaacttccaggaaatattttagtttttgcttcattatcaggaaatattgaacttgttacatacattttaaagcaaaaaggaattgatatttattctaaagatatttatttgttttatttgaaatttattttaattattgaatatttcaaaataatatttggaaattatttatattatttgatacagcacttatgaatgcatcttatgaaggtcatacagaaatcgttaaattacttattgaacaagaaggaattgatattaatgccaaaaatatttatttgttttgtttaaaatttatcttaataatttaatattttaaaataatatttggaaattatttaaattatttaatacagcacttatgtttgcatctgaatatggttataaagaaatagttaaattacttcatgaacaagaaggaattgatattaatgctaaagataaaatttattttaataatttttgatttcaaaataatatttggaaattatttaaattatttgacacaacacttatgtctatttttcatatcacaattccttagaagtacaaaagtgctactttctaattgaattcatgtaaagcaaatttccaagatcttattgttcagtttaaactaagtttgttgccatatttgggtgacaccgatcatctaccatgtactgaaatatttcgaaattaggttttttgttttatctagcctcgtagagagttggcaaagatataggacattcaacaacaacaacataaaatggagcatttgaatcattatagtttaaaaccttcaataacaatgtgaacaatggataagctttaaagagaacaaatgatatcattttcattaccaagaaaaaaataatttagtactaaacctcaaaataaatttttttgaaattccaatatgcaaaatatgattcaaatctatttaaaaatagtttataacaatttttaattcttattctctttcgctcaagctatatatcaaacaccaagttggtcttccatgcggacaattccatgggtaatcgctgcttgccattttttccaacaactttctcatttgcctatgagacaaagcgtcgccaactcttactgatgagtggcatgcgtggtaagcgagttgtgaccttgcattaaatgtcattggcgttgaataaggaacgtcatttataagtccaattagttcttgtaagtcctcaattccatttacgacatttttatccattggaaccgatttcacttcgattccattatccaaaatattataatcaaatccaaattgattacattgtttttgatgcgtgaacgcattctctaagtcatctggtgtaagtggaacaaaaataggctcaagtaaaacttgtcgatcatttgtcttttgtttgcgaagtttctcaaaattagctgcttcattagctgcatgttgatcaatggcaaaaatatcatttccgattttggttatgataaatgatttattccattgcccaataatttccatatctcgaaatgcagtggtattaatttcaggtgtaggaggatatccagctggggaataatcacgcatttgtagaaattgtgaacaaatttgttcagtagtaatgtttgttgtggttgtagctcctgatatgttttgtgaagtggatttcagaggagttggcggttttggtatggtttcaatgggtttgctttttaggtctttgaacgttaaagtttcagatgttgatttccatacattacgaaaaatttcacaaaggcacttttggagaatcatttcatttgaaaaagtgacgcctattaacggcgaatctggtgtaaagtcatataatgatcgatctgcattaatgaaaagaaaaatagagggattcttaggacctgcacaaagacgaaattcttgtttcaatgctttgataatgggcaaatttacacatggacgtccatttacaaaaatattgacttttccatttgacggtgttgtaggagttgaagtataataatcaattgaagaatcatcattccataagtgtaagggtgaacttccttcaattaatccgtttgatatcgattgacctaatacatctttaattttttgaaagcgcgttctattggataattgcaagattggctttgagtctaatgttaatgaaattctgatatctgatgaaactgcaaaaagaattgaaacttcttgtatttcttgagatagtttttgtttgtgttcaagccaaaatctccttctaacaggatagttataaaataaagattggacaataattgttgtgcctcttgtgcgtgagattggttgaataattctttcaccactttcagaaaacgataaacgatatccatatccatcatcatttgaactgctttcaattgttacataagataaagatgaaatagcatcaagtgcttttccacgacctccactattataatcttttccaaactcttttgatgttgcaccttccaaacataaaatatccatactttccctatctattccaagaccattatctgatactgttataaattctaaacctgttccagaaatctgtatattaataattttgctttgagcgtcaagactattttcaataagttctctaagtacatgggaagggcttgcaattgtttcagttgcccttaccaattggctatcatttttttgcataattttcattgaagcatttgaaaaatcttaaacggcaaaaaaccgcctggtattgactatgtttgcttgataattcaatcaagaaaacaaatgatatcagaaagagatgctgatcttcatatggttcaaattttagatcaaacaagttgttacaaagatatgattgaattaatgaaacatgttgtagaacttaatccagagctaactgcagatgaaagaaacttgttatcagtttcttataaacgagcaattaatatttctcgaaacagcttacaaaaccttacagagattattggttttcaggaaactcaaagctcggaagcgagagttaatcagctcaatatttttaaacagaacataattcaagaattagaacaatattgtcaagagctcatcagtattgttgacaataagcttctcccatcagccaaagatgttgaagccaaagttttttattacaaattaaaagcagattattaccgttacatatctgaagctaaggaaggcgaggagaaagaagaatcatcacagaaggcacaagaaaactatgaaaaagctttccaactcgcccaggctgaacttccgaaatacagtccatcttttcttggagttgttttaaattactctgtattcttatacgatgttgctcagaagcggcaagaagctattgatttagcaacaaaaacagaacaggaaacgtcgatcttaattgaacaaaatagtgaagctcagatcaacgaagcagtttcgattcttcagtttcttcgtgaaaatatttcactatggaccaaatcaaatgaagaaaaccaataaacatttacaccattttttcaatcaccattttccacgaccgttaatttaacgtactctattttaaacgttcgctgttaacggccgccaacggttttccctattctcatttttcttaacaaaaatttgtataaaaatttaaatcaataaacaaacattttaaatctataataaataagttggaaattcagcttatcatgcatgattgtttttcttctttcttttgttttttttcttcctttttaaaagggtaactttctttcctttgcctaatattaaccataggaatttgatctgtactcttgactccagcgtgtgagttatgatttattcttaatctcttttctggaatgtcaaagctttcatttgacattcctgatttcagaaagaattgagcagtttttggatctaagtctatttttccagatattatttccgtgatcaatttttcgtcccagccattgacattaaaaacaaattcgattggatactgaaatcccttagtgaagtgaaacaaaacttcctttgaaaatttgaaccaccccgggaacgatgaaatcgtattcaaagatacggagcactccaaaaggaacgatcgaatcaaaaggttttcttttgcttctttgatattccagaaataagcgatcaaatgctgcatcgcaacaataaaaaacgacacgtatgcgtggcttataatggtttcttcaaaaagacttcccgctgtaattaatataaaatttgttggtggcgtcttttgaggatcatgattattcggatcataataacgaaacaaaacataaaatacattgatgatttcgccgatttccaagattttcgtgcagtgtgttaaatataatattgatttctctactgcttggttattaatacacgaattacgtacattttctaatgcggcattaaccagttgtttgtttggaggaagagaaattgatgtattcatgatttccccaatttcttcaatatctgaaacattttttatatttgaagaaacgaagtcaatgaagtcgtttttgagttcgtgtttaattggaaataaagtaaaatatactttgaagatacgatataatagaattctttgtgacttgtttggatttgctttagaacattcttcaagaagtaaagagttagtattgtattccgatggaggataataatgtttttcgcttgtagatgttaatgctaagaaatatccccaaataaaaatcggtgaatgatcttttattgaattgataatttctgtaatgagattgcaaattgatggaatttggaaatatttaagaagatcgacaaaaaaaaaatgtgaattacacattgtattaatgactttgattggatttttagttatagaaattgataaaatatttgaagctgttcctattttatatatatttggctgtttatgcttatgaaaaattttgaaaataattttcatatcttttggggaattcgcaagtgaatcaagaagagctgtatttgctgacccgaaaaaataattaacagctctgataatttctgtattatctgtttttacaaatattttacaaattggccttaaagattcacataataattttgtataacttggaacctggatatgatacttttgttgtatggtggtgtcggtaagcatggaagcgatatctttaggttctattggcttccctgtttcatcttgcatgaagtgattgttaaccagaaaattcagttctcaaaattatacgatatcgctctcaaaaatatttgtgatatttatatttacaatgtattgaaatagctataaaaatcaattttatcacaataattggagtttaagatttattctgtgcgccgtatccaacatgttttttggttataatttttcgaattacttattaattttcaaacaaacatatatcgagaataataaaatctagttctaactttgggttggagtaaagcaaagaatttgccatcgcaattcgaaaccattaagcaagtgttataatacaatgacaaaagcttaatcaaatgggcccctgtatagggaatcattcctgatattcaccaaatcaaatatgttcggtgtgtcaatcctgatggttctatatatagatgctgctcaaataattacttctccatggagaaattcaaaatcaattggattggatccatgggtatcacaatcaaaactataattaagaagatttgttcacattttagcgtgttgggaagaaggttttgatataagaacgacaatattaaaaaacatgtgtatgtaaacgatcagtaattacatggtttcaaacttttctatctattgcagaaaaagaatatctaaaagatatagctcaaaatttaattgatgatggaatagtcgaaattgatgaaagtcattctttcggttctgaatacaacgaaggaagtgcattggaaagagaagaaattcgggttttggatcaaatggacagtaaaagaatgtgagttgctgcagagatttacgataatatattgaaataagttctcattccaattatttgtgcaacagtgaaacctaattcagaaatttggtctgatgaatagaaggcatataatactctctaagttatgtacacgaacagcaaatcatctagaatatttcgtatatttattggattagtaatactaatacttactaaatccaatactcaaaaaaattacatttaattttataaaaggattctctataaaaaatggatttaagaaaaatactggaatgcaataatcggtataatttttataataaactaaatcaaaattttaaatattttatcattcaaatagagtgctccttgtatcagaccccccgaaaaaaatattttgccaatcttcactttttgaaatgattttgattccttatcaaaagtcgaatatttttattgacccattaaactgaattataatttttttatttattgatattaattaaaaaaaaaatatttcaatgataaagattatataatttaactatttctgaatgaccatttaaatatgctttcataagtgctgttttaaaaaatttaaataatttccaaatattattttgaaatatcaaattattaaaacaaatataatataaaacaaataaatatctttagcataaatatcaattccttcttgttcaagaagtaatttaactatttctgtatgacctttataagatgctttcataagtgctgttcgaaataatataaataatttccaaatattgttttgaaatatcaaattattaaaataaatattaaataatacaaataaacatctttagtattaatatcaattccttctttttcaagaagtaatttaactatttctgtatgaccattccaagatgcaatcataagtgctgtttgaaataatttaaataatttccaaatattattttgaaatatcaaattattaaaataaattttatctttattattaatatcaattccttcttgttcaagaagtaatttaactatttctgtatgaccattccaagatgctctcataagtgctgtttcaaataatttaaataatttccaaatattattttgaaattagaaattattaaaataaatttcaaattctacaaataaatatctttagcattaatatcaattccttcttgttcaagaagtaatttaactatttctgtatgaccttttacagatgcatgaataagtgctttattaaataacttaaataatttccaaatattacttttaaatatggaattattaaaataaattttatctttagcattattatcaattccttcttgttcaagaagtatttttaccatttttgtttgacctttccaagatgcattaataagtgctgtcataaatgttttcaataaatattttaagcagaaaatcaacaaaaaataaaagtcaatactatttgtatctattttgttaatatgtgcaatgtcaacaccattttgctttagatataattgcttttttagttctttttttcttctatcattgtttattacatttcttaattctttaatttcatttcgaatttcttcattttctttctttaagtcagttttactttttacgaattctttaatttcatttcgtatttcttcattttcttgttcttgttcttcaagcttttttaatatttgaattagtaaaaaacttcttttatcttcatttcattctccatttgataatgaaataattgaatcagattcattatatttcccttcaaacccattttcaaatttgttttcttaaatgtattttggaaattcctaatgaaataaataaagatttttcatattaaacttactttcttttcgtttaagaagtaatttagtaatttctaattcaaaattttttgtttcatttaaaggtttagtttcaaataataagaaaaaattctaaaaatgcattcttaattaaaaattaagtgaattttcgaattcattttatattttaatctaattaaatggaaattgctaacctcggctcgtacagattataaaagatgttttttaaatttaaagcttcttttgtcacatttctaatcattgaagcaatatttcacataaaaatagaattttgcaaattttcttgcaaatgtatacatttaggtagatttagctaatttgcgaattagcatttgattccaattttaatttttttgtattttaataaattacttgaaaataaaacaggtgccttcgtagctcaatcggctagagcataagactcttaatcttggggttgcgggttcgagtcccgccggtggcttttttatcaattattttggtaaaccatattttttggaagtgagaaatgcttactgcaatacaacttatatctaaatttaatggaccattaaagaattcaggtaaaagttatattgtgcttaggacctccagttacacttaaaatagcaaatagttaaaaatttatgaaaaatatctgtgataacagttactcgagtaatatcatctttaaaagttctagatttttggtatcattcacgaatatgatacgaatacatgttttctttaaaggtttttaccaaaatcaaataaattgccactttttattccgaaaattatgaaaagccaacaaacacaagaagaacaagcagctgccatggaatctcgacttagcaccgatacagatgcacttgtttcctctgttttaaccaatgaaaacattgataagtttttagaagatcttcgagcatttattgctaaaaaaaatcttgatatttctgcaatgtgtggtgaacattctcttacattttcccgtagtattgaaggtgcccaagctcttggaattcgtgctaacaatctacaaaatgaagttaatgaaatctccaaatccattaacaatgccattgacaattatgagcaacaacttcagagcactgtcaaagcacgtgaagacatcaacatcattgatacgaaattgtcaggaattcatgaatgtttaattttcttccaattactagataacatcaatgtccttatccgtgagaaatgttattatgtagctatttatagacttcttgaactttctgattatgattctcgaatttcatccagctctgttattcaatcatatctacgagacattgagccgataattgcatccattgaagctgaagctgaaaaggacatgattagttggatgacagattttcgaaatgtttgcaaagacattggctcatcatttttatacggcacagagatgcctaaattccccaacaaccgcgtatatgagtattacatggttgaaaagcaattaggcaagttgtcatctttatgcgaattatacacacaacgtcgttttaagcaacttgacctcatctttaacattaagccaccaaaagaatatactccgaaagagcaaatacgatttttgttttcacatattgccggatttttctatactgaatataaaattacaagtgatggcttctttttgatcccacaatctgctcttgatgacaagtggaaagatatgattaatcaaatcaagttaacaataggtactttagtatttccttcacaaacaggttatgataacctaataatggcatcccaagaaatccaattgtttgctgaaaaaatgagccaatgctccgttagttgtcaaggcttatatgacttccaaaacaaccattctgaaagctttagaaagcaaatggagaaacaaggaaaagcggttatttacaaattgatagacgataacgccgcagattttatgaccgttaaaactcccgctgaattcaaagaaattgaacgctatgagttcgtcgaaccgccaacagaatttccattcgaattaccgttcatccccggggtgcccaaagcctgtgaagccatggaaaagtacatcaataacgcaatgaacttttatgggaacactaataataataaggttgtggaactgttttgtgcgtatgtgaaatcttgtgctacacatatttatcaaattgcagtgaaagattcttcaatgcaaaattgtgcaatgttaacatcaagtataatggtgtttccgaaatgtattccttacttcgaaaacatgatagctaaaagaagcttctcttcttctaaagctaaaagaaatgagataattgctcatttcaaaaagactacagatgatatgatcgagcttttgaattcgatgtttaaggaatttattgatcaaatgattgatacatactcattcaaaatgatggcaaagggagaccctccacacaacttcgcgattgagcttgtaatgttccttgagtcgaagtcgttgtacttgaaacaggtactcaaagaagagcggtttgacggtttggttcaaaaagttgtgaagtcgatcgccgatagaattgtgaacgttataaccgaaagtcacttttcttggacaccccaattgattgataacgcattacaaaatgtatcttatttcggtagttggtctggatttatagcattaccatctgcaaaaagatgcttgaatggaattcaaaaaatgtttcagttgttattgagtaatcagcttgtggcattaacaagtgattcgaacttcttaacaaaatatagagacgtaccattggctgcaatgaaggtaatactacagaattatgatccagtgccatataaaaatttgtacattctatctaataatttatgtcagaatttgatttcccaaatagataaaatattgaagaggaaataatcttgatttgtacatttaaataaaaagttctttgtgtttctttcatttttcgtatataaattttaaatttttctccaaatagaacttcactttcaaaaaaaaaaaaaaaaaaaaattaatttcatgcaaaaataaacaaagaaatataacataataaaggtttattgtttgatgtaattttaatgtaacgacaacgtcatcttttccgaaagcatttaacacattaacatactattctagatcaatttggaaaatatgctattcatattttcttcttctatcatcagataatatataaaaacaacctacaaactattttgacgaacgtttaaataaataaaaagtgacacatattatgttagttcactaatgtgcaatataagagcaacggaaagatttacaacaaatgataatgtgcatagtgaagaagagctagtggaaatcaacagagttattaaggttatatcacaattagatcaaattgatgaaaataacgaactattatttccttattttcaaatgatttctgaatttttggaaaaatataatgacataagaatagtggactatttaaaagaacagaattatgtatttatgatttatttgttaaaaagtcaaaattcttatgatttgaaatatacattactttcgatatttacatttattactcaacaggccgacgttaatcttgcaaactttttaatcaatgctggatttattgattgtatttataatctacttcaaacagaaaacgttattcaaattaagtcatacattatcactattacagagaacttattcgagtttttaccaatcaatatgcaatccatcattattgattcattttttgggatgattcagacgattacaccaaacgacgaactcttcaaagacttcataaatctcttttacttcattgttacatattataaatcattcacgaacgaacaaatctcttcgatatttttgttaatttcaaatttcatcactgtggagaccgttaagccgaaaatcttttttttaattgttaaacttattgaaaataataactcattatacacattatttttgacgaatgaattcgttggaatatttaatgaagcattacaatcatcaaatgataaaataatttacggatgtttattatgtttagaaataatattttattataactctgatgttgcatttgtgaactcaattaacttcccattaattatttcatttcttcaaacaaaaccagagaaaattgttgttaactcattaaatatcatatcgaacggttgtatcgtctcaaatgagttaacgtgcttgtgcttcaatttgaatatattagaaattttgaatggtttatttcatgtcggcacttttgatgtaaagaacgaggccgtttattgcttctctcaaataatcccaagaaatgatatagaactaagggtgaacttgttaaaaagtgatttctttatggaagtcattgagtcattaagttgcttgaagtatttaacacaaaaatctattgtgaaaaatttgttttttacattgaaaaaaagtgaaaatacaaaaagtcatgatgaactatgcgcgaggctaaacgaatcggaaatatacgaatacgcaatacaactacgttcaaatatgttaatggtttacatggatcaaatcattgaaatgttggagaaattcacaagtgaataaaaatttatttatacaacttctctattatctttcatttgttatatttttttaattttgcaaatttatgtaatagatttcgaattcatgtaaaaaattccaaagatattttttgagaatgtgtgtttgattcggataatgctaacgtaaccaatgacgtttctgactatcaaaaagtttttgttttctgaggtttattgtcatttgccgtcagaaatatcgtgttttgggaggagtttcttcaagtcaaatatcatttcattttatattatggattcccaacgccaacctcctcaaaagagaaatacaagtcatgcaaaatatgattacaaatcacatcaaacgtgggaaatttttcgaatgaaaaaatgggacaaacttgtagatggtgacatccttctaatagcggaaattatttgtcgctggttaggtctcaatttgggacgcaatgagaaacggctaaagaacgttctgttcaaattttttgatgacaatttcgaagtaattggtccattattccaatacattacaatcgaaaccgaataataacctaagtaaagaccaaaccttactcaatttttatcattctcctcaaaccaaaatcatgttctacattatttttgaatattttgggtttaaccaaaatttcccaggataaaaatctaaattatttgtgcataaatgaaagaaatcaccaattgttcatgtgtgtatttattaaaaaaatattttatttaatttttattctatgtattagcacaaaaaaattcttttatcaatgcgaaacgtgttctttttcagtgttttttgatgtttcttcgattcgtttatgtacatacttctttatttcggttaatgcttcaacaggaagctttctaaggtcaacacgaagtggctcattgaagatatctaattctgtatcataatggcggaagacattgttgaaaaataaaagatcatttgacttttgtttgggcaatttcttgatatcttccaaaagtgaagtcagatcattttcagaaaactcttgtggtttaatacttttaaggaatgttttaggataattttttgaaacagatggtggtggttttgagatcaaatcagatatctttaactgtaaattaataaattgtcttgtccatccttcaatacctaatctgtataccttctctttttgcttattgaaatagtgcgtaaattgttgagcaacaatgaaaaaatacgaattatttccataatatttttcaacattatatagtatcatttgtacatcgcgatcccaatcttctattgtgttgtattggtttctttgtagcctttcttgaataacttttaaattagttaatgttggaagaacttcgtctggaatttcatctgcaccatattcaattaagcactttcctaaaggttcttccattaaatcattaataatttgtaaacatatttttgtgttttctgtgttcatttccattcccagaattttgccgaaattaatgaatgactttttgagcgtattttgaccggcatatatttaaattatttttttagatattaatgtacagcatctttggtaatcgtcaagggaatactcattttgatacagcagaaactatacacatcagtggtatggctcttctcaaaatgttaaagcatggaaaatctggaatccctcttgaagtagttggattaatgttaggtcgatttattgatgattacacgattcaagttgttgatgttttcccaactccacaaacaggaactggtacctcagttgaatcaattgatgatgttttccaagaacaaatgaagagaaatcttagacttacaggacgtaacgaagaagttgtaggctggtatcattctcatccaggctttggtgtatggctatccaatgttgacatcaatcaacaaatgacatgggagaaacttaatcctcgttgtatagccgttgttgttgatccggtacaaagtgttcgagggaaagttgttattggcgcctttcgttgcattggtgataatccacttcagatgcaacaagctgatgaagcgcgtgaaactacttcattcatcggtagcttagaaaagccatccatcaaagcgttagtacgaggtcttggccgactttattatcaaatgcccgtagcatatcgaatgagcgaatatgagcaacaagttttaatgtctttaaatcatccgacatggagcaatggatttcaaatttcgaactttgttaagcgcgatcaagaaaacataaaaatattaaaaaatatgacaaaagcagcagataattatcggagaagtataatagacgaagaagcaatgaacaaaaaagaactgttaaatagacacatagggaaaattgatccgaaggaatatataaaagaaaactcaaaagaaatggccgaaaaaggcgtaacacaaatgacaagaattttcttggatgagagcgcgttttaggaaaaatatgaattataaatatattcggttgattaaactcgtgttttgatagatgtttgtatacaaaaattagtttccaatgtggaagaactgtatttgttgttgtgtttacaatgaaatttatctttttcatgatattgtccataaaatactgtgcactatgattcataaaacacaatacaaccataaaatatacttcaatatcaataacttgattaacttctttgctgattactttttttgatcgtatttctcagaatttatgctcagaaaacggttattttcagattttttaaaaaatgaagaatcgaaaagaaaaatcaaaatcaggcgttggactacaacgaaaaaccaacaactcaaatgactcaaaaacaaaatcaaagaacgaagaggaaaaaattgatgaagaaacatatgaaaagattaagaatacattcgacaaacaaacaaaagcccatttactagaaaatgtggtggtatttttcattgtatttttcatgatattaattttttcactgattaattattttattcccaaaaaaaatttataccaacctttatcaaagaaagagcaaccattgtgttcagcaatagatgatgcagttccatggctttcctatattttagttccaatgatcttttcctctatctctgtttacatcacaaatcttggcggaaactttttaatagcaataaccggatcggttttctactttttgtgtgaacctcaaacagcacttttatatcaattcccctcaaccgccatcatcactttttgtataattctatcgtacatttttattcaaaatgtctttactgagaaaaccatctccactaaatggtttttaagtttctttttctcatatttatttgttgctttatcaatttgtcttagacctgagtgcctaggtccatctattggtgtcttttttattttctttgtttctggtatttctcaaattggaaaatatttaggaaactttttgatgatggtaattcaagccttgaaagtctttggcactatgtttttatatgggaaatttttgtctaatttagtttttattatatgggagaaattcgatgtggcatcaagtagtaatgaaagtttcgatttagcaatgtttatggttgttttccagcaacatgaaagtcgtctttttatattttatttagttttgtgtgttttgttattgaacaagggtaaatatgagtataatagcataataccaatgatagcaatgatcattggctgtatagcttctttgataacacaaatacaatcaaatggttatgtgtatgagttaaaattgatcttctttaatttacatgtattcttcgttgcaattatagtgttctcaaagctgaaatataagtgggcacatgttggaattttggtgattttgatgtttgttgcgcttttaattaagttaattgaaattgtaaagtcattaagtagataaattattttatcaataaaagtatataaattttatttaattttatatgttaaattaataatattttcctttataatttttttttcaaaataattagagaaacaataaaaaaaaaatcataaaaaaatcaacttacataactttatgaaagatgttcattcattaatgaagaaaatgttacatcaattgattatgcagcttttttttcagcaattaattgttttaaatatttacttatgaatggtgcaaacgtaaataatacaggcaaatatgcagttgcaagtgtaaattaagaaattattcatttatgcgaacaacttcattcatcatttaaaaatgcatatgaagcagatatgtttcatcgaaatgatatatctaaatatttttatgaacaaaatttgatgaaattaaaaattctgttggaaaaattgttgttttttttttcgcggaaaactttatgaattttaaaatttttgattttttgtttgaacaataagttattaatattcatcttaataaatatatttatttattgtgaataaattttttccctaatatttgattttttacaacaatacccagaaatcatttcaaggatttaatacactatttttatacctctgaaaacaactatatcgaaatagttaaattacttcttgaacaaaaaggaattgttattaatgataaagatatttatttgttttatttataatttattataatagtttggaaattcaaaataatatttgaaaattatttaaattatttaatacagcacttattcatgcatctaaaaatggtcatacagaaatagttaaattacttcttgaacaagaaggaattgctattaatgctaaagataattatttgttttatttgaaatttattttaaaaatttaatatttcaaaataatatttggaaattatttaaattattttatacagcacttatgcttgcatcttggaacggtcatacagaaatagttaaattacttcttgaacaaaaaggaattgatattaatgccaaagatatttatttgttttatttaatatttattttaataattttggaatatttcaaaataagatttggaaattatttaaaatatttagtacagcacttattttagcttcttgttgtaaataaagtatagtaaaaagcggttgaagaacgtaaaaacttaaagcttgcattcacaagaagaactaaatcaaatttgtcgttatgtttattgaccttcaagagcttccttacgttgttgacggcgaaccttatgacgttgtgcacgaacgcctgaaccccaaacctttaccttttgcttacgtgtattcttacgcatacggcgagtaaccttgctcttttcagcaagtccagccttgataagacggtgctttggttcgattgttttgagtgcatcaagattgtcatagataaggccaaaacctgttgtacggccacctccgaactttgtttcgagtgagaagatgacaatgagatctttgttagctttgagttgctttgcaactaaatctttgatttcatcgcgtgttggtgccctgtttcctgggtgtttaagatcgacaacgaactgtttacgatcaagtaatttgtttacgatgtatttacgaatgcgcattgtaaccttcgacattctccgaaaggccaaccaaaaccgtcattacccgcacgatatgagtttacaaaaagtgccatcgataaatgtatcgtatcggccaaatattaaaaagtgacaaggcgataaagataaatgatttttgtttttttctcattaacctttgcaacaccaatacatttaacagatgaaaattttacacgatttttaaatgaaacaagtaaaccagttttcttgaaattatgggcaagttggtgtcctcattgcaaagaaatggcaccagcatgggaagcacttacatatattgatgatctagatgaatacgtttcaatagctgatatcgaatgtgaaatgaatcgagaatcttgtaaaaaatataaaactgatagttatccaaaaatattttggattgataataaaaacaacattgaaattaactacgacggaactaggaaccttgagcacatgcttctcttcgttaaaaaacaattaaattttccattaattccaatcaatgaatcccaaataagttcatatatcaaaagagcaaacacaacaacagtgtttgttttcacaataccaccaaatgataaagaaaaaattaacagcgtacgtaatgtttcaacgcagttcagagacattgagtcacatttccttttgattgatgggaaagaagacgttaagccatccttaacggtctacactgatattaacagatccgaagattataatggggaatgggatatagaatctcttacaaattttgttttgctgcactcacttcctttctttgttgaaatctcttcttacgtgatgaaacatttaacaacccaaaaattaacagcactcatttacttaacaaacacaagcaaagaacctaccagtgatgctatttctatttgtgataaagtttcaaaggactttattgtatcaaagacaaattgtgaagattatcaacatttttgtcgttacataggagttaaaaacgcttctattccaaagtatgttttgtacaatagggctggagctcgtttttggatatatcaaaacgaaagtattattgaaaatgatgtgttgaattgggtaaaaaatgtgaaaaacggagtgatcaaaggaagtggcccaggaactggttttggttcttcaatattggcaatatattataatatgaggggccaaggaacaccaacatttgtatttttcctacctcttttaatggtgttctgtgtagctctgatggtttgggataattgtagtcatagagaaaagattaagaaagaataaataaacatatactatacaaacatgtttatattttccaaaaagaccaagtagataaatcttcagcttcctggaacattttgtcaacttctttatctgtgtgttttacaccaaaaatatcccatttctttggattgtcttttgtttgatcgtcattgaacaaatcaatatgtattccaatctctggtctttcgtgtgcatcaggttcctcgttttcttctgttactttatcaaaagggtggtttgtgctcatttgctttcgtaaaatacttttaacgtctttcgaaattttaaacgttttatacaatggttgaaaccctaacagcagaacaaatccaagaattccgtcaagctttcgatatcatggatagaaatggcgacggtgtaattaccgttgatgaccttgcctctgttatgcgtgcaattggtcaagccccaactcatagtgaacttcaagatatgatccgagaagttgatgctgatggaaatgacaacatagatttcaccgagtttcttgctttaatgtcaagacaaatgaggcaaagtgatattgaagatgaattaaaagaagcgttccgtgtttttgatcgcgataatgacggttttataactccacaagaacttaggtcattgttaatttcactaggtcttgattcctcacctgaagttattcgtaaaatgatcggtgaagctgacagaaatcgtgacggaaagatagattaccacgagttcagacttcttgcacttggtaaataaataccgaaacttttttacctaaaatttccagattattaaaaagttttaatccagtttttaatctcatgcgcttacttatattttatgaggcttaaactctttttatatcccgcaatctgaaggtttgtaggaaatgatcacaaatatagttacagaaagaataggtggattagtgcaatccctctctgtaaagtgatatcagttgtcattgatgtacttgattgtcattatcttttatgttcaattgaaacattttcattaattagtcttcttgcttcatgtgccaataagctacaagcgatcaccatagtttgtgactcacaaaacattcaaaaaactccgaaaaagtcaaattgtgaattagcaaaattcaattacagtatatgatctaaaacttttaagactcctcaaacgatgttgggttcacatcttcgaagatgatatcattttggtcgggatatctatttattcactattataatatattacatatttgagcgctttatgtaattagtaacattcgtaacatggagatgcattggctttgttgaaggcgaatacgattaaagcctacgataatatcattcactggaaagacatagagtcacccaagcaaaaagtcggaggaaggttaaaacttattgtaatggatgcgcaagttatacatttcttgataactgtttttcaagtactgataatacaagcttatggcactgctgattcaggtggagtaactttggttcaatatgtaacgatcgttggataatatttatcaaaaagaaaatgtgttaataatgattggtttttatattttatataagaattaaaaaaatcataaaaagttacatttcttttataagttcattttttgtaaatttgtttctttatttacatagttaaccattaaattcatgaagctttttccttttttccattaatttctttatcgtgcgagatattatagcgtttaattccattggatgatcatctatttttagattattctctttattatccccaatcttattttttaattcatcaaaagaactttccatcttagatatttcctttgaattaataatagacctcaaacgatttaccacatcgtctatcttcctagttgataattggctaaagtcatgcttacctttattcatttctttgttgaattttttgttattattataattgtaaggggatattaattgtatttttcttgttgatgatttcttgatttcccgtggctttactttaatccacctacttccagtatttcttaggaatgaacctttagtgactaatataagaaaaaacatttaaatattttgactttatgcaaataaataaaattaataatagaataaagaatatgaagacatcaataaaaaattgtcatctgacttgtcctttagaaaggggctcaggtgtgaatgccaacataagtgctgttttaaataatttaaataattttcaaatattattttgaatttgaaaattattaagataaatattaacattaatatcaattcctttctgttcaaagtataatctcactatttctatattaccattatatatatgcacttatactgaatgtaagttacctttcatgtcttcaagtttatcttggtaaaaattattcaataataaatttgccttgtaaaaaacacattactttcagtgcttttagaattcattaaccaataattttgaatatatatttatatctacaccattcatttcctcaatgactcagctctcacagacaaagtttcacatttcatgaaacaaacaatttttttatccataaatttcaagtcactattttcattattgccaatatacaaaattaatttttccgtaaattcatttggtgattcacaacctcccataaaaagttttatctttaaacgtttgtattgttgattattttcccaagtttcagtaccatacaaaataacaacatttctttgtaaataaatgatacatattgatgcattattaaaattatttttgattttattttattaaaattaagcaaaaatacaattatttttgtggtgatcaagttccttgttatgatgatccgattttttaggggcattaatgtcttttttattgtcaatgatcagtcgaacaatggtcgaaaacatttcttcaatatttatgtattcttttgctgacgtttcaaagaatggcgctccaatactcttcgcatattcttctccttgttctttacttacttttcggtttgaacaatcgcatttattaccacaaactacaattggtatataaccagttccttttccatcttttattactttgtgaaacatttcgagttcgtcaaaagtagttttatcaatgattgaatacattagtataaaaccatctccaaatcgtacataatcaggccacatttttatatagtcagtttgtccagcgaatgttgtaacattaaatgttatttcatcatcatcaattttaattttatatctgattgtttccgtaatggtagggttataaacttcagaaaaacttccaccatgaaacacttccattactgataattttccagtatttccactgccaaacaaaacaacttcgatgtatttttcagtttccgtttaagtatatttctttattcaaaaagtccatgttgtaaacggtttaaaccctgaaaatgaatgacaaatacgatcaaatcattatcaaaaagtggaagttgattagtcacttttgatacaaaaacatttatcatctaaaatatttactcgtgaagttataggtcaacaatcaagcatataactcatttttgctttcatcattaaaggagaatttctatccaaattattattgttttcatgttaatactttgtattaactacttcatctattaaagaatttatatccaatttatacaaaatggctgatggtgcaattcaaaacacatttagcctaagtgatatagcagctgctaagacatcttgattattaattgaaacatcattattaaaaatcaatctaattacatttaaattctttttcttttttcaattcaaaaaaaatgagcccataatcttaatatgattcaaaatacaaaacatacgtattttttatttcattcattgccgagtttaggaatttagtatattttactatttctttgtttaatttgcttatttcttcttctttattcgagatttcgttattaatttcttcttttaatttatgaatctcttcttctttatttgttatttcttgtttatgttgttctatttctccatttactttgttaatttcttcttcttttgtatttatttcttgttgaagttcctcattttcatgtttaagttgttcgatttcttcaaataatttcttggatgtttcatctttattagtgatttcattttctttatttgttatttcttgttgaagtcgttgtatttcttcttcttttcctttaatttcattgatcttttcttcatttattttgtgaatttcttcttcttttgttgttatttcttgttgaagtccctcattttcttgtttaagttgttcaatttcttcatataatttcttggatgcttcatctttattagtgatttcattcttaatttcttcttttaatttgtcaatttcattatctttgtttgttatatcttgttgaagttgttgtatttcttcttctaatttattgatttcttcttccttatcttcaatttattgattttaacggtcgcttttaccaccaattggacaccaggtatcactacaaaattttaattagaatattataatagtgcatttattatacaacagagaaatatcttattttgtcaagtttttacagtttttctaaaaatgattcaccaaaaaagataatgcttgtacttggaaaagaggatttgtggttgtaaaacacctgctatgcgtgggttctggcagtgagcaaaatattgcttcccttcttcaggattgagccactatgcatttttttcccctaattaaaaatataagtcatagcaaacaaaataaaacatttatttttctagaagtatgttctgtgggttaataaaatatttatgatttatccgcattatctgagaaatcgtctatttcatccagaagtttttgtatcatttcctgattgactgatgacgaagagctagagtcatcaatagctattgctttaacttcgttctgttgtaataatgttgaagtatctcttactggttcatctttattaacaaactcaccaatgtcaatttcttttgcttgttcaactttgggttcatctgcctgtctaaaacatgagcaaaaacaacccattaaagttttaacgtttagctccacaattaacagcacatgccaattttttcacagccgataaatttttgagaaaatgaaatattttccacaactacaatttgcatttaatcttaatgacaattaaccaaaaataacaatttatataagcttttaaagaaaataaatatttactattaatgaaatctctcaatcatcattatcatatcaatcattttcacttcattctctggaaaataattaattccaatcaatcctggtattttatctctgttttttgtccaattttctcttataaaatcataaacaattctaaatttatcctctcccaatttctctttacattcatcctccaacttcttttttcttgctgcaatattcatttgtattgttggaacaagttgctgaggaggcaatttggaaagagacgactttacaatctcggcaaaccgtaaaccgtcgttgttaatttttctgaagctttgtcgcatcaaatcgtttgcgatgttcggattgtctcttatccacgaagggacatcttgttgctctatctcactattagttgattgcttagacgcttgtgtgctttgttgtgaatctgttcctgaaactttttgttggaattttttgagagcattttgaatgattggatattgaagaatttgacgacatgtcggtctaagaataggattcttgtttaaggtcttgagaagaatatctgtgagttgtttagaatacttagaaaatgattttcgtggaagtgattgatattgaatgttattgaagaggtcttcccgggattttccggtaaaggcatgtttaccagtcataagctcaaaaagtacacacccagcagcccagacatctgccggatatccatatggtttccctttgattatttcaggcgccataaaatatggtgtccctattattgttttggcaagatctgttttacctatttcacgagaaatgccaaaatcaccgattttaacaaagccgttcttaaaaagaaaaatattagcaatcttgatatctcgatgaagaatattttgtgagtgaatgtattccaaaccaaatataagttgtgaaaaaatttgaagtatttttgcttccgtaagtttatttgtatcaacataatgtgataaatcactagcatctgcatactctaaaacaatacaaaattcatgatcattcttttgaaatgaatcgagatactcaataacattaggatgttggagttttttgagatattctgcttcattttctgcacttgcacgagtttttgcatctttggtacgaattgtcttgataacaacatacttgccatctcttttgtcatttgctaaaacaacagaaccataactcccttttccgatatctttaataactttgtaattttccattcgttacattataacgaccgtttaatatccatgtcaacaaaagaaacatcttattcacttaatgaaaatacagagaatgaatattggtctgccaaaggagtttgggtaatagataatttccctagccaaaattattctgcatgttcacaaaatttttctttatcaaaagatttttatttctatttttcttttttaaacccatttagccgaaatgaattaaatgtaaatgtagttgtgatgttttctaagatttcaaaagattatccaatgatcttaacaatgaacttgataaatagtgacgatccaaaattgaacttaaaacaaacaaaaaaagtgatttttacacctcaagcgctcaggagctatatcgaatttccaatttcttggaatgatctcattaaacaaaatggatacgtagaagaaacaacaggaagattaaggatagaattcgaattcctccacgttgcatttcttcctcaggttccaatcgaaatatgataatttgtatttaaaattgctattttttttaattttgttatttttttgaaattgtcattactttgtaaaaaaaatataaatacgcaaaaaacaccagcatattggaaaaaaacaaaaaattgcaacagattttgaagttgaaataatttaatcattaattattgttttaaactctaaattaatattatttcgattccaatcttttgacaataaatgtgcacatcttaaccgcactaagtgcaacattaagctgctttggtgctttattttttttgtgcaaaacaattttttttgactattatagttgacacttttgtagaaaatttgcgtcactttttcagaaaaacgatgacgaactgcgtattcattgctgtttacaacgggaaaaaagcattagctgttcataccccagtgatggggaactacgatcagctttatcttaacatttataacaatggaataaaaactccattattattccgtcaagctaataattcattgatcggtatacttcacgacgacagcgatttcaatgttatgcttgtaacaactggtgggcaaatgaatgaaaaaattatgggtgattttcttaaatcaatacatggaaaatttttatcacaatatgctgcacaatggaaaacagctgagcacttagaattccaagatgcatttaagccatactttgaagaaattcagcggcaaattgaaagaggaacgagagctaaaatatcacaaatcaagtctgatctcgacgacacagttgttaaaatgaaagataactttaaagaagctattcttcgcggcgaagttattgaagaattagatgaagatgcacaaattgtagaaaataagtcaaaagaattcaatacacaatcaaccaaactgaagaagtacttttggtggaatcgctttaagtggtggcttcttgttggtgttcttgcgcttgttgttttatatttagtattagttcttggctgtggcggatttgatctcaaacctcgatgtcgttcatcaccatctgtgaaaccaactccaacacctgcaccagttccagaaccagagtaaaattaattttttttttctttattttggattcaatgaattatatcggtttttttttaattttgattggaatgtattcaattccctattcaaatgatcaagtttgtttcaaaaagtggttcagtgaagttggccccttaaaagtggcagaattctaaatggcaagaagaccaaagaaaggtggtgaaccagacttaactggcacacgttcagaaggctatctccttacacttcagaaggatttacaagatatcagagaaatggaaaaggttcaaaatcttaaaatgacatttccagatccttctgatatcactcatttcatcattgatatcggtatcacatcaggtatttacaagggtggtcacttcaaattcgactttaagattccacctggcttcagagctgaaaagcctattgtacgtattttaacaaagatttggcatccaaacatcatggaacccaaggatggaggtgaaatttgtttgagtgttcttcgtaaagaatatcgtccagcaaacccacttcgtattatcgttgatggtttggtgttccttttcattcaaccaaatccaaacgatcctcttaacattccagctgcacaacaaatgttgactaaccttccaggtttcaaggcaaaagttgaagaatatatgcaagaagttgctgagatggaagatgaagatgagtgagattggtaaagccttaatattacaaattattttttttgatttgttgattctcttcatcaatttagattttctgcattttcagaaggttacggaaaagttgcaaacggttacgacaaaacgataaacggttgaattgattttaacggtttcttaaaatattggttttgcaaaactcttataataattgtgatgctaatttaaatattttttaatgctaaaagtatctgtttcaaatattaatatataataccacaattgttcatgtgatttttagtattgctgatcaacaaagcaaaataagaaaatgtagttgtaggaacatcattaagttatataaatgcagacgatattaattttgtggattaattcataaatatattgaaactccacacgaattatgcaacaattcattgagagtaaacatcagaaaaagtttctcacccattatgtcgaccgtttatgctaatggatgaaacaaaaaaaaggaaaaataaaaaacaaaaagtatcagaaatgttttacttattggaaatagaacaactcatttatagtttaaattctgataacatcatagaaattgttgaatcattaatacaaaaatatgatccaaaaataacatattcttttaatgtaataatttgtcaattaatttattcattttttttaagaaaatctattagtgttgatcttatcattcaatatcttcaaattattaaatctaaagaaaatactaatattattattagtaaatattcatgtgatgatgatatatttgaaatatttactaaaattctttatgatatcagctcacatgaatcgagttatcttctagaaatgctaattgaacaaaatgttattgataaaagtattataaaatatcatttttcaagggaaggattttatgattctgatatgtaccagaataaagtttcatattttgctcattatttgtcaaatgaagaatttaataaaattaaatcgaatgaatttaatgataatttttttaaaactattgaaacccttaaaaagaatgattgggagcttcataaaaaattaatcaaagaaggagttaatccaagtgaaattttaaaaatcattcgaaatgatgaaattgaaaaacttcaagatatttcatcacaaaataattttgattttaatcaatttattaaaccatcactttatgaaagatgttcatttattaataaacgtaatgtttcattaattgattatgcagcattttttggatctattaaatgttttaaatatttaatgttaaatggtgcaaatgtaagaaatacatgtatatatgcaattgcaggtggaaatgaagaaatcattcatttatgtgaacaaaaacattcatcatttaaaaattcatataaaacatcaattatatttcatcgaaatgaaatttttcattatctttatgaaaataaaattgaagatattagtttagaagaattaggaatgatatgcattttatattataattatgaaattttgtcatttttaattgatgaagggatgaaaattgatatagattttataaatacttcagcaaaaattggaaatttatatcttgttaaatattttcttacaaaaaagaatattccaatcaatcttttgattgattcatcgtattctggaaattatgaacttgtgagatatattattgaacaaaatggtatcgatattaactatatagacacttgtttttgttttttagttattgttatatcaatttgatgttataaaattttatttggagtatgtaaatattatttcaaacagcttttacaattgtatgttcaagaggttattttgatattgcgaaattgtttgttgaaatgggtattgatataaactcaataaatattcttttaaaatatttcagaaatttggagttgattttttgaatattatacgcctctttgttttgcttgtttaaataatcatgttgatattgctcagttattacttgaacaaaaagatattgatataaacataaaaaatgttttttgttttgattgaaaaatgttattataaaattattggaattttttgaatttatttaatactattctttcagaagtatgtgaaaacggatatctaattaatgttgatattgttcgtttacttgttgaacatggaattgatttaaactcaataaatattcatataaattatttaatattttaaatctgtttttggatttttattaataattttaaaacatctttgttattagcatatcaaaataatcatttcgaagtttttaaataccttgttcatcaaaaagctttagatgtgaatattaaatgtattcttttgttttgttagatgtttgttttaatgattgaaatttttaatcgaacatttggattttatataatatgtttaaaacaatacttatttatgcaactgaaaataatgatatagaaatagttaaattacttcttaaacgaaaaagaattgatattaatgctaaagatatttttttgttttatttgatattttttatgataatttaatattttataattatatatgaaaacctttcaatttatttaatactgcgcttataactgcagttgaaaatggttatgtaaagatattcaaattacttcttaaggataaaagaattgatgttaatgctaaatgtgtttttttattttataaaatatttaaattttttgcttcttatttcaaaataatatttggaatttttttaaatcatttaatacagcactaatttcagcatcaatgataggtaaaataaaaatagttaaattgcttcttaaacaaaaaagcattgatattaatatcaaaaacatttatataatttatttgatatttatattaataatttagtatttcaaaacaatatttggaaattttttaatttatttgaaactgtgttaatgtctgcatcttttaaaggtcagttagaaacagttaaattacttcttaagcaaaacgaaattgatatcaatgctaaaaatatctctaaattttatttaatctttgtattaataatttactatttaaaaataatatttggaaattgtttaaattagttgaaaatgcatttattttagcatcttatgctgatcactctgaaatcgttaaaaaacttcttgaacaaaaagaaattgatataaatgctaaaaatatttatttgttttgtttaatatctattttaaatcaataaaattccaaaataacatttggagattgtttaaattatatgaaacagcacttatgttagcatctggaaatgggtgcactgaagtagttaaattacttcttgaacaagatggaattgagataaatgctaaagatattcatttgtttaatctgaaatttattttaatcgtataatttttcataataatatttggaaattctttaatttatttaatacatcacttatattagctgcttattatggtcatcaggaaatagttaaattacttcttgaacaaaaaggaattgatattaatgctaaagatatttattcattttattcataatttatttgaataaatttggatttcaaaataatatttggaaattattttaattgtttaaaacagcatattcatattcaactcgatatgaaaacatcaacaaactcatgaacctctattgcacgaaaacgtttcaaaaatgcatcataaattagtttaatattattataataaataaaaaaaattttagataaatttttattcccattctattgttgctggtggttttgaagttatatcatatactactcgattcgtatgaggaacttcattcacaattctacttgaaattgtttccaacacatcataaggaattctcgctatttttgctgtcatggaatcgatcgaatgcacagctctaattgctataacgttttcataagttcgataatctccttgcgatccaactgttttacaatttgttaagaccgtaaaatattgccatatagatttgtttaatccagacttctcgatttcttctttaagaatatgttcactattccttaatatcttaagtttctcttcggtaacttctccaattattcgtatcgcaagccctggtccaggaaaaggttgtcgaaggacaattttttctggaagggcaagttcaaatccaacttttctaacttcgtctttaaacaattctcgaagtggttcaatgatttcttcgaaatcgaaattattaggaagtccaccaacattatgatgacttttaataacagaacttttgtttttacatttcccgctttcaataacatcaggataaattgtaccttgcgcaagaatagtaaactttccaagttcaagtgaatgtctttcaaatgaacgaacaaattgttcgcctataacttttcgcttttcttctggatcagaaataccttttaatttttcgataaatattttctcatcatcaaatttaatgagttgaagtccgacattttcttgaaattctttaatgacttcatctgcttcatttttacgtaaaaatccatgatcgatgaaaatacatgtaagttggtttccaatcgctcgatgaataagagttgcagcaacaatagaatcaacgccgccagaaacgccacataaaacgcgacgatttccaatgattcgttgaagctctaatattttagtagatacaaaatttttaatgttccatttaccatttgctttaacaacttcatataaaaagttgtaaagaatatttaagtgattttggattcgtgtggtgtcgatcatttcttgaacttcgggatgaaattgtacaccatatattttgttttcttcatcacaaaatgctgcgttttgacagttttgtgtgaatccaaatgttgtaaatccttttggtatctcaacgactgaatctgtatgactcatccaataagtaaatgaatggtttgagaatccttttgttacttgtgtttcaacaaaacgaatttcgacttctccaaactcagatttagtacatttttcgactttacctccaagtgtaaaagctattaattgacacccatagcatattccgaaaatagggattttaagtgaaaaaatttctttagggatttttggagaattttcttcataaacactattagggcctccagaaaatatgataccaatcggatgaatcgttttaatcttttcaattgtgaccgactcactatttattaactcacaataaactttatattccctaatgcgcttggcaataatctgactaaattgtcctccaaaatcaataattaatatcttttcttcttgcataaatgaataccctcaaaaagtatgaaaattaattatgaaatgtttaggttttattcggaagaaaagtttattatcttattgaatgaagaaactttaatcattctatgcgctcaattttgaaagtttcattttaaaaacataaaataaaataagtgatctgttaattaatcactatgtaaaaaaaagtttgttattcattcaaacatttaaacacattttaaatataaaagatccacccaaataagaaaaagtttggcacgatcaaaattaattgaatgtgaaatatttgaattgattttgatcgtgtggtactaatcgtgaggtaaattctctctgtctttttggatacgagtgttttctgcaataacaaggggtacgagaatgttaggaacattaagtgctttgtcaggaatacattcaacaaatattttttctccattaacaaatgttccatttttttcatgaatggcattggctgcatcgctttccgtatcatactggagatatccaacactttttttgatttcaatctgttttaaataaccatatttccaaaagtcattatataaatttcgatctgtgagaagttgaggtggataccctcttattgctaaagttcttgatatgattgtctcgcctctttttcgatcagaataagatggaatatcaacatgttcaggcctctcaaacgtaacttgtaaagtaactccagcaattttgagctggttgaagtaatgaacaaatgcttcagcttcttgaatttctggaaaatatatgaacatgcaatcatcaaaaacagaaaatcttgaaaaagtataaaatccttcctgctcaaaaaagtctaaaatgtaatttggatcattgaaaataggtgccactctcacgggatattccttggacatccactccatgatcaaacaaagatagttaaatcaagatcttgattatgtagcacttttgtgtttaatgtgcgaattgtgatatgaaaaatgattgtatgtttgcgaccaattgaaaactaatgtatttcgttcacaaagatatattaaatctttgggttaatcttcccaatgtgtcataaaacaaaaaatgaatttgaattaaaaaatttttgtgcatcacttgatatttatatctaaaaaatacgtatgttttgtattttgaatcatattaagattatgtgttcatttttttgaattgaaaaaagaaaaagaatttaaatgtaattagattgatttttagtattgatgattcagttaataatcaagatgtcttagcagctgctatatcacttaggctaaatgtgttttgaattgcaccatcagccattttgtataatacattccatttcgcttcaaagttatttctatcatttgaacttaatccattttgattaattctttgcttcattgcattcaaatcatactttaatccactgtctccttttgttccgattgttttagcttgtactgctctttcaagtgaatcgtatttacttatgaattgcgaataagttgaaattgaactcattccatttaatgcgttgatgtcttcttgtagcaaaacattcattttttctgttcttccgggtgtaatgtaataagtttcgtttggacagcctctactgtatgcggcgccaacagaaaaatcagctccactgctagaattgtttataatataagttgtaacttttttgaacttgatattatatcttctcattttttcatcgcctttttgaacagttccagaagcaacgtaaccatccgtaactataatcaagtgatcgtgatattcgcttcctgccatatttgcaatgtccgcaatgaggtcagaatctgtacctccagaaccatatttacttgaaattattaaatttattgaatttgttttgtcttcaggctgtgatgaattccatatataaatcttatcgccaggactgaagttattattaataattttttgaagttctgaataataaaaaacattaccacttacagatccagatgtatctattgcgaataatctcttctttataatattaggcatttgctggaatttgttccatttaacacccaattgtatgttataacttacagcttttggcctccattcattaggtttattacaattatctatccacatatgcacttcaggtcgtgctgtccatccggcaatattttgtacgtatcgaaatgttccatctgttcgcatttgcataaaacattttgtgtaaccacaatcgattataatatcgccatgaacagtatcacttggataaaacattgaactaattccaccttctgaatcacgtgaaaatggaatgaaaggctctattttattttgcgcatatgatattgtaattccttcgaaaatttttccaagattatgtgataaagaagttcgattaaatttcttgaagtcttgtttctttctattgaaagtttgtggattctttaattcgcctgtttcatctccaagtaaaattttacttcctgcatgttcgccaccaatacgtaattcagaacatttatttcctaattctggaaaagttgctgtttcaaggaataaattaacttgataatgaagtggatctccttctgcccaaaatacaattgagcctccattttgccaatactgaattaatacttcattaaattgaccaactaaattcggatctgcatgaggattgttttgaggaggtaatagtgcataaggaggaccgcacattacccacacagcataatagtcacaatatccaggtttagtttgcttcgttaattcgacaattgcatcataataatttataacgactttaagttcaatgccaaagtgatctacagctgttttgatacattctgtatgaccttcttcacttgatttaaatatataatctggatgaacttctgtggactctttctcaggatttaattcatttgaccataacattactataagtattttttgaccttttaatgaatctttatcgtatatttcagtattatctccttctggattaataaattcattatttgcatctttcacattttgttctgggttatagaattcacgaaatgcatcaagtgaaggtgtgatattttgtaaatcttcttttaatgaagaaaatattggattgtccttgtttttaattaagttttggattatatcagatatagtttcaatatttggttcattattttgaactaaagatattttttcaagtttttctattaaatcttcaccaaaaatagaagcaataccattcattaaataagaaggattaggtgaaaatacaacttgtgggaataaattcgtgattccttttggacaaatacctacaccaattccaattgtagtaataccatattgtacacatgaattaacttgttcaagaatttgtttttgttcattttcttgatataaaccatcagtaatgacaaataatatacttgaataatccgttgatttgattcgtttcagatcataagctgcatgaatagatgaagctaaatcaacatttcttttattgttttgtaaaaatgcaaataatgattcccaaattagtgattttggattcaaagcattaaatgtatttacaccagaacataatatatttggtgttggcgaacctgcaataattaaatcaaaacttggtaaatcaagaattgtaaatactgataaaaggctttgaattgtttgaagtgtatgtgcaccattaagttcactaaaacatgaaattgatggatcaataacaatagttactccataattacgaattaatcctcctttttctactaaataaattaatggatctggtactggatttaatatatttaatattaatgcagtgatatcaaaatctgtacctgttgaagataaaactgtttgtgaagctttatttggtttaaatatagtttctaaagaagaatgatgatttctttcagttttaataaatgaatgaattaaagtatcaagttcttttttctctatttttcttgaagatgcattaattctatttgaatgattacgataatgtgacatctttaatttactaaacctacttgataatgaatttaatacttctgttcttcctgaataaactcctttttctaatggtattatataatgcattaatttcttaaagttatccaaatcatttatttctggtatcttttcagcaaactggggaagtgtaatttcttgatattgtgaaatttgtgtatcatcaagttcacgtttcattacattcataaacatttcaataagtgatttagtaagttgactattgatttctgcttgaattgaaacaacttttattaatgattttgcaccaagttctttagttttggtttcgaaatcattccaaacaccttcaataaagtctaagttttctttttcaagtttacttgatttaataaagctaaatccaaatgaataattaggattagataaaagatttgcccagagacttgttcgaagaagattttcatctaatccatcagtaaatgtgaaaaatgaaacgtttggtcttgttttaagaattgattcaggaattgtatcaatagcaaatttaatcgaatgaattaaattagttcgatatcttttaattaataagcaatcaagaattctttgtaatgcaacaattgaatgttcttcttcaaatgatttaataacacatttaaatttctcatctgcaattaataatactgaataaggaatttctaatgaattaagtgctgctgttaatgaacatattatcaacatattaaagattttgtttacatcagatataaatgaactacaatcaactaaaatacaaacacaaatattcgaatatggaactgttgaatcagttgctgcttgaataaatggtgcactaagataataactttgttgaataagttcttgaattggaaattcatttttgtttggttgaagtaaatcatttggaatttcatgtctttcttgatagaaaattgtattatcttcttttggattgctcatcatttgcttcatacgtataattgctcttagaattccatcaatttcagttatctgagaaagattttcttcaaaattctttttcgtaacttctttcatttcagtaccacctcgagcggttacaacattctctttattacgatcattattttctccattattctcattattctcttcttcattatcattttcttgttcaatatcattttctttatatttcacagttattaaatccatttctgattgaactctttgataaattaaatcattactttttgacatatttttatgttcaattaaaatttctttttctgttttttgtttgtttggtaaattataaaattgatcttcttcatcatattgttcattactaacaagtctttgattttctgattgattaaacattccaaatttaatatttttcatattatttccatcagaatctgttgaccatttatttttagcttgaggaattgaaccaatgtttggaatctgtataaaatcttgagatgactgtgaattaaccatcatattacttggtaaattcatgatacaaaagttagcacctgctttctttaacttacttgtaagtattttgaatgattcgcaaaatgtattaacataaatagataaaaatgaatgatcattatatggtaattttcgatatatttgaagtaatttagtataatattctgcggctggttttaatacttgattagaaatctttaaattacgtatatatattggaagaactcttgtaccttgtatacataaagaataaatttgaatcaaagaagaaattgattcaaagttcaaaccttctgtaaatgaaggcaaattaaaattaatatttgttgaatcagtggcatcttgtttgatctttgtatttgcaataatcttatgaggattaaattgtttctttttctttggttgtttgaattcattaatcaaataacattttgaacctatatcttctggatcaagttgagcaattttggctttgatttcgttgtatttctgttgatgatcactaaaaatagaactaatttcgattttgatttgttcttgagttgtttgttcatcatattgaatatattcttcatataattcatccattttttgcttaatttcacttggttctggtgatggataaagtttgaaactttgattctttaatatttcatatctttctttgaataatttgtaaaacctaattattgtattatacatatatacagaaattagatcaccatatttatcttcatttggtattaaatccatcgttttctcttgaagttctttaggtaatttttctataaagtctttgattttataaaacacattctgattaattaacatgtacataaatttcacataatctctatttgaaatgtgttccatgtcttttccttcaaataaagtacaaactttttctatagcaatttcaatattttcattagatatttctaactcacttatgtcatctaaatttggatattttgaaaatgctgggaaccattgaaaattctcatcaaatcctattaatgcaagggaaaattgaccatctttttgaaaaatacaagaataatcacttatttgaaattctcctgtttcaaacccatgaatataatataattttttaatatttttaggggaaatattaaattcttcatattttatttcttgtgaagattttggattaccaaaatgaaatggagtaattgacatatttgatttgagtaattctctattaaatggtgtaatatcaactctatcccattccatagttgaataatcgagaatcaatgcagaatataaaaatgatgtgtttatatatagagaatttgcatcaacaaactttattgttaccatttttgatatattatgtgattttattactaaagaataacaataatttccataatcacgatgataaatacttgagtctatttcaagtgttaacacgaattcagaaatttcttgtatatatatgtcatctgtattctccaaaatctttactatatttggaagatttgacttaattaaattggctttttgctttccaatatgaggaattccgataattttacaatgtaatggaacacgccaaattaatttttcatttgaataaagtatacttatattatttttaaatgactttgtgggaaaatcatatatttcaaatctaaaatcaaacggaactaagattgtatcaatgtgtatagtaataatgaaattcgatgaaaattgcaaataaacattacaattaagtcttgtcatttcgttaaccaaaggaagatttagatataaatgatctttatgtgtgtcaaattgtggttgttgtgatttattgccatctagactttcaatactcggaatatatcttaagtcttcttctatataataatttttaagtttaagtgtgattttagatcctgatataatttcttgataacataattgatattttccatctttatataacaaattatattcttcacattcaataagaaatgataatggaactaattcaaaattaaatgtacatggaaggattaactctttatatgatttagacgtaaaatgaatattagttggaatttctaataaagtaatatcgttatccaaaagaggagggaaagaaacataaatttgtacaatttctcctggattaatgtcatgatgtgcagagaaaattttagaatattcatcattctctgtctcaatatcgattgaaaattgatgttcgataaacgaaataaaattaattgcaatagatccattgtataatgatggaactataggcccaattggacaagaaagtgatttataacaacattgaatagcaccttcaggtgatacacttaaaataggtgttgaaaagaaattagaatcaattatattatcaaatgatggaagatttctttctgggatttttgaaggatatggaatttcatatgaacatgaaaatacttctctatatgaagaagatcctatttcaccccaatattttttaatagtattttcaacataagaatcaaaatcgctgatattcttctccaaatgttttaatattgcatctaatttattcatggaatcttgcacttcattacattttgaattatctgtaaattgaacatctaattgagaagataaactttttacttgctttactaaatcttgtagaatttcaaatgtctttttttgaatatttgaattattaaaggcatcaaagaactccttaatctttgtgtaaatagtgttttttaaagaattaagtttttctttgaatgttccataagataaatttttgcaaaatataatttttggtacatcttttttgtattcatcttcgtttggaattggaaaagcttgtgtaatgtcaaaatcatccctaatattataaaaatatatatttttatgttttaaatttgaatttcttgaatttttgttacgatatattatttgacaaacttcaagatgtgagatatcaaggattcccagttgataattgtataaaatttgttttgttttatttaattcagaaacttttaactttgtatagtcgcttacaggtttatcaggattttcattaagatttgtttttatttgagattttaattcattatatctacctatatacattgataattcattgatttttcgttcccttaaatttttatcttctgttattttattttgaatgtattcttcttttttatgatcttgatctttaacaactgattcattaaattcttcaatgagattatccaattctgttttcatattttcaatgaaatctcggaattcaacagaactttctgaggttttaatttcattaattcgattatttctttcaaaaataattttatcattaataaatttacttggattaacaataaatttcaaaacattattttctgtttcatcagtttttgcgttaattacgtcattaaacccagaattaaatgttaaatttactgtttctttgatgaaatcttcaatacatttatattttaactcacctatagtatttttaaatttgagttcatctcttgataaagaattaagaaaactatgtaataattttgtattttgttcaataaactcaggaggaactgtttctaataaaagatttaaccaatctgttccaatattttcatgtcttaacaacttttgtttaatagtttcattaattgatttatgaagagtataatatattttttcaccggtcattgtattttgatttatatctggaacaacacaattaagcgaagaaatgattcttaaaacaagaatccaaattggaagtttatcgtctttaaattcttgctttgaataaattgtttgaagttgttgtgcacattgttgatttttacataaccaataaactaatgatggatacttattaatgaattcatcgttagttttccaatttgatttcaagaattctatgtcattaaaattaagtttatatgcttcaaagttatcaaatttttctgcaatatcaaacatatataaaacatttttaagtaaaattttctcttgaaattttccatttttaattttgttttcaattagtcctttgattttatcaagttcatttgaaggtttatagtttaaatcaaataaatttcgatatattgactcagcaattaaagtagacatttccttaaatgtttgaacacatgaataacaatattttcttaatgacttgaaaacattagggaatgagcattcttgcgtgaataaaccattctttacaccagtatcacttaaaatatttataaacataaataataaatctcttggctcaaattttggtaatgtaatcatcgctctaggatgaaatgtatttgcatttttatatgcccaattaatttcgttatcatctttttcatttctttctgctaattcatttagtatttgatcaagtttgaaaatattattatcaagtttatcttgtttcattttataaataaatgctgctcttaatgttgaatgcattatgtcataatcatcggattgaattcctgttccttcatttgagtcagaattcattacatgacctaataataattctcgaacattatccatttcagggaaattatttaaatcaagaatagaatgaactacttttggattatttttatctatgattttttcgaaaatatcataaattttagagtaccaaataagatgttgataaattttaattgaatttgtccttatttcattagtagataatgattgataaattggccagaatattgaattagattcacctggagaattattatcttgaatataatttaggaattcatttacttttcgttcacatgaaacataattttcttgagtaggtttcttctttaaaatatcttttatatgatttaatatttgcttacgaattcttaaaatttctttcttttctattttaatattattaagggtttcttgaagtgtttcgaacgatcgttgaagttttaacatttgatttttattacattcttcattaattatttgaataaatggtgctttagcatctacaagtaagtcaatataaggttctggatcccatattgatttatcttcaaataaaacatttttgatcaatgaaatttctttatcgatttttgaaatttcgtttttagcagcattcatatccatgtgttgatttactttatataaatttcctttaattctccataatattgaattcggatttccaatggcttctaatgcctttgaaaaattcattatcatttcgaaattatatttttcaacattgtcaagtattgttgaaattactttaagcatttcagattcaagagggataagatattcttctaattgtaaaatttcatcctttgaaaatgaatatgctaaactccataagttactaatcatatttgatggttcataactaaataacaatgataattgcccaatttgattatctcttggtgttttaccatggatttcaaatgctttattagaacaatattttttacatattttatatatttcttgactccttttcatattagaatatgattgtaattcatctatatgtttattgttgaagctaagaattgtttttgaagaaagtaataaagaattattatcctcaaaaacaaattgtggttgaaaactattctttggctttaggaaataaaagttgtatggcttttcttcattaattgttatggaaaagttgatttgtgcttggtgtaaatcattaaataatggtaaccaataacaaatatactcaaatggtttagaaataaatttattatatggaaatattttttcgattaattgtaataaattacgattatctcttaattttgatataaacgaattaaagttttctaaattttggttgtttgccattaaatttatagaccttattatatcaaagatattatttttagttaattcataagggatatattgtgtaaaacattgtgaattctcttcagcaaatcttattaataatctaaatttagaaagtggatgttttatatttgaaagtgaaagcaaataatcatctttaagttggatagtagaaataattccattctgattttcattaagtctttcaattaattcttggaatatttttgatattattttaatcgagtaaaactttccagaaataagtttagatttcgttgtttgaactggatgtttttgaattatttctaatgaatcattaatatgatattgaattgtttctatatcatctatttggcatacggtgtgtttacatttactaacaaaagaatataatgaaaaatcactaaattctttcttttctataaaatgattttgaattttacgaagatctcttaaaatttgttcatttcgacttttcacatttgaaaagttaatttttgataataattcttgttctggttctttagcaaaattatttatcatttgatcttgaaattcttgttttttatgtaaatcaatatatgaattccaatatactttcattgattgacaaacaggctgataaatattttttgctatattatctttataatctttttgatgcttaatgaagttaagtatagtaaatcgtaatgttcttccagtaaactctatatcacctgcaaatgaatcatgatcagtttcactttcttttttagcaagcgcatgcataagtgccattcttgcacctatttctatagaaagcttatttggatatgaattcttgattaaagatccaaataatatttgtgctgaatattctacactagaatcaattggtggaagtgtaaatgaaacgcatttattcaagaatgattgatctatagttttgttttcatttgttgaagttggattatatgtaacaattagacgaaaatcattatgaattgtaccatttctctttgaataataatattcttggcctcgttcatataaattaagttctggttcatcaccacaaagtgaagatattttttctgcaatttcaggtggagctgactctataccatcaattaaaaccatttctccttttttaattgctttaattattgttgattcaacatgatgaaatctatttgctggttgaattaaatctttaattgcattttcagtatctattaaaattttaagtttgtcttggtcgagttttgtatgatttgacttgaatttttctatttctacaagaagatctttgaaatcttttggtttccattcatttgaattattaatattaatatcaattttaaggtctttaaatgctttaactttaagttttgctaatgcttcctttatagaatgaaaatcttcattagatattgaattatcaagaattgactgacctgttagaatagaaattcctgtatctgcattcatttgaaatacattaagttttctgccaatcattttagcaaataatcgaattatatgcgatttacctgatgcagtatttccttgtattacacatccacgatttgcaagataagaacaagccaaaaataataaacaatgcttttcgggaagagttagacatcctataattgattctatttcttttacatttatttctttaggattaataggcaaaacaagtggtttactatcttgactatcttttgataaacgaatatttaattgtttagaaggtatatcatatataaaatctggattatacttgaacttcatatcaatcatattaagttcagataaaactttttgtataaattcttcttgagtaaaacgatatgcaaataacatttgagatataatatcttcatcaaaaataccataagttacctccctaaatagaatgtattttgtaatatcatttaatgccatattttgatttatatttgaatcattacaaattttattagtcttgaagtaatgttctaaaaatggtaattgttcattattaaatggtaaatgttcaaattgttttttgacaatactatttacatcttcattgtgtggatcaaatacgatatgataaattgacgaaaacattaatgaagtcggtaaaagatcacgattataaaatccattttgtgggttaaatatagcaacaagattcattttacctttttctaatgttgacccattaggtaataaaacatctttttgactagaatcaaaaatactaatcattacttctaaaacagcaggtgatgcattattaatattatgaaatacaattattgattttgattgattggatttaattgctttaacaagtttagtttcaatcatattaacaagaatattattatttttatctctttcaattgtaattttacctaaaagatcatcaacttttgttgattgagttataatgatatttactacttcatatcctaaaacttttgcaatataattaattgctgtttgtttgccttgtcctggcttaccttcaaatattacaggtgtatgtgtaattaaacctaagtgaagaacatcaaccatttctgtaaacttacctgtgaatgcaatttttggattttctttatattcattcgttgtttctataaataatccagtaatatttgatgtatatccgtgataaccatttatattatcaattttgagtggatcttgattaaagttttgtaatgttgttggtatattaatatctaaatcttgaacaatatttataagtttatttctatttgtttggctttcaagtaaaccagagcataaacgatacataattaagccaagattaagttttatttgtgttcttatttcttgtgaaatagaaaatcgagttaaaacacttaacatttcaattgttttaagcatttgtgggaacttaaattgtttctttaattttttattaacttcatatgaaaacttttgaagtaaatcaatttcagcatctgaacagtttaatttctttattttgatataattttgaagaacaattgttcgttcatctgatttatattcaggtatagctataacagtaaaacgagataaaactgcttctgacaatttcgatggggaatttgctgaacatgttgcaataactctaaagcttgggaaatctgttaattctttattatcttctggtgtaaatgtattatgtatatcttcatttaatgttaaactatgtttacctgaaaataattcattaaatctctctaaaactattgttggaagatttgataaattctttaaaattaatgatttcctttcaagtattgcagataaaaataatcctggcctaaattcaagaataatatttgatataacgcaattatttttgctttcatcttcaaatagtttttctacgaaatgttcgactgcatgagaaaatgattcgggaattctatttcttctttctttggttctatttactaattcttcttttgtaagtgttttattttttaatttttcaagtagttctatataatcattaaaaccacaaattttacatatataatcgagataaaatatttttgcttctgaaactgtaaagaaacttgatgagcctaataattgtgaaactgttgattcttgatttaatgtgataacttttgcatttctttggaatttttgagctaaaaatgtcttaaatcctgaattacccattaataaaattggttctgatgaatcagctaataataattgaaatgcactatttaaaaaagagtgaagctttggagaaatttcatcatttatttgaaatggaaacatgttaatagaaattccgatatttcctttcattatatatgatttatcaattactgggtttgctaaataacaattctttaattcttcttctttatcttcttcaagtttaaatactttaacaattaatttaacaactttattaagaatttcactaatatcattttcattaacagatgataatgtataaaaaagtacttggtgataaaatttaatcccaagataatttaaagagttcaaatcttgatgatgcatccgaataaataattttgtaatatctctaagtgaccattgtggaagaattctattttctaatttatttaattcgatcatatatttaccaatttgttcagcatttgtctcattaataattgtcatttgtacaccacctttataacaattcttagctatatcaacacatatttttgaaatatcttcttctgtttgttccggataattaaaatatctaaatcttgatgaaattgaatcaggaattgcattacgtccaattgtaccaagttcattttgacatgctatgaaaaagaaattatcattaacatgaatcgattctccaacaccaggaataaatattgttccacctaaacatggttctaatgcaggtgctaaagttttcatacaacttgctgttgataaattcatttcatctgcaataaaagttaacccatctttcattgaatttgttaaagttccattatgaaaataaactttcccgtttttgattgtaggtgttccataaaaatgattaggctttgttccagaatgaaatgaatgcatttgaaaatgaacactaacattttcattaactggacgaattgatgcaaatgctctagctgcagatgtttttccagcacctgttggaccataaacacagattggtaatcctatgattgatgcagcatatattttagccatgaactcacaaagaggtggtgaatctttataaaagaattgattatcatatgtttcagatatgtaatatgaatctctatttaataaatttagtaaattattttgaattattttatttggtttaaagttttcatttgattttaacatattaattgcaaattcgacaatatcttgtgattgaacattatttggtaatatgttggaatattttacgatagctttacaaaagaatgcaagccaatacattgacattggagattttgtatagccattgtatacttgatcaattatttcattatttatttcaaattgattttgatcattttcgtcttgatcataattcatatattcatttgtttcatttgaagcattttcttcttcttcttcctctttatcaaaaaaggtttcttcttgataaaaatcatcttgattattttcatcattttcattattttcatcatgaaaaatatcattttcatcatcattttcttcaatatgaacataattttcttgttcatttgtatcttttttgattttttggagtttattataccttatcattaaaattttaattaattctttgatatcttcttcttttaattcatttaattgattttcaagtactattacatcaaatctatttaagaatgcaggcgaaattaaatgtattttatcaatattgcaagtgcataaaagtctgaaatttttatcaattggaatttgactttgttgaggattttcaggaatatcaaacattttttgttcgccatcatatttttgatcaagaagactatttaatctttctgtaacagttgctggtgcttcatcaattgaatcaagtactgcacatttaccatcttgaattgcttttgtaaggaatcctggtttccattgaattaattcttgatcagtatctgtatttggcttttgttttccgattaaatcggaacactttgtttcttctgtacaaatacaaaagaattcttcttctttgttctgatttttatgtttcttatcataccattctgaaacccattttgctaattgagttttaccgcaaccttttaggccagtaagaattacatggcgattattattaaatgaaaatataattgattttaattctattgataatgattcattatgaaaacattcaggaaaatcatttggataaataaattcattattttgcttttgatttaataaaggataatttcgaagtgtctctttaagtttttctcgaagttgtttcttatatctagcaccataaattgtcataatggtgtcatatatatctgcaccatctgcaagagctctaacagttgctgcaatttctctaactgtaaaacagaaaatatcttctgcaatttctggtttttgagaccattccatatggaatttaacaagttgcaaaataacatcattattattgtagccaaatctttgtgctaatccttggccaatttttaaaagttctacttcagtaaattgtgggaaattaattatttggaatcttgacaaaaacttaatacctaaatcttgtcttttgttagcaaataatcctttatttggattttgtgttgctataagtctaaattcaggatgcattttaattgcttttaatggcattccaggaatttctacactaattacaccactatcaagtgcttcttcaatacattgtaatactgaaggtgaagctaaattaatttcatctaataataaacattttccttgagaaaatgcttgtaaaaatggtcctggcttaactataatacctgcccatgaattggtttcacctacatatctacctaataaatcacaagtctttgtttctgagcttaaattaaatcgtattaattccttctccattaatttacatacaacttcagcactaagtgttttagatgtacctgttggaccttcaagtaaaactggaattcctactgataaacaatcataaagttttgataatctttcattagcaccttcagtaaaaatgaaattcctttttataagttctccttcatcaaaattaagttgagttgaaacatttgctttttctttgatttttgcaacaatttgattgaaatcaatgttttcattatcattaaagtaattatcattatgcaaacttatgatttcttcttttttctcaactatagtttctgctggtaaaatttgcgctttatcactttctgattcagaattttcatctgagtcacttacaggttctagtaaatacgactttgctgcttcacttccttcttgcgctgctttttggatatatttcattccttctacctcactttttggtgttggattttcttcataacgcttaatcccatatagaaatgtatcatccgcatttgtaaattcatttttttcttctaatttttcagaaatcattaatttgtattcagtaaatgttggaataattgaatcttcagatgtatcatcaagctctgaaaagattttaatgatctctgcaaaagatggacgtttttctggtgctgtatccaaacattgaattatcagaggacgtatttcatcttgtaaagatgatggaataaatggttttgtattattcacaatagctttatataaatcttcattttttagtccgttaggagagaaaacgtcataatttgaggtataaagttgtaacattaagataccaaatgaatatacatcagacttttgagtaaatgccttctgattaagtacttctggtgccatataaataatcgtattggtgttatcattttgaaaatcaataggatagattttatagaacataaaatctgaaataattggcctgaagtcctcagtaataaatatgttaaacgaagttaatcttccatgaataatattattttgatgcaaggaattcataaaagaagcaatatccttcagtatcatgaaattaggagaccatgtttcttgaacatctgcatcctgtaaagttctcaagaaaatatataaggatctattctcataatatggtaaaatgaatccacctggatttaatgcatttggctctataaaatgaagaacctctatcttattctcgtgattgaattcgagatattttttatgaatttctttgaataatccttgtggaatctttttaataatatagatatcattatttttttggtctttgcgctttgcctttattgcatgtccactgcctagaatacttatttcttcgaaatcatctagacaggtcgatttttcgaacatcaagaaaaaatgaaaaagtatggtatttttggcaaaaattaatttcttacaatttatttctatcgaattgagttggggaatctgaccagatatgcattgaaaacacaaataaaaacaagcagcccaaattgagtattgacaaaataaaattcattgaaaataatttggcaaatgaattgaactaaattgtcttctaatgaatttgactcttctgcatctatttgcctcaaatcttatatcaaactctccattaatatcgcggtctaacaatgttttaagaaacaaagaatacattttaaattgcaaattttcaaaattgtttaattcagcaattttttcacattccaattcaaaaattactgttaaaaattcagagtttaagtcaattatatcgtcagcaatccatgtttcaggtaacttgcaagttggtcatcggcaatttaattttgcaaaactcaaaatatcttatacaaaatttgagcgtggaattgctaaatatggaggtgctattgaagctcagcattcatatcttgatatcgatcactctactttttatttcaatactgcaacatattcaggtgctttacatgcatccaattgcatgacagcctcttttgaacataactgtttttatgaaaacaatgctgattattgtggtgccatgtctatagatgttttttcaaatgatacatacaagccctctatagttaattttgagcataataactttactaaaaatcgtgcattgttttggaccggagcccttagaatcaacacggccagtggtaagagttctttttgctattttaattctaataccgcatcatctatcggagcggtttttgacttcactcattcacctcacaaccgcacaacagaatattgttattttcgaaataatacatctgttgatcgtggtggtgctatatgtgcatatcattttatgcatgtttcatcatattctaattgtttatttgagctaaatcggtgtcaaaaaaatggaaattcgattcatattaactcaattgatacacatattgaagttgataaatcaatgtttgatggtaaaaaagagaaagaactaacaatgtcttttgaatattccacatacaaaattacagatacattattcgaacagaaagaaatagatactgctaaacttaagaagaaaatcatccaacaagttaaatgttattaaattttgttttttttaataaaaataaaattatatttcctgtgaaaatataaaaaaaaattatagagaaatgtgaattttttctgaataattaatttttttataatgtgtaattactcactttattcgaaatatttttaatgtttttcgatgtaaattaaaatcatgcgacatattaagcatatcgaaataagtatcagaaatcctcctgaaccaaaaattaaaaatgttaataatacaagagtaaaagaaataaattttgaggcttttttatgtcttaaagccgtattaattgagatgacaccatctttatcaaaaagaggaagaagaaattgtgactttggaatgtgataaactgtacgaaatggtacttcaacatttgttccccgtataaatggtgtgaatggaattcgttcactttttatttttgatattttaaaaaatgtttcatcatccattagtttattttgaatcttattttccaagaaagtaatatcaaactttacctcacctgtttgctggatgtatatttttttattatcatttttaacctttatttctgtggataaagaaaagtttttaacattattagttttatgaaatgatataatttcattcataactttgtgataatctaatcttttacctctttgaataaaactatgctctaataattgatcaattgtccatcttttattttgatcgataatcacacacttagaaacaaaatccataaactcatttgaatggagttttgggaaacgatatcctggaaaaccatgcataacaatattaagcattgctcttgcaggctcatattctacgaaaggtggagagccttcagctaattcaactgctgtaattcctacactccaaatatcagcaggaaaactatattctttagcttgaattacttcaggagccatccaatacaatgagccaactattgttattgtatgttcctcacttgtttcaaatcttcgcgaaaccccaaaatcagcaattttaattgagcctgaacttgttaccaaaatatttgctgctttgatatctcgatgaataatatggtacttattatgaattaattttaatccaagtaataaattatacataataaatgctatttgatcttcactaaaaacttttttccttgaatcaagaatatcccgaagagaacctttatcacaatattccattaatatcattaatgaaccttcataatcaacgcacccataatattttatagcatgagtagaattaatttctttcattaatttaatttcatactcaagatcttgttttgattcactattaattaaactatcaataattatttttcctgcaagtattttcattgaaggcctatgaagaattttaaaaactgttccaaatccgccttttccaattgtttctaaaatggtaaatattgtttttggttctactgatacatcaaatgtccattttaaatcattatcgatatgcaaaagatgtttaacttttaaaggatctgaaatttttccaaattgcttttttaacctaggcatcaatgataaataaaatataaaaaattgaaagaatgagataaatttgaagaatttcattatcgttctgtgttttcattggagctcaaaaatatcctaaatataacataagattttttattaatgacaattaaaaaaggaataatcaaaaaatctaaataacgaaaataatattggaaaattaaaaaacataattatgtcataaatactgcaatcaacactataatatatcttttaattttgaaaatgcaattcataggtggcaaatgaagttttattaagctgatgccatagataaaagattatgtaagtatgtttttcattacggtaaaaaacttaaaattaatttttgtatttctgctttcttattgggaatatcatatatatatatatatatatatttgaaaaaatttgcaccgaagaatcagcaagaatttcttctgcaggaggattttacacatgcttcgtttggggattcttaaacccttatgatatgagtatcatgatgtcaatttacttaagaccatcatgcaaacctcctattcatatattttcaaccatttattttcagttgaaatatgataaacactttaaacatgctgaatatgatgaaccagtagatttagatgtaagctgtttgttattggatttgtggaagctattataatcattttaaaagcttttttatatgatgattacagttgcacatatcctttactatataaaagcaagcttacaaatttaaactataaatattttgaaatgtttacaattcctggagaattgacagtctctgtttgttcatgaattgaatgtcattggcggttagctttggctcttcctttttcaaatgagcatcctcgaaaagaagggtgaagcaacagctctcgaacaacaagttgccacagccatcaccgaaatcaaggcctccgcagaagagggaatcaaaaagtctatgaactccctcaaaatcactggcgccaaagaagctgattctaatggtgttaaggttatcatcattgaagttccatacaagcaaatcaatggctatcaccaaatccaaggtattgtcatcccagaacttgaaaagaaattaggaaacgctcaagttgtcattgttgctaagcgtcgtgcttttccaaagacaccacaaccaggacgccgttacaaggctatccgtaacgctggacgtacacttcgtgctgttcatgaaggtcttcttgatgatgttgtttacccaacagcaattgttgcaaagcgtacacattacggcctcgatggtaaacttacaacatacgttacactcgatgcccatgataagacacgcgttgaagatcgccttaattcatttgctgctgcatatcacaagcttactggattaaagacggtctttgaaattgctactcattaaaaaagacctataaaatattttttaatttaatgtaaatcttttaaaaatttagaaaaaatgagaagttggatatttaaaaaatgtatttaagttattaattatgttgatgtttttatttcattgatcgaaaggtcaggtggccgagtggtctaaggcgctagttttaggcactagtcagaaatggcgcgggttcgaaccccgtcctgaccatttttttccttttttattgatatgtttgccttttttgtttttttctcagatataatgaaataatcttcattaatattactaccatgtatattactcaattgtatccatcaaattctattaaattataatttgaggttaatttatttttcaaatattatgaatttgttttttgcttcatctatataagacacattgatgactgtcatttgatgttatatgttttaatgaaatcgtatcgataagattaatttctataattcaatatttgttaattatttattattaaattttttttcgttttattgatattttttgttgcagcctaggtaaagcattataatgtctaaattcaatttaacatttataatattttcaacatgatgtcattgatactaaaaaggtcaaatctcctctcgaaaatttgataacagaaaaaacgtacagcttcatagaaaagtaaatttttacaatcaatgtaaatcaattttttattcacgcctcacaaaacgaacttttctctattcaaaattgaaagcattctatcgttattgtgaagtcggttataaaacagaaggatggaaatgctctctcacattcaatgctcactcaacacagaagatatcaatgagattatcaaatttcctaaaatgttggaagagtgtgtacttgatattgatattcgagcattccttactcaagtaattccaattattaaaaacttagtaacttctgaatatgaagaagtaaatcaatcaatggtcgagtcaatgccttacatatgtgaagctgtctcaaatattatgaatggaaaaacatatcaagattttatcatcaaaaatattttaccaatctatttattaattgatgactcaaataatgaagaaacggtcgagctagttgcaaattccctaaccactatttttgaaaatttttttcaaaaaaattttaaatttttaccttttttacatcgacttgcaaatgaagaaaaacatgttcttcgagcagctgttgttgaaacacttgaatacattggggaaagtatggaaatagcttctgttttttcaggcattttaccaataatttcaacactttccaaagatccattatcaaaaatcaggggaatgttacccagcatgatagattcttacatcggcaaaataaaagacaaaaatttagcaaaacaattatatgatataattgcaatactttccaaagacaaagttccttatgtaaggctcaaagtgacagaggcgctttatcagttttcgctcaaaatggacgaaaattctcgtatggaagtaattgatccgattgtttcaaaagtaataacagacgatgacgcatctgttcggacattagccatctccagacttgctcctgtgatgagcacattcggtgaaaaggtttcaaagaatttggtttcgaaatattcagaaattttattatccggaaatcagaaagactcttatgcgactgcgttctgcttctccgcagttgcattgtcgatcggaagagagcgatttagggatgaattattaccctcttttcgtcaatctttgcataataatgataagaagatcaaaagaacactttcgtttgcattaattgcccttactcaactcttcgaaccatcggagctacaagaatttgtggaactgattctaaatgacttgccatttgttgcaattggagtcatgtcgaatttgtcagattttttggaaaagattgttgacgtcaataagatacttccttttcttttagaacctttgtctaagtacccagagtggagaatgcgtcttcaagtatcaattcaattacgaaaatgtaaatcatttttccccaatgaaaaacttatagaatcagcttactcactaatcggagacaaaattgcagcagttcgaaatgacgcaacgacttcatttgctgagttaatgacagaaaaagatttacattacataaacgttctcgcaaaaagtgacaaccactgggaccgtttatgcgccgctgaaattatgaaaaaaatgaatccaatgtttattcatcttgtacaagatagtttggatttgttattagcggatcatgtttttagcgttcaaaatactgcaaaaagtataaaaaatggaaatgattaatttccatttatgttattagttgaattgaaaaaatatttaatttcattttcgcatgaaacaatgttttggggttcatgcgttggaatttatatatattcagatatttgttctttttggtaaaaattgctttcttacatcatgtttttattttgttgttgtgcaattatatgttttttcatcttatttcaaatttattggattgaatgatttgattctaaatcgaaatattaatattgtagtttggtatttataaagataaaaaatgtacgtttttacgcacaaaaataagctaaacataacataaaagaatttttcatttcaagttgaaggaattgatattgaacgaccgttaaatgttgacgatgataaaaacggttttgatattgggccgccctaagccttatctgtggatgtcgatccttgtaactggtggcgcaggttatattggaagccatactgttgttgaattgctcaacgcaggaaagcaggtaattattattgacaactttgtcaattctaaaccagacgtattagataaaatcaaattaatcacgaagaaagactttaaattttatcaagtagacctccttaacagagaagacattgataaagttttcgctgaaaaccaaatagatgcagttattcattttgcaggcctcaaagctgttggtgaatcaatgcgtttaccaattctttactaccataataatatcacaggaactttacatcttctccaagtcatgatgaaatacaatgttaaacgtattgtattttcctcctctgccactgtttatacgcttaatgcccatcctccatgcaaggaaactgatccccttgctacaaccaatccatatggcagtactaaacttttcattgaaaacattcttactgatctctataattcagataatgaatggagcgttgttttactccgttacttcaacccaattggtgcccatccgagtggacttattggcgagaatccaaatggaattcccaacaatcttattccatatgttgctcaagttgcaattggcaaattaccatatttgaaaatttatggtaatgactatgacactcctgatggaactggtgtccgagattacattcatgttgttgatcttgccgaaggacatatttgcgcattagattacagcatgaaacataaaggtgttgaagctgtaaaccttggtactggatcaggaagctctgtgttcgacgttgttcacgcattcgaaaaagctagcggagtgaagatcaattaccaaatcgttgggcgaaggccgggcgatgttgccatttactacagcgatacgagtaaagcattgaaattgtttggctggaaggccaaatatgacctgaataaaatgtgcgaagacacttggaacttcattaaaagagtaaaagaagaggaacaataaaaaatttatcacatattattttgtaaagttaatgatttatggttagttacaaattgaattatttaaaaaaaatgttgataaatcttgtggaaaattatattgatgatgaaagtagaagtactgtcataaagaatttaaatcatttccaaatattatttgaaaaataaattttaaataaaacaaataatattcattttattaacatcaatatctttttgttcaagaagtaatttaactattttgatataatatttctcaattacttaaaaagactttgaggaaaaaattgaaatatattaaaaataatattattttcttttggtttttcattaattaattttaagtagtcaagataaatttttacttctttattttgtgcaataaaagagaaaaaaacattttgccatatttggaaataaaatgaaattggattttcggaatcatataaacaaatgtagaaaaaacagataaatcaagattatcttcacataagttccaaatgacatcttggagagcatgtaaatattgaaatatttgattgaatcttgggagcttacttttgttttattattcatgaataataataactattgcattcgaaataagttagtgaccaaataatatcaacaaacagataaaatttcaattcattcactattatgtaaattattgttacaacatttttgtttatttagaaaattttaattttcagaccttaggtattttcttataacttttaaatgcagtgaaagtcttttgtttcttataacaatagtttcgaaattaaaaagacattttttgtacataaatttatattaaatcaaatttcacaaaaaaatttattaacattttattattacaaaacaaaataaaacatttatatttatatttacaatcacggatacaaacaaacataagattagttaattataatctgtcgcatattctgtttcttgttctgagcctgaaatttcttgcggcgcttgaacaacaaatttttccggaacgtccgcaaacacaggcggatcgccgtcaaactgcaagtaataccatccgggcgatgacgttggctgtgtgatcactgtagcggtataaaaaactgatgtccatccaacaatttcatcatgccaaagagacaaaacgcgagcgccaatagggtacattgtagccttagagcgacgcgctggtgatgatgttggtaggggaatgacttttgatgctaatgaatatatttctacaattacattatcttctggatcagcatcatagactaaatattggaacgtttcaggattgaagctctggatgatgccaagaatataatcattgttagagttaagaacacatacaaatgaaccttttgataataactgatcaggttgaagtggtaaggcaccacaaagtggtggataaggagcagaagctaatggctgacgattatttatgaatgctttggtttgttcacgaattgtttcaatatctggtacttcgggttccggtggtgggtgttttcgttctgctattaaatgatcaatttgtataagagcttcttgtatccgatgcttttcggtttcgatgagattattaacattttctgataattgtttgagggatctgtatttttctatgttgtcttgtatctccattattgagctaattttagtggagcattgtttaatatcatatgcacgtttgagaagtgtgtggaacctccatttgtgatcttttgtttggaaatttgtttccctcatctaaaaaagtgccgccgaagcgagggtattcgaccgtttaaatataatttgcaattattaactcaaaaaaaatcaaaaaacgccctatcccattaaaagaagaaaatttataattcttttagtctataattctttgtaatataagtcaataactaagatcttatttatcagtaattactaaatactattcgagaactttcattattatattatataacatctgcgcctgttgcgcaactttttcatcttcactaattatcaatgtttcaaggatattggcgatcgaatccagaccattcaaacttttcatatctttttctttcttttctataatactcaacagcttaaccaatagatccattgttaccaaaattgcgtctccattatcagaatcgaaaatattttcaaatatcgaaaatacatttttttttatcaactcttctactaagccaatatcattcacatctaatacaacagccaaatagttaatcacagcaattctagtttcaaatgatccattaactacaaattgaattgttttatcaacaaaattttcaatttgccttggaaaaaatttcacaaaagaaagaaaatcataaatttttggcaagtcaacactatcatgttcaatatgagacataaaagcctccaaaaggcccatctggaagcaacgcggtatcgcattcgtttccctgtcaaatttgagtaaaagccgcagcaaaccgtcaattaccctattacccatcaaaccgatttcagccaatttggcaattaatgcgtcgtctgggttaacatgaaggccactcccaatcaaagatcgcatagacccaagacctatatcaacagaagaccatgtcatctcgtctgagataaaacatgttgaaatataccataattttatcatatcttcatttcgataaacttttaaatgaatgatggtgtataaacaatgggaagcaacttcacatgagtattcaaaaaaatgatgtgaatctttctcatcttgtgaataacttgaaaaatcaatcacagaaagaaacatatcaagaaaaccaaaattaacaagaactgggaaaacattgggataatcaatgagaatgtctgtaatagcatcaagagagagtcgtgaataaattttgtcattggaacggaaattaaaaatcaatttttgcaaaaattgttcatttgtaaaaaacgatagatctacaccttctagcctgaggagcaagtcaataaccatgagtgagttgaattcttgaactgcattggatgaaaaaaataatgtcatcaaaaattggaaaaattgtaatggtgttgtgattgagttaaaagcatcaagtgaccttaactggaaatgcctagcaaagtattcgcactggttcgtgtcaccatttaaaaaaagagataattttttagaaaattcaattgaatcacattcttcttcttcttcaaagctttcatcgtcacggtgtgattgatctttcatgggagcatacttaaaatttcccacacttcttaattgatttcgaattgaagagaaattctcattttccatatgatgaaatgttatgtgaaatccacaggctaaatgaaattgggaataaaatttggaattttatgctatctagaacatatgaacaaaatacatttcttaccctgatatgatttgcgtggaattacatagatataaatattaagagatttataaataaataaaaacaagaaagattttaattcaaaacaagattatttggtgattttggtagacacatactccgaaatttgagcttcgatttcttttgtcaacgcgcaataaaatatcttataaattaaatagaataaaacgcaaagaaggaaaacgagtaacaatgtcatacatgccatgctcccatatgttccttcaattggagtattgatttctacaagtttttttggttgatcatctgaataatctgaactacactgatcactttgtatatctgaccacactgtgtatgtatatacgatggggtttggtgaaaactggactttcttttgtggttggtttccactgccagaactcatctgaggctgttgtgaaaatttaaatatgaaccagttatttacttaatttgtgaggtactcagaaatttcgcttggacgatataaactttttaaaaggagtcaaatatttgactttttgtggggtatggttcagaaaacaaggaaataaaaatgtacttttagtttcacttttgaaatgtttacaaaaaattttttgtatatcaggaggatcaaaaaactgcagttctaccgatgaatttttctgtcaaaaacgattcactctaattgaacctatctatcgttcggctgttcccttgtggaagagaacggtaaaatgaacacaaaaaagtgtttcattatttaccactggatcatatctgataatgattaacaaactcaaatttattttaatataaaatcatatgtttttgtaaaattaatttaataaacttatatttttcaaatgaatttttttcaaaatattcattttaatatatcaatatttatcattactaaaaagataattatatgattttgttcacaagaaacatagtacattcggaacatggacagtttatgttttattttaaacaacaacaaaaaaaaaaaaaaaaaaaaaaattaatacaaaagatagatagtttatataatcgcaaaattgaattttgagttcattacaccaattcacaagtgtaaacaacatcaactatttcaacctaataaatccaaaacaaatgttaataaaacgccaacaactgcaccacaatttttagcgagaaaaagtatgtcgtttgcaatgcttttcttgtcaacagttaatctttcattttcattaattgcaagatatataatattattttcgaagtatgtatccgaaaaagcaaatggtatgacccaaaatactgtccaataaggatcaaatttaattatgttttgaatcgatataataaacaatggataaaacgatagacggagcaacgataaaaaccgtaacggttttcttctgaaaagaaaatggttggcagtttgattgccacaaaacaaaaatatgcaaaaaagtacagtaataattacatagatccaatttccaatattaggaaacgtagatatcttagttaggtagcctgggaaaagcgaataagtaatggcactattcactaaagtaagaataaagtcaatgagaattaacttaaatgtctctaaaaaactggtagataaaggcgtgccttgaacgaatctgttaaaggtgttaaaaacactttctattttgagtttgacaataaaaagaataattggtatgatataaagacatgaagctataccaaaatatgcagctgaatcaactttgctttcgctttttgttgagccttttgtaaagagtcgaagtccagcagcaaatattccacaacatacatatccactgtaaaagttccttttttcttgttcactgacataattaacaagagcacttgtgcaagatgatatgatagatgaaatcatagcgcaaaaaccaattgatatcattattattgtgaaaaaatattgggaattaaaatcaataagagcaaaaagagaaatacaaagtaatactattgctagaagaacaaggcatactataattgtaatccgaggatttttgatattgaaaaaaggaaagaaaatacataaagtgttataagtcaagcaaaaagccctagaaacataacaccccatgttttgtgcatgagaaatctctttgaaaatatcaatactatttacaaaaatataataagaaaataaagatgagagtcccaaaacaaaaaacaaaaatggttgtgagtcattcccaagttcttcgctaccttctggtttatcttcaattaagttgtctttgatgccatcttctgattcttttgtttccatttgggaatttttgggaattatgtaaaccatttaaataacgagaaagaattctttctaattagcagttttcattcaaaggtttcacgtaaggggtcgtttgaacactttttgttgctgaaatttaggtgttataaaatctggtagaaaaagtcgataatataaacttttcaaaaagttttgtaagcaaatttcatcttgtttgttgtaagtcttatcatatgaatgattttatatttcgaaaaaagattattatataattattttatttaatgatttaataaacatcatcataatacattgcattatatatttaaaattaatataatttaatgaggccattttggagaaaactaaaattatttcaaaaagttccaatgaacgaagtaggatatacaaatgaaattaaatatcagaatattaccagaaaaactcgatattatctcttaaggtttcctaaacggtttccgaaaaaattgagaaaggatctgtaaagtattcaatattcaaccaatgatttttcctgagaaagaaagcgcgtccctggggaaaagcattcaaaaagataaaacagaagttccaaaaaatgaagatttaattcagtgttttcaagggattgttgatccatctcaaactttaaattgttttaatttcatctatcagtactccacacaatttatcttcccaaaggaaatatttccttatttttcgcaactttttttgttctatgatgataatttttgcgctgacccaaacattcgtacatcaattagtcatttgttttatgaaattatggtagattcaaggtctgccaccttatatcttatacaccacaagttttatgaaataatttttcctagttttccaaattttgatactcttcgattagttgaaataatgttagacgacgatattcctccaagcgacctcgatatccgggaaccgatgcctacagacaaagatgagtaccaatccaagtttgaaagtagcgcactcgttcaaggttattcacatgtttgtcactattaccttaagaacggagcagcacagaagcttcaaacccttaacattaagcaaatcctccactgcttgctttcctttggttcctattatatttcttttcaatacttaagaccatttcttgatcaagtttatgaacttatatttactgatcccgacattaagctcaaaagcttatgtatgcgtattttaagcttttatgctaagaaatctaaagctggtttatttttttctttaaacaaaccgaattttccgtcacttttcaatgtaaacaacgatatggaatttgtgaactctttgctctcatttattcatcgtgctctgaagcaattctcatatcttcctcatgaaacctcattattttttatacagtttgttgtatcgttgtttgattgtaatgatgatcatgtttctaatcatgcaatttatgcaatctcaaaaggaacatatggaggagaaatattttcggaattttgtttaactaatttaataacgacaaaattgtttcaaatcgtatacaacacgaatacatttgagaaacaaacgaatgctgtccgtgcaatttgtgatcttttttcggtgtcgagtgaagtcgttgccgaagaaatggctaaaatgggatttttccaagtgttacacgattactttgagcctaccgcaaatatattaatgaaaagtttattaaatgcagtaaacaaagcgttggaaatcgccgacttgaatccaaatttcgaaaattggaaagaaataattttcgctgatgacgaaatattaaataccatcgaaaaatatgcaccagaacgtggacatgtcggagattactcagtgaactcgtatgaggtgttggcttactcaatattgatgcaaagtatgcagttcgggtaaaaaaaataaataaaaagtgaaataattttattaatgaataaaaattttttaaacatttgatttaatatcattattattttttaaatttttgaaccacaacaagcttaaactacaaattgattgttttatccattcattttccattatgatttcattgttagatgacaaaaacttaattttaccgaataaatggtatttgttctttgtttagaatatttatattagaatatcatcactttatgaaagatgctcatttgttaatactgtaaatgtttcattgattgattattgcgcattttttggttcgattaaatattttaaatatttgttattaaataattcgaatattaaaaatttatttttatgcaattgcaggtcaaaacttagaagttattaatttatgtgaacaaaataattcatcatttacagacatatatgaaacagctatagaatttcatcgaaatgaaatttttcattatctttatgaaaataaaatcggaaaattttccaatggtagacaaaagtcattttcaatgttttcttttacaaaatcgaattccaatatcgaaaatcaagataattgtaatttaattgaagaaaatttaatatatctcgggaaaaaaatgtgtagaatttaataattatgaaatcttcatgtttttagaaaaagaaggcatgaaaataactaataaaaatacgaaatacattccaataattataacaaattccaaattcaattttactatatttagataaatcaggaaatatagtgaaattacttttagataaatgaattgatgcttatgcaaaaagtattcattgaataattttttatatgtttcaataatttaccttccacaacatatcaaccacaggtgacatatctatattagaaatatgacgatgcaaatagatgagtaaggacttgatccccaaatctatttaaaggaaatatacaaaatattgcatttttcatgtttcgtacatagtatacgatggcaccaagaataaatatttaatacattttgttggtccaaagggtgaatttcattattagtatatttatcaaaagatatcatagtgtttaaataaattcaccaaaatcttcaaaacattatattaaagaatatataaatcatgatttaaagagaataacgaattgaaattaaatatatttatcagatatctttttttatataaatataatatttttttcgttgttttttatatccgattaacatattaaatgtattttaatttactaacactaaaatgtcattgcatatagttgaaaccatcaaacaccagtatcggcaatggatgtgcaaagaaattttcgagattttgttcccaaattcatcgagttatgagattcctcatcaggaattatcgttgcatacagagatgcttttctttatcggaaatattcttttgtacgtcatttttccaagtcggcaatgaaacatattttcgtcgtttctcccgatctggacgaaatgtttcgacttacgcctgaagtatcctgtgagagctaatgcgcatggaagattgtttgttcacttctgattgaaggcataatcaaatttttatccatttggaaaggagaaacctcaacggagtggcttgggaattatgatatcattatataattcatcttataatccatcccactgggatatatgataaattatatgatgactttctttgttacaagtaaatgtatggatgtaatagataaacgaaacccgtagctaggggtgtatttttaaaaaaattaaattcaggtttacaaaagatcttgtttaatatttaacatacaaaactgacctttatagcatcttgtatcatctgaattaacttttgaaaatattataatactaaaagaactttttggaataaaatttatttgcatttcatttaatattgaataaataccataggaatgtattagataattcaaacatatttgactttccatattcatataattttcaattttctaggttattatattcaatatttgcatcagagataaccaacataaatgtatatatcattataaatttatttggtgagtgatttttaatataactaccaacgacttaataaaccgtttatgtatcagacttgtcctgtgaaatttgacaaaaatcaaccgttagaaacccgccaaaaatcaaatactttacaaataacagtcaaaaaatggaagaaaccaaaacaatttacctcccagagaacatcaaagaaattatatctcgccgtagtacaagagacccacaaactaggtttccagcaaaattatatgcacttctttcatacgtttcaggaaatccagaattagaagaagaaataggaattgcatgggttgataatgagatttttcagatatgtaaagcaaagctattaaaagtcatgcaaattaaattaaatacattaaatgtcaatttgaaaattggaaagttcaaacaattacattgtgaaaagcatgggtggactcgatggcgccgtgatggctttaccaaacgtgaatgtttaatgagcaactcatatcaaaacttcaatgaatctggggaaatggacatatcagactggaagcaatatcataaggatagcactattcaaagtgaacccaaagaattccatcttggtaaaatgacaccagatcaaatagatatggtttcacaacaagcccttaaagaatggattgaaatcattgaaagtgatacattttcatatcaagcctcgaccacatattttgttcctcaagcagctaagagatattgtgctccgcgacaatcatatcaaaattcctttgaagtgcttatggcaatttttgcaccacaagaaacgagttttatacgctttgatgatttctatcgcatatatgcattttttggacctgccgatacattgatgcttaaaattgcatctcttttagaatgcgcaacaacaggaacacattggctatattttggccaacttccaactaataatgtcactgtatatggacatattgacgaagttgagtcaaattgtttggtaattcatgaagcgaatggtaatgtcactaaagtttggaatgatccatttaaggactcaaacagtgattacctaattgatcaaaatgataatagatatagttcatgggaacagtactttcgagttcacccaataaatgagacaaatgtgtatactaataatgagatagaagagtttcattaaattgtttgcactccaaaaattatttaaaacttttaccaaagaacaatcttatttttttctagattaatgatgatatttttaaatccattgttacttagtaaacatcatttattatattatgaccagaaaaatgcaaaatatttaaagaaataaataacattttacttgcggttcagaaaggtttctgtgtgtgttggcactttttcgtaagaaacatgaatttttgcacgttgccagaacaaccatccattgaaaaagtgatgccccggccactatcccaattcaaaaatttgaatagcttacctcacttctcagaatgtctgtttcaggcgcgctgaaggaacgttgcaagtacacaccatacctctccaaggtttgtgacgcaaaagatacaattcctttattcaagaatggaatgtacgttggctggtcaggctttacaccagtaggtgatccaaaagcagttccaattgctcttgccgattatgttgaacaaaacaagctccaaggaaagctcagattcaatttgttcattggtgcttcttctggtaaaaagaatgaagatcgttgggctcaacttgatatgattgcttctcgtcacccatatcaaacatccgaaactcttcgtaaatcactcaacagtggcaaagctaagtttgaagataagcatctttctcaattcccacaagatcttacatggggattctacacaaaagatcgtcatggcggcattgatattgctatcatcgaagcctccgaaatccttgatgatggttcgattgttctttcaggtgctgttggttcagctgttgaaatgtgctattgcgcagataagattatcattgaacttaacacagctattccatcattcaagggatgccacgatattgttgaaccatgggttccacctggcaaaccattaaacatcagatctccatcagatcgtatcggatcattatcaatcaaagttgatccaagaaaagttgctgccgttgttgaatccagactcatcttcccaggacgtgctgttaaaggcgccgataaggattctcgtgctattgcatcttatattgttgatttccttcaaaacgaagttaagcaaggccgtatgccagagaacctttacccactccaatcaggtgttggtaacatagctaatgctgttgttgatggacttaatgattcaccatttggaaatcttacagtttacacagaagttcttcaagaagctatgctcccaatgtttgattctggaaagcttaaattctcttcatcaacatccatgactctttccaagtgggacaaattctatgataactttgatttctataagaacaagattatccttcgtccacaacaaatttctaactcaccagaagtcatccgtcgtcttggtgtcatagcaatgaacacaccagttgaagtcgacatgtatggccacgccaactcaacgcatgctgggggcacccgaattgttaacggtctcggcggttcaggtgactttgagcgtaatggttacctctcaattatgcactgtccttctgcacgtaagacaaaggcatcaccaacaggtatttcttgcattgttcctatgtgttcacatattgaccatacagaacatgatcttgatgtcatcgttactgaacaaggtcttgctgatatgagaggattatgcccagtagatcgcgcaagacttgttattgagaaatgtgctcacccagattatagagatcaacttactgactacttgaatatggctatcaaagaaacacaatcgaagggccgtggacatgagccacagatcttaagtagagttttcaagatgcatacaaaccttcttgaaaaacaaacaatgcacctcgacagttggtaaacatcgaaaataacataataattttgtttttttctttaaagataaaacatgtgaaatgagaaaaactttaaaattgggttccaaacaaagaaacaatttggcaaatagggaaaacttctgatgaaatggataatgagaacaagtcagaaatttattgttattaacgttaataataatacataagtttcgtaaaggtttgattttggtttctctaatatctctccctagcttgccttcgcaagagtacatgatacatcagatttacctggtgggagggcactcaacacaaatctaattacctatcaccacagcagttacaacgcctgaattctaagggtagcgtacactttacagactgggattacaccaatccacccattatttctttctatgtttgagtttgtgattacatattaatttatattaatttaattaaaaagatctttttaaatttacagagatcatgttaaaaataacacaacaacaccaatacttttgcgtttgctggtcggatcaagtattatcattgtgaatgatattaaaattcttattgaaaattttcaattaatttacttaaatttgattaataatatgttatcaggtgcttcttcttttgatttaaaatcgctgcataataaaaaacattatctaaatttttttgaagattttttcaaaacgaaaatatttgtcactttttgtattagatggagaataaaccagaacaaagatctctactctttgacccagaaagcccaactatcaagagggaaatacttgcaatgatagttcaatttcttgaagaaaatgattttcaatcttcagcctcaatccttcgaaccgaagcaagttttagtacaaactcagatcttgacaaaaagattgattttgatcttcttaagtcatctcttttatcccaagattgggccaaaattgatcaaatgatcaatgaaaaatcattttctggaagacttgtttattctctttatagacatcgtttcattgaaatactattatctggcgacacacattcggctcttctctttctttcgtctagactccgtccatttcgggcatttgaagatcaaccaggcgatttcgaccaacttaccacaatactcattgaatcagcatctccaacttgttccaatccaccaccagagctggaagcttcactacagcgcacattatccacaatcgattcacaacaatcaataatctcaacaccatcgtcaatgaatggaaaacttccagaagaacgtcttatccatcttattcaacaggcagcagcaagccaacttatgagttatcctcttggaagaattcgatcaattgttaatgatttcgaaccagctttacttccttcttactcaaacaaagcactcgaaaatggccacactggtaacataaaagctatatgcttcataccaggaacagaaaaccttctttcgggtggaagcaatggtcgtattgtattatgggatgtaactcatcaaagtcaaatagggcaattcataggccataaaggacgtgtttggacaattgctacatgtccacaatatgctgttagtggaagtgctgatggaacgataaaaatttgggatacaaaaaccatgagtattgcttctgcacttggtgtcgaaggtaatgatatttatgccgtagatattgacaaccttggaagcaaagtaattagtggaggttttgatagatcaattaacttatgggatgtgaaaacgggctcaatcattagtacaataaagggacacaaaggtcctgttacatccttatgcttggattcatctggaaatctcgcaattagtggcgggaaagaccttgcgatccacctctgggatttgagggactctatttcggttagaacgatagcgccggttttgggtgaagtttcttccgtcactgccgatagggagtttacacgtcttttagccgctaccaaaaatagcacaaatagaatctgggatttaaggtcttccgacacagcaattctccttaaagggcataaaaacacatcaaagcacttcgttagagcaagatttggtagcgaaggaagaactgttgttggcggatcagaagatggaaaaatttatacatgggatgcagacactggaatattagtggagaagttagatgcacataaaggtggcgctttggatattatttattcaaagaaactacaaatgttcgcttcatgcggagaagatagcgtaattagattatgggaagaaaaacaaatggcttaaatgaaaacactttcgttgattagtgactagtcatgactattaatgatttttattgaataaatgcttttttataataaatttttaaatttttttgttttttgtgttttatctgatttacaaatttccctatttgaaatacggtatatcttttggaaacatgtttctggtaaaggaacgatcaaaataactttttcaatacgtactgaaaaacggtcgccggtacgatagagcgaaaattttaaattaaatagtttactcataaattgagtgataactgagaatttctatacacaacaaaaacttagataatttttctaaaatgaatcaaaagcaaacgtaggaggagcggccttccatgtgtgaaaataacagaagggtttgacagaaaaggtctccagcctgaaatgcacataaggtactaagctccaggatggaataaattcgcacctcccaaaaaactattgatatgacgacggactatgcctttcaatatgttattttacaaccattcaatccgttccttgacccatgctggctggattcgcacccccacattttattataatttggattatcaataaagtatacaatatcggaaacattttcaattgattatgatcataataacagttattaataatttaaccattttataaagcaatcaatactttcaagcttttttcaatttttcaatattacacaaaaagtcgtggatatatgatataacgagatttgttcagccaatttagaaaattttctcgtttttttaactttttgaatatcgtaaaaaataaagtataagataaaaaaggcaattgcctactcaatatattcacatcttaaaatgagacaatgtttcaatttatatacttcgagacaacatattacatgaattcttaatttaaatgatgatatatttttttatatatattaatattgaatgacgatacatgtaaagaataaacatcagaaaaaataaccgaaattttctaggaaaaactgggagccgctccgatagatgaaattgaatgataattttcgaggagaaattacggttagagtgtcaccctctgtttcgttctcatatattataataatattcaaaaaacaaaattcggcggttttttaaacggctttgtcgccctttctatttttctaaaatgaatcaaaatcaagcagcaacaacaaatcagaaatctcaaaaggagtgggaagcatttacagcgctcaaaagcataatctttggtttgaatatagataattttgctcaatcatcaaattttattatcagcaagttttgtaaagaatatccattatcttatgatatcattatattccgaatgatatatatatatatatatatatatcttctgattgatagtaataattttgatatatatttgagattattacaagaaattgaaaaatatgaagaaaataataaaatcaacacaaaaataataaatttattttctcaatttctacttaaagaaaacacacaagaatcattttatttacttaattacatgattaagcataatttacttgaatcaaaattcatcaaaaatacatttaatccattttttgttcatattaatcaagataaatcaaatgaatataaatatttatttgatcaagaaaatattgcttatgaagaactttcacaaaatgactttgcacttcataagcaattaattgaagaaggagttaatccaaaagaaattgcaaaaataattcgaaatgatgaaatagaaaaacttcaagatatatcatctcaaacaaattttgattttaatcaaacaattgaaccatcactttatgaaagatgttcatttattaatcataaaaatgttacattaattgattatgcagcatttttttcttcagttaaatgttttaaatatttacttatgaataatgcaagtgtagaaaacacaggtaaatatgcaattgcaggtggaaatgaagaaattattcatttatgtgaacaaaatcattcatcatttgaaggtgcatatgaaacagcaattaagtttcatcgaaatgatatctttaaatatctttatgaaaataaaattgaagatattaacaaattaaaagaattaggagaaaaatgtgtttcatattttaattatgaaatttttacatatttagaaaaagaaggaaagaaaattaataaaaatatcattaatgaagcagcaaaaattggaaatatttttcttgtaaaatatttccataaaaataatcaacttccaggaaatattttagtttttgcttcattttcaggaaatattgaacttgtcacatacattttaaagcaaaaaggaattgatattaatgctaaagatatttattttaaaaaattttaatttcaaaataatatttggaaattatttaaattatttcaaacagcacttctgattgcatcttcagaaggtcatacagaaatagttcaattacttctagaacaagaaggaattgatgttaatactaaaggtgtttatttgttttatttataatttatttttataatttaatatttcaaaataatatttggaaattatttaaattatttgaaacagcacttatatatgcatctcgaaatagtcacaaagaaatagttgaattattaaattctcaaatctaaaatggtgaaattaaattaataaaattgaataaaataagtgccgtttggtatcatccaaaatgaaattaataaaattgaataaaaaaaatttaatttcataaatgtcataacgtatatctaaaaatgaaagaattttattatctccaaattataaatatgtgaactttgtttgtatgaataaaatcaaatatatattttctataattaatatataaattcagcaaaaaattgtctatgaatacagatgaaatagaatataatgaaaattttgttgaattctaatatgatcaaaaaatattaaaatcagatgtatgaattgtttaataagtatttttctttcgaatttattatatattatatatgaaatatatagcatatgtgatatcacattatcaaaaaatgtatcttatatgagaaaaaaattaagattaacaatttcgttgtcaaataaatagtaatttttataaaagatgaatataaaatagttattcatcaaataaatgtatatatatcagtatatatattaataaattgaaagattaactatatgtaattataatatataatattatcactttggttttagttaaattagatagcgaataaaagatatatataaataagttgataattatcacataagcaaatatcaacaactactttttaatcagatttcattttaatttataaaataggagtgtgaacaatatcaaataataaataaatagtagtgtaaattatatttttatcagtgaataaaataaattaaatgaattttttattagcttctggtatgatttatgctaatatcaggattatatatattatattattactattatatatattattactattatatatattattactattatatatattattactattatatatattattactcttatatatattattactgctgaacaatgtggctccactgttatttcaagaagcaacacgtttattcgcgaccatggtatgcgacttcattatactttatcttttagcaaatcgtagacttcgggatagcgtttgacatcatgtagccaattgctaagagttgttatcaatttactcaaaaacaaatcggtttgaatcgtcgttatcaaattgctttcttaagaaattgcttcgtctgttttggattcttcccattttaacatgctttcatagtaatcaagcttgatattgtgtttgaaattttctttaattttcgattgaagataatttattgtcaaagaagcaattgaaaaatcttatatatttctgatcagtttttgcaatatatgtatttaattatgcattgtttcttgcactcataaataaatcgataatcagattaaaaatcattgatatctctttagtaatcacctgaaataacaggaaataatttgttgatattctctttttgaatgactgatgctattttattcgatttatcataatcattattaaatatattccttttagaagaaatgcttctttaccatttatcttagaaaaaacgtttttaaatcgtctgtaatccattaatttccatgaggaagatgctccgtaaattgttcccgaattcattatgattttgtttaatttattgaatttaagtaattcttgtaaacaatgaagcttatgatgattcatttttggatcatttgtctatttttgcaacttcttcccaaagtcccaatttttcgcttaaaacgtccttttggcgtatcaaatcccaatttttctgctttcctcagaacactgcctgtaacaagtttaaatcccaatttttggttaatctgtagtattcgattgctggaattttgctctcaaatccaattgtcctctttcatagaacggggtgccccaaaacgttacatggtttgtttcattttttttatagctatgatttcgctaaagcacatgcctattgatgataatactataaacacaggagataaaaatttgaataattttccaacctgcttgaaattcctaattgagattgagaaaactatatttgatttaaccgaagaaaactttcagccgtccattaaaaaaatattggaattattcgattcaaattatccctacacatttaaaactattataagtaacatcgtttataatacattttcatcaaaaaagcaagtatttgatatttacttaaattttttaaagacacttcaaactaaagaagaagaaattaatcaaaacacagttaaattaatagcaatttttaccaaacgtatatctgcagcaaacacacaagaaacatattatttaatagagcaaatgattgaacaaaatttaattgataaaaatataactaaaaacattaaatcaaaatattttgctcattataaaccaaaagaagaaaacctaatctacctgcgacttgagcttaatgtatatggtcaaatagaagaatactttttggaaaattatgaagaactttcgaagaatgattgggagcttcataagaaatatattaaagaaggagttaatccaaatgaaattgcgaaaataattcgaaatgatgaaatagaaaaacttcaagaaatatcatcacaaacaaattttgattttaatcaaataattgaaccatcactttatgaaagatgttcatttgttaatcaaaagaatgttacattaattgattatgcagcattctttggatcaattaaatgttttaaatatttacttatgaatggtgctaaagtaaataaaacaggtaaatatgcaattgcaggtggaaatgaagaaatcattcatttatgtgaacaaaatcattcaacatttgaaggtgcatatgaagaagcaattgaatttcatcaaaatgatatctttaaatatatttatgaaaacaaattagaaaaaacacaatcaataccaaaaatgtctaaagataaaacaaatgatttgataagtttttgtattaaaaaagataactatgaaattttagaatttttagaagaaaacggaattaatgttaatgctgataatataaacgaatcagcaagaaatggaaatttatttctcttgaaatatttccttcaaaataatcaaattccaaaagatattttattatttgcttcagaatcaggaaatattgaacttgtaaaatatgttttagaacaaaaaggaattgatgttaatgcaaaaactattcatttgaataatttgtaatatgttttaataatttgaaacagcacttcatatagcagttagaaataataatatagaaatagtaaaattacttttagataaaaaaggaattgatgttaatgcaaaaactattcatttgaataacttgtaatatgttttaataatttgatatatgttttaataatttgaaacagcacttcatatagcagttagaaataataatatagaaatagtaaaattacttttagataaaggaattgatgttaatgcaaaaactattcatttgaataatttgatatatgttttaataatttggaatatgttttaataatttgaaacagcacttcatatagcagttagaaataataatatagaaatagtaaaattacttttagataaaggaattgatgttaatgcaaaaactatgcatttgaataacttgtaatatgttttaataatttgatatatgttttaataatttgatatatgtttaaataatttgatatatgtttaaataatttgaaacagcacttcaaattgcacaacaattaggttacacagaaatagtaaatttactccttgaaaaaattacaaacgaaaattctaattcagattcctcttctacaaatatcaaatcttcattttcaacaagaaatagaaatgaagcgtatattgctaataatcaaaatcaactcaaagatcgaatgtatgcagaaaaaaatcgaaataatagtatcaaaacaaaagttgatataaacacacaaacatatgaaaatcatcaaaattgcaatatacaacataacaaatatccccacaaagcaaaacgtaaatacataaacacaataatattataaagtgcattataagaaaaacttcaacaaataatttttggaaaaaatattacaaagataatgcataaatatttcataataatcgctttgggttcaactgaatcgaaattttgatatctgcaaatgttcttaaggtatttcttccgtatttaataataagttcactggttgcatcatcgtttagaaaatgaaacagtttaatttccatattacaaaagttacacataaacaaatgactttttgaaattgacatgcttggaagcacattatataaatatacaattagaatttaccaaagtaaatataaatttttttgataatgatttaatatatttaaaatattttttgaatagctacttttgtgagattatattctcttagaaattattttattagatcacagaaaaaataaaaccaagtaatgaattttaaaatatatttttttgagaaatcaaaacaccatatgaaatgttttgaaaatgtttgaagataatgaacaaaatatatctttaatttgtatatcataaaaaatttttttggggtaaaatgaatggtgctcccggatttgaaaggaattgaacgttggaagttgtttgcatattccttatgtggaagctctcaaattttggaaattaattcatgaaatgaacatgatatattttttaaaattatatacttgtatccaaaatttatctaatttaaaagatttttgtcaagacagatttttgaaattttgcttatatcaaaagtaatcacaatgattccatatttcaaaaacagcccatagattcctcttgatcataaattattttattctttgatgattttaagcgagtgtgaacttaaaaatttgacatataatatcaaaatattttgtattataatattttgtttttttgataaattcttctatacttttatttaaaaatattcaattgttttataaattatatatccatttttggcaatcattcaatccaagtattcatattaattatatttattcacatcaattcgagggtagctacccccacgaaattttcgttcttaagcccataacaaactatgtcaaattaataattgtttttttatcttcttaaatggccatatatggccatttgtgaatacattaacgtacaccatacgttaagatcatttgtttgtttagtcagatggaaaactgttccccaaatgaactaattgaagagtttgataaagaagttattaaaagatgcaatactattagaatgaattcagaaaatacagcaagcaacatgaaaaatgcatttgaattaatattatcatctatacccgaaagcatacgcaagatgccaattaaggttctcgttaaaaaatatgatggagatatacaaaaggccattactcatttaagtcacacatcatcaactccacacaaatctcgaaatccccgcactccaaagagtgtaaaattcaccaaaagtattcatgcaactccggcaactccatttcttgctcagattcttaaacaaaaggctgaacaagaaaatcgattactcgctaataaatcacaaaagcgcactcacttacaaacacccactcgtgcccgtcctacgacaaagaatattacaagtacaccaaaatctcgaacatttacaccaacaaaaacgaaaagacctcaaaaacaagttcgttaatacaccgaaaaaaaattgtttaaatcaataaatttaactaataatttcgatataattttgttttccgcctctaaatatctttttatatgaaccattccaaatcacatatgcacacaacgaacctaaaaagaaaccagcagtcgcatcatctgtgtgattcctatacgaacggatagacattgacccgattattaaccctgcaaaataaggaagaagagagagacattggaaccatgttgagcttgattttgtgaatttttgcatgaaaagcgtgaagaaaagagatgatgaagaaacaagagtggctgttgtggatggaaatgaaaggaattcattgttagtatcatatttgctgagttgttggcatggatttgttgtatttgtaccgcaccgagaaaagatatcgggacgagctcgtccaacaaaaagggaaacagatatgcaaacaacgcatgacatcatcaccgaacatgcatggatccatatagcagagaataaatgaaattcattggtgacggaacaaatctttttttgaatgaagtaaagaattacaaaaagaatccacatgagtaaaaacgaaaacaaaagaggtaatataaattcgaataagggaatatctttatacgggaaattggaaagagaatcattttctgggataaataatctgtgggaattaataaatgaaaatccaacataaaaagaacagagaaccactgcagtgataaattctttgattgcaaatctctcggaaaaacttgattttggagggtccaacttattttggattcagggtgccctaaaacgtatcgtttaaacgtcttcatttcaaagagttttcactcaaaaaataggaaatttcctttcgaaagcaaaaaaacacctaacacattaaacaaaattaacaaggacactaaaaacttgatttactttgaattttacaaaatttattgattgaacaatttggtagaaaatcattattttaatctaaatcatctctctcaaaataaataaataaataaataaataaaacacaaatatgtatgctgttggactcaagaaagcattgaacatttcttttaccctttagcaaaccatattttcaatccagaaaaaatgggatatgaaaataatgagtttatgccaaaagtatggatagttcactctttggaagttggaccatatgtacgaagctcatatgtatcctttgctgttgagataacccgataacgttcgtggaatccttgcttctgaaggaacttacgagcatagtaacgaacagcacgctttgaatactcgacgttgcatgtgataacaatactactttcctttgcgtcggcttcaattgttaccttgtttttaagattgttgacaagcttgtgaaccttcatcttcttttgaagatattcaacaaagtcttgaagtgagaaaactttatcagatattggtgaagcagaatcaatcttataaacagcaaacattaaagtgacttgaaaagtgacttttggcccagccacgacgatagaaagccgctactattgagtcggatttgatcatccacttttctgttgaacttttgaaagcactttttgaatcgaaattacatacgttattaaatggctcaaacagatttatctattatttctgaaagtattaaaaatttatatcaaattggattttctgtttatgtacattgttctaaagttcattctcttattcaagcatttaaatcagcagatcaaattttatccaatatcaagttaagccataaaataaaactagctactattttttcaaacataatttctaccattgaacaattcaagcaaatttgtattaattgtggtagaaatatttttcttaattttgttttaacaactccattaagacaagtatatacagaaattttatcaataagaaatgccttaaaaagcaacttcaataaccttggactcaaaaatgttagtgagttatttgaaatatcagaacatgatttacaaatgcaaaatattgttgatatcaaacgaattttccatattattgttcaacttcgaaaacaaaaagttgttttatcacgacaagatgttcttcaaaaaatggcatcacgattaaaatcaattaattcctataacatccaaattggcgaagaagattgtgaatttgttgcaattccaccacttcccatacgtattgatttcatattaaatttttctgatcttgaaatcatttctgagattggtagtggtatctcaggtaaagtatacaaaggaaggcataaaccaacgaatcgttttgtagccattaaagttcttcacaaccaagatcaacaaacgctaacatttcgtagggaaatttcaatactttcttcgttaaacaatccatttatcgtagaattcataggttatactaacaagtcaccattttgtattgtaactgaattactttcaagttcgttacgtgcgaaacttaactctcctacatttttatcatcatctgagaaaaccatcatagccattgatattgcatttggacttttatatttacatgaacgtaatataattcatcgtgatcttaaaagtccgaatgtaattcttactaatgataatagagcgaagatttgtgattttggactttcacgacttcgttctaataaaccattaactggtaacattggtaccacttcatggatggcacctgaagtattaatatcatcacctatatatgacacaaaagttgatatttatagttatgggattttattatgggaattattaacatgtgaaattccttataaaggaattccaagtgaaaaacttccgactttaatagtgaatgaaaatttaaggccaaaaataccaaaaaatactcctccgaaattaacatttttaattaattcatgtttaaaatcaaatcctaaagagcgtcccacgataaatgaagttatacaattattatcttctcctcaaacacattttcctggatctgattcacaatatgtattacgtacaacgaatttaatacgtaaacattcacgttcaatatcagacccttataaaatgattaaaacaattgataccaaatttaagcctaaagtaaatttaaattctttagttacacaaccaaattcttctacattaaataaaataattgatgattatcgacgaatattaaaatcggggaaaattacaattgtaatgatacaaaatttaattaatgcaattaatatttcacatatatcaaataagccaatgttaatacagttattatcggaaactttaatattatttccaaaaatgataacttgtttaaatcaatttaatggaattgaaattataattaaacttttaaatgaacctgatattgaaaccattgaatcgacattaatattacttcaaactaatatatgtaatgaaataattaacattgatttaattaaagaattattgttatttaattcaaatgaaaattataatattcggaataaagcaattcaaattctatttaaaataatcgattttaaatttgattttcttttaggttttccttcgtttttaagtcgttttataatattttctttaaaacctttaacgaaaacaaatttattaaatttacttaaatatactttgttatttatacaaaaaacttcttcaatagcaaatgaaacaatttcttgtttaatttatttattggtaatgtttcaaaacaaaagacaaatattaaatatactgaaatatgttttaagatttgataattttaataatttgatttcacgtgatgtatgggaatcagcttcattaagttttgatcaagattcaatattttttacacattacattgatataataccaacacaatataaagaaatgatttctgttttattttcgacatgttccaaagacaaaaacgcaattttagtgctaataaaaatggctaaaaaaaatgaatatggaatatgtataagtgatttattacctatacatttaaaaaaccaaaattcattagtgttaaagttatatgaaaatttaatcgaaattcctttttgtcatgaaaaaatttcatatcaaactgagttctttttaatatgtaaagattttttgcatacgaaaaaccaacaaaaaatttgtaatttaattcgtgaaattccagttcatcaagaaattgttgaaaatagtggaatacattcacgaatcgttgagttaatattagaaacaaattcacatgaatcgttatggaatttgatttctgttgttttccatttttgtgacggcggaaagtttacttcgtttagattaatatgtccaaaactttccgaattgttaagttcgacaaacgataaaattcgtcttgcgtcttttttatgtttaactaatttaatcgataagaattcatttggaataaattatactttgtttttaatgactgcagtggaattcgcaaattcaccaattaatagtatacaaaagagttccgttctttcttttaaaaatttcgagttccaaatgaaatcaaatgtttctgatgtgttgcaacattttttgtctaattttaagatgaaaaataaggcaacaatggaaatagcaaatatgttcctaaagaatccaaaatgtgatacatttagcaatgaacaaataaatatgctacaaaaaatcgcacaataatatatattgttattaataaaatataaaatttattaaaaattctttttaactttatatacaattttgaagaataaataaagtaattatttttacttttagtaattttttttgaatatatattctacataattcttcaacaaggttaaataccaaattattgaatgtactaatagaatatattgaacttaaaattgtgaagtgtgtttgattttatcgtcgtctgaattcccctttgttcgaacaaaacaattttggatgaatggcaattctgttccagaattaaatatcgatttcctctacaaaaaagataaatcgattgacatcaatactaaaattaaaatggcaattgcacttcttcaaaataatcaaatatcaccagaaacccttttaaattggttacttacaacattttcaactgatgttaatttccaaacttcagaagctccatggaatcttcttaatattcttcttcataatgataaactcaaaaatgttcgtttttctttttcaatcaaaacttcttcactcgcacaaatatacaaagcaccttatcatgaagtatgtttttctactctccaatatttaattcaaaattatccaaatttatggcgtccatcatatcaaagcttagttccaccaatttccgaatgtttagaatcaggaattcatccaaatgaaatttctttacttttacaaattttaattaatcatcatgatgtaattgctgcttctgattcaatctttaatctaacagttgaaaagctaatgaagccattacttaaaaatctcgaacaacttgacaaacctaaagtatttacttttcttacatcaactctttgtattccattttttgtcagaaaagccaccaatgacacaaacaacaaagttacaagttcactcataaccatattcaatgagtttccaaatgctagtatacaatttgcaggaccatttatcaaagcattttatcaacaagtttttcttcttaatgtacaaaaaaaccttgaatttccgatggccatcatcaagaatagtcgaacgcttgacattgctgtccctattcttcgagaaactcgattgatgaacatatatacaattgaagttgaatccaaagattttgatttattaatgtcacttggcgaacgtagtgtccaagaaaagcattcagggacattatatgagctcgggcaacttgattttagaataattcataccttattaaaacatattataccattttcagatatacttacggaagaacttcttttgcttatactagacaatgtttttaagcttcgtaatccactaattttatttgaaggtggtgaacttcctctttatatattacaaaatgacaaattcattggtcaatattgtcaaaatgtctcatatttagtctcaaaccaattaagtttattgcttaaatatttaatatccaaaccagataacattgatacatcagtcttattatattggaccataaaatccggccggttaacggtcgagcacattgatattttgacatttttggcaaacgattgttgtcaaaatccatggcggtttacggctgcggttattgcctcaaaaagtctacaaattcaattgccacctccaacatcatttgttgttgatgcgcaaacaaaccctgtgattttggattgtttcttatatgagaattatggcctattaacaataccaacgtttgttaataagtatcaaattgtaccaaagataccatcaccagaaatggaagataacgaaacgtttcgattagcatttataatcaccaatttaccatttttagttcaatcttttaacgaatcagatttaatgattattttaaagtttattattcagaaatgtatttatgctcaacatattcaatccccacagaccatatcagattattgtttatgtttattacataacacaatgttttatgagtcatatgaactccgaaatatctttactaaagtcatcaaagaatttttaccaagttatcatttccaaagagttactgaagttacacccaaacaacaaattcggagtgccattatagcatcaatgccacaacaatttctacatcccaaagtatcaatgtcagcatttaatgggatatttaaatccatttgttatcaagaaagcgttggactcataatttgtccagaaatattttcacggttaaacttaatacaatgtttattaaattgttctaataatataccactttcatcaattaatcataacattaatgatattataatgcaatgtccaaaagaagcgatcattgacttattacctattttattacaaaggtatggaaagttcccaacaattgatatcaataatccatatcaattaataatgttatgtaaatattgttatattacgaaacaacaattaccatttgaagaaacatattttcaagatgacattaattcattttgcgcacaacttaaagtaggtcaaaagagtacatttgagatattacaaaacaaaaatatcattgaaatgaacattaatgatataatacaaatcattgattccatcgaaacgtttaatgatttttcggatgaatttattaataatataatacaaatgttatatgaaaatgaaaatgatattgatccaaatatattaacaaatttcgtattaaaaataccaaaacaaaatttaatatatttattacaaaatattaaagtcgaatattattattatatattttcgaagttaaatataacaaaagaagatattaatgatttcactatatatataatacaaatgattaaaaacatttcgactttgggtcaatacaaagaaatttgtacatttccaattagtaaatattataacgaagaaataattcaatacataatattaaacttaataactttcacaaatagaaacacattaaaaatcgatgaaatttgtatcattgcaaatagtattacattaattctgataaattgtcgaagagaaacatataaaaatttgtacataataactgaagtaatacgtaaagtttcttctttgttcattaaaaatgttgtaataaatacaccaaattataaacagttaagaacaatgtcgaaaatgttcatcgaattggcaaaaatgaacgctgataacttccaatacataatatcaagtttcgtgtcaaacttttcgttgtatcaaatcgatgaaaacttcgaccaaatgaaaatgagagtgctccagtcagcaattttcccactcatcgcgaaatgcgcaaaggaacaaatagaagaaatatcaactgcgctccacgactcgcacaggcaaatatttaaggagctgtacaacagatacgtggaagaggcgcagtacaaaggaaaagtataagtaaaaatagaatgaaataagttttggatcaatacggaatttgtgaaataataaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatgtaaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatgtaaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatgtaaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatgtaaatagtaacaaatgttgtgaagtgtaaatgtgaattatataaatagtaacaaatgttgtgaagtgtaaatgtgaattatataaatagtaacaaatgttgtgaagtgtaaatgtgaattatgtaaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatgtaaatagtaacaaatgttgtgaagtgtaaatgtgaattatataaatagtaacaaatgttgtgaagtgtaaatgtgaattatataaatagtaacaaatgttgtgaagtgtaaatgtgaattatgtaaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatgtaaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatataaatagtaacaaatgttgtgaagtgtaaatgtgaattatgtaaatagtaacaaatgttgtgaagtgtaaatgtgaattatataaacattgaaattaaattctagcattcaataatttaaaatgaattttaaaatcttattccatcagtttacttatttcttgcaaaaattccaaacaagttcccttttatttcatatcataaaaatatctctctgaattttgatgtatgtcctgattaataaaaaaatattatataaatgagtatatttcattattttgagaataaatgatgtttatatggtcactgaggtaatatattgcaagcagatttaattggattacttgaaaaatttatattattaatgcttacaatatataaatcatattattttaagggaaaaatttatggaatattatatttgtgcaaattcattttctttaaaatctgctgcaaatggatcttcttccacatgtgacatttgtattcctaccgataatatatttgtgttttcttcttcttcttcatcattacttattgtagattgtttttcttgtgtagtttttagagtttgatttctttttaatagtataataaaaattaaaacaataatgaataaagatataatgcaaactacaatgataataatcgttctactattattgtcagcaattatttgttcatttgaataatatatagaaaaaaaattggaataatattcataatatgtcgggtaaataatgagagtataactataataaataaattcagtataaaaataataatattctgattcaatatttgttatgcaatatgattttatatatgtcgaataatatgataatgtttttgtaaatgtaaataaatatgttaatgtaaatgtatttgtgaatgttaaatttagaccaacatatgtatatgtttgggcaaatgtattgatggtgtaaataaatttgaattagtaaaagtattactttgtgagaatgtatttgattttccaaatgttttagaaaatgtattcgaatatgtaaatgtttgtgttgaccaaggaagacattcagcaattgttgttcctttggaaacatttaaaccgccaaaagtttcatttgaatatgtttcctttgtcatcactgatttagctgcaattccaacaaaagcatttgatgcgatttctggatgtgtttcaccataaaaataaatacatttaagagagaaacatgatgaaaatgcatcagcgccaattttatcaacattttctccaataaaaattgtttcaatataagtacaattttgaaatgaatattgttcaatagaagtaattgaatttggaatatgaaatgtttttgttgaatttccaattggataaagaattagttttgtaatatttttattgtataaaacgccatcattttcataattagaaaaatttaaattttcttccgaaactttaataaattgaagacttctgcaattttcaaatgaacttgataatatagaagaaacagaacttggaatataaatgtttatcaaattgaaacaatctgagaaagcagattttccaattgtttctattccttcttcaaaagttactatttcaagtttatcacatgaaccaaaagcgctttctccaatagaagttaatgatcttgggaatgtgatttgagtcatttggcatccataaaatgctcgggcatctatttctgttaaatttgctccaaattcgactgtttccaatttagaacaattacaaaatgacatcattccaattgtttttactgaatcaccaatttgtacatatgataataaaggccataagtagaaagcaaaatcaccaacttcttcaacgccgttaattacaacgtgttcagtaacatccttataatcacttgtaaattcacttagttgagttatattaagtgttttcgttatattatcaaatgtttgtgatgtattaatgaaaaatatcaacaataaaaatgaaatatttgggttaaccacaaaattttgttcagagaacatttaattttgaaagaaaataaaaaaattataaaggtaagtgaagaaatattaagaaatcgtattccaatatttttgtaatttatattattctttaatgggatattcatgtatatgttttgcatataagtaaatattttttgattcaaaaaatgattaaataattcttttccaaaaattgaacatatatctaaaatagagaaatgaatgtacggaagcattctaatcatgatcattatagactgaagggtgataatgttttgcatttttccaatccctaaagagatttgaaaatttaacaaaattgaaaaaattcaattaattaaaacatatatttttataaaagtttttgcgcaattttacacgggtaatgaatttaaaatattctatgagatctaataaatcaacaattgaatatataatgtaataaaccgtttaatttaatacgttaacttccaaggcatgcagtgcaagcttaagccactggaagctatttgtgttgctggtgctgttgaggattgtcttgaccggcttcgtgtacttcaaagtctcacaccaaatgtaattacacaacgagatgaactttcaaatatcttaggcgatactgtttcccaactaatcgatgaacaaaaaaagaaagaacttcactatgagcaactgatcaagcagagaagtgagcttaaatcacttagtaataaaacacgatataagcagaatcaagaagaaattgaaaaacaagctcgagaacttcaagatctcacacgcgatctttgccgccgtcttagggaatctcccaatgtatcagaaaatcttttaaaaatccaaaatgagagatcagctctcatatcactttttgaagcatttcgtgaagatttacttcagaacaaatcctttcaatggattgctcaatggactaatgatcgtaagagcaagtatgaaaccatgatgcaaataattcaaacagataaacaaatgcagaaacagattgaagacctcagtacctcaatccaaaagactgagcaagacatgaaaacccgaattgagtcgcttgacactcaaatcaaagaacaaaaagaacaattaatacaaatacaatcacataatgatgctgagaaagcccaacgtgatgatgaacgtaatgcccaccttgctgcagttgccaagatgaaccaactttcccaaagtgcattaaccaaacaaatgcgagatgccaaaatgatgcttgaaaatgaacacagagtgcattccgaaacattagcatactttaatcgtcgccgcacgaagatatccgagatgagccaagagtggcagcagaaatacgaaagcgaaacaaagctaaagaaaaccgaattgagagagttaaccgacagaattgagaaggcgacgaaggaatatgaagaactaaagccgaaaaaagaagaagcagaacagcaactaaaacttgagcttgaaagaagtaagcaaagagctaaacagaatgaaatattagcggaacaaaaggcatttatggataaggttaaacttttgtattgcttgagacatagaataagaggaccattaccaaagcctaagccaaagaagaagaagaggaggaggtcaccaccaaagtaaacgaataaatgtttaatttacttaaattatatatatattcatacgaaaaataaaatataatttattaatataaaaagattttgtaattctgtttgtactacgaaatgaaataattctttgaagttcttcataatttggtaatgaactcacaaaatcaaagtctttaatgcatatcttggaagagattggattgtgtttggtccagtttacaaatttcattataataagaataaataataacggtgtaatcataatatataaactctgtttcaatatagatattcgatgaattaattgttgtaaatgataataataataaaccaaaattagcgaaaactatacctggtaaaaattcaggtgaaattgtgaaaatattagattataataaaaaaacaaacaggcggttgagacacttttgaatgcttttgagtacatacgtttataattaattattaaaaaggcaattgcctactcaatatatctacatcttaaaatgagacaatgtttcaatttattatagcttggaattagtgtacatgaaaatggttcgtgtacctatcgttttataaaaatttttcagcgcatatatacatatatatatatatatatatacatataaaaactcattagacatgtgaaatgaaatattgtattaaaaattttatttagatatttcgagaataagtcttgaacttagagtttgtgttcctaaattggtcatataatgtccaacattgcaagtgattttttcttcaaatattgttatcggtttctctttctcaatatttgcgattaaattcatcgaatttgttatgataaatggtatgtaaaattgtttaaatttggagtgttattgccatatattttcccaatatttatcccgcattctaaatttttttgaacaaatgtattaaagtgatttgttgtaatcttcgaaatcgaaatgtctaaacagccagtaagtaatgctgttgactcttgaattatttttcgaatttgattgtcttgcgggcgtgttaaactcattgcgattctgtgtttcgttatatttattattctttgatcatctttatcctcgggaatatcatatttatgtgaacccttaaggtgctctctccatttgttttttctcttgcatacacttcatcgacgaacttcaccatttcataatctaacgaaagctggacatctccacctggctgttttatttatgtaacatatgtcccaatctgcaggtgggttatcatcataattgcgcggatatggtggttgcaaatgtaaaataaatttaaatgttcctgtgtgcggttttctagcgttttgtttgtttttgaaataattttgttttattacgatgaatttttgataataaatttgactactacatctgtttaacctcatggtataatgactttttaaatattttaatactgaaaatttacataataaccggaacaaattgaatagttgtaattcatccaagtcgatcaatctcaacacaaacatctgttctgaaaatacgacaagtattcaatctgtttatagtttttcaggaaggccaaatgacccgcccatgcttggtctgctcgacttagaattatgttgattacacatcaagctccttgtagatgtattcactaactcacaggcgtccaattaatcgaacgatatttatatgatatttagaagttataattcatactagtattttttttcttgtcctatttggtgtaaaatagatcaaagagctttcaattaattttttcgaagattccaatttcgaaatttagaaatattctacacctgaagatagatctattgtttgatgagttattgaaattggctacaggtagaatatataaccctatattgatccttatatcaaaatggttgaaaatagatatctttaaatcacatttaaacaaaacataattgtatcttcaaacgatgtttcgacaattactcgaattatatcatttttctaagatatgtaaaaaattgattgtttttattttttcaaagattttattttgtgacgaactttattttggctaataataagtggtattcacaacaaattatattcaaaacgtcgcagttaaatttgtgaaaatcattttgataacactattattgttatttttttcacatacgatacataatcatgaaaaccgtttattttgattcctcatttcatagagaggcctgaatccgttaaaatcattgaaaatattgtaatcgattttacaacatatatgaaaaagtggtgttgtatttgatacaatttttcaatgccgataatgcacatgtaggaccaggatttcaatagctcatgtgcattatctacccattgaaaattgaaaaaattaaaacagatacaacgattgttttttatggttgtcgtaaaatacattcaaatattttcaatgatattaacggattcaggcctctctatgaaatgaggaatcaaaataaacggtttttatgattatgtatcgtatgtgaaaaaaataacagtattagtaattaaaattgactatgcttgctcgattataagttcattataaagcatttttattagaaagattcacacgatttgcataaaactcctctaaattggtcatgaaatgcaattcttttgcttcttttatttttgcttttttttgctcccatgtacactttcagcaaaagtacggggacactaaatccgagctatacaatttatatccttcaagacaacatattacatgaattcgtaatttaaatgatgatatatttttttatttaagttaatattcaaaaaacaaaatttggcggttttttaaacggctttgttgccctttctgtttttctaaaatgaatcaaaatcaatcagcaacaacaaatcagaaatcccaaaaggagtgggaaacatttacagcgctcaaaagcataatctttggtttgaatatagataattttgctcaatcatcaaattttattatcagcaagttttgtaaagaatatccattatcttatgatatcattatattccgaatgatatatatatatatatatcttctgattgatagtaataattttgatatatatttgagattattacaagaaattgaaaaatatgaagaaaataataaaatcaacacaaaaataataaatttattttctcaatttctacttaaagaaaacacacaagaatcattttatttacttaattacatgattaagcataatttacttgaatcaaaattcatcaaaaatacatttaatccattttttgttcatattaatcaagataaatcaaataaatataaaatatttatttgatcaagaaaatattgcttatgaagaactttcaaagaatgattttgaacttcataagcaattaattgaagaaggagttaatccaagagaaattgcaaaaataattcgaaatgatgaaatagaaaaacttcaagatatatcatcacaaacaaattataattttgatcaaacaattgaaccatcactttatgaaagatgttcatttattaatcataaaaatgttacattaattgattatgcagcattctttggatcaattaaatgttttaaatatttacttatgaataatgcaagtgtagaaaacacaggtaaatatgcaattgcaggtggaaatgaagaaatcattcatttatgtgaacaaaatcattcatcttttgaaggtgtatatgaaacagcaattgaatttcaacgaaatgatatctttaaatatctttatgaaaataaaattgaagatattaacaaattaaaaaaattcggagaaaaatgtgtttcatattttaattatgaaatttttacatatttagaaaaagaaggaatgaaaattaataaaaatatcattaatgaagcagcaaaaattggaaatatttttcttgtaaaatatttccataaaaataatcaacttccagaaaatattttagtttttgcttcattttcaggaaatattgaacttgttacatacattttaaagcaaaaaggaattgatattaatgctaaagatattgatttgttttatttgaaatttattttaataattttttatttcaaaataatatttggaaattatttaaattatttgaaacagcacttatgattgcatctgaaaatggtcatacagaaatagtcaaattacttcttgaacaagagggaattgatattaatgctaaagatatttatttgttttatttgaaatttattttaataattttttatttcaaaataatatttggaaattatttaaattatttcaaacagcacttatgattgcatctgaaaatggtcatatagaaatagtcaaattacttcttgaacaagagggaattgatattgatgctaaaagtatttaatgtttgatttgaatcataaactataactcgaattcgaatgtccttttgattaaatatcgataatgtgcttacttgattaataggaattggattagtcacaaaagcattttgtaaaacgtcatctatttttaatgaatgataaacaattcgaccattatcaatagtgataataccaaaacctttatgtttaagaagatctgatgcaacaacttcaagcattccattcgtatggatgaatgttgtttcacttggatgtgtatgacctgtgataagcattgaacaattattattcgttataatttgttcaagtgttttacctgttgaagatgtacatgtgtatttatcccataagtctaatggataatgacaatgaattattcgcgttttcttttggggattttgaatgaaaaattcttcaattcatctactttcattaaatagttttactaaaaatagttacatttataatctgaagtctttaaacactttaagactcattaacaaaaaacatttttttcgatcgtaattttttttactggaaatccattgctccaagtaaattaattgttgcatatctttcaagtttggtattctttgtatcattgcttgcttgccacgacaaaggatgtggtggctttaagtttgtagcatgctgttccatattttttctctatctcaataaggtaacatcattgctataattgcctggttaccattttcctttgctatttgatatgggtgtacaatatgtgaagcatttggattacaaactgcattgtaacaacacttcgactgcatcattattattatattaagttgcataagccaaagctgaccattcttcatctaaagcatttaagttatctgtattcaaagccaacaacaaagtaatcaactggttaccggctgaggctgcttcgtgtaatggggtataaccgttggtcggattgatttgacgctttttcatgtcgcaaatgcacgagtaaactttgagaacgttaccatctcttatcgcttcgtgcatgtcatagctttcgccgttgttggcaaaatatgacatctgcaagtacttcttccggatatactcttctcgtttctcttcgtaacgccagggttgattttctcgctcccaacgttcttctctaatatgggaattagcattagaattaccaatcgctaaaaataacttattggtggtgggatctaatcgatctaaggttaatgatcgaactttagaaactgatgtggtcaatgatcgatgaactccactacaattgatgcagatgcaaactccccaattgatgcaacaccaaactggatttggtgcaccgcaatctgcacaaacacaattacactcgaccgataatggtgagtcattgctagaatctttcgtaaatgtagtagtttctttgatatcttccccactatgatctaacagatattgaatattgttttggatgactgcgatccattcgttcatgtcccattcagttaacgcctgtagtacatagactttttcttgcgatatgatcgtgaaacaaaatcggcgttctggatccttaataggtttaactgtggtcaataacaggggtaagataccttgtggcttatcactgtcttctgttccatggaaatatgataatgtatgatttttgacatatgaaatatcgctttttgccaagatttggtaaaaccactgcctttcttccataaatagccttcgtggttgatggcaggggtgtgtgtaaatgagacttttaatcgcttccaatataacgtataatatccttcgagtgattttccaagaatatctgtgttcttttcaaagttgttgacttcatcagaggaaactggaagtgtaagttgaagatttgaaaaagaatctttggcacatcaaaactaaattttgtcgcacttcctttcaatccctagaaacaagcaaaaactttatccatcttcaaatagtatatataattatcattacagggcgtgctaatcaaatattcataaaaattgtatatttattgataattatatttgttcaataaatttttcttcttgaaaatcttcagcaaatggatcttcttcaatatttatgttacttattcccgtagtaaatgtatttgtcgtttcgttttcattttcttctgatttatcattttcataaatttcttcttttttgtttagaatatgtttcaacaatataattaataatatgataataactattactataacaattacacaagctgaaatgataataattattgttttatcattattttgattattattaacattagtgtaaaacattgtaaagaaattggaataataattataataagtcgaataaataacaatcgtataattgtaataaataaattctgtttcaatatatgaaaatgtcgaattatttatatataacgaaaatgttttcgtttgtgtttcataaatagttaatgaatgtgtaattgataatgtaattgttaatgtacatgaaaatgataatgaaaattcactttgaagtgattcagcaaatgtatttgattgactaaatgaatgtgttggaattggttggcatatcccttctgtggattcactatcaacacccaaacttccaaaataatcgcctacatatgttggatatgtgataacacttgttgaaacattataaaatgcactttcactaatttctggttctttgtctccataataataaatgcatcgaagttgatagcaaaacgcaaatgctgaacctccaatttctctgattccatatccaagtattaatatcgttaaattagaacataatgcaaatgcataactgccaattgttgtaactgaatttggaattgtaatgtttttgattgatgaacacaatgaaaatgatgaaccaccaattgttgtaacattttctccaaaaataatcgtttctaaattaaaatatgacgaaaacactgaacctccaatatttgtgactaagttaccaaaattcactaaaacaactgaaggccattctgaaaatgaactgcttggaattgaataaatattttcactgataattatatatttcgtgatattttgatattaataaatatctaaaatcatttaaatttgtgaatgaaagtgttgaattatctttatgaaatatttcataataatttgtgaaaaatataacaacaattttttattttcttttgctttcaatatatatttggccgtcaatattttctgaactaaaattgtttttctgataaaatttgatataaataaccgaaaatgtcattgaaaaaatgaaggttaaatgaagtaaaacattgaaaatatttggtttctttgttgtagtttcgcatcatcaaaaaatgtgaaaattcacgttttatagaagacatatcttcatagtatttgttcaaggttccctcagatatgccatttttgacaaatatcttgatttcaaagtcttttttcaaattgcttgaaaaatatgttctttgataattttgtttgtgtttaaaatcatgacgtaccattgttgcagttttgttattaagccttgaatttaaaaataagttgttgatcaaaactttataattattgttaaatcttttaaattttttgatcataatttcattatttaaaacttctctatcacattggtaaatcattccttccttgcttttgtctttttgtatttgtaatatttctttttgaataggtgtaataagctttgcatcagttctaaatcctttcaccatgatccatatgctgaagaaaaaaaagattttcatgtttcagcttggaatatactttagcaaaattaagtaatattccttcaccaaatatacatcgaccatcacaaaagtttaaaatctcaggttaaacattagaaagtctgtagttttgttgtggtttttcaaatcaacttagaaatatttgaatttatcttttaaagtgatgatcaaagaaaccactttaaaacattatgaagacacttttaaataaacataatgaatgcatgtcatagaattaaatttatgctttaatttgatatgtcgtttatcgatttgaacagtttctatcaccataaaattgatcctttttttataacattgggaattctgcgatttctttttaaatttaaatttattgtttcatgtaaagcactcataatattgaacttgttacatacattttaaagtcaaaaggaattgatattaatactagagatattttttttaataatttaatgtttcaaaatattgtttgaaattatttagttaatccattacatattgatcttcgtacaagatctgagatttctcttataaatgtagcataatcttttcctgttacacttttcaaaaaccatctactaataactccaaatccaggtattacacaagataaaattgatagcttcctacaagataaatcaccttcaacaattggaactaccccaatcaaagatctcccatttatggcatgaggcaaataagtcacagctgcttcgtcaacaaataaaaatagtatattagatcgcgatgtcaactccaaaacaatagttgcccgaaaagctctgaggcacattaatgtggtaattctcatacaaattataattttcatcccatatatttactcaaattaaaaaataatggaatttgaattcgctgtgtattttttgtgttattgatttcatttatattgatcgttaaaactttaggacatcttttgattctgatttttgctatataatttgaattttcaataatttctgattgaaaatactttttgatactgctcaaaatgtttccagtttcgaaacttaataacatagatgtcattgtatcataagttaataaatattccacctcactctacccatagtttttttcaaaatcatagcaaaattattcttcgtttcttctgctaatgaatttataaaatattgatagaattcatgaacatcttgttgaacaagaaaattgccatcatcgaatagaagaaaagaattcatccagcagtcccatttttgaattaaattcttcagtcgtataataaaattatagaatttagtactttccatttgatcgatgatttctttaactagtatgtttgaatattcattactatgtgatctaattgagttaataatttcttctacaacaagaattgcttggaaataagaaataatagaacaagaatgatttgtatttaaataaccttttagaaaggcttgaaacttataaacgtatttcttcttgtcgagtttctcgagacctgagagaattgctccaggtcgttttgagtcataagtaccggatttttctccagtttgcgtaaaaaataatataaaatcatcattaattcaaaataaatttcataataatcaaaatatcaattttttcacttaatttttattgaaggaatatgacattttctagtctccgactgttaaaagtgggcaatttttaatgaacgatggatgaaaattaacgtcctggcagaaaacgtttagaaaacgttaaaaagtggacaatttttagcttccaatggtcaaatttttgtggccggcactgtagcatcaaaggaatggatttttgaataaatgggcacccaaaaagtttgtttcaacacaagagattgatttttgtaatacaagtaaccgccaaccaagaggacgatatgtgagcacaattacctaacactttttgaaacgttaagaaaaattctggatgtgtggcatcaagtaaaagtaaaaattcaagtaaatttactttctgttgttgtaaaaaaattattaaacttaaacaaattatatttaatataatacaagaaaaatgaacaaaccagttaaagtgtcaactttctgttttgttcttgtatattgtaatcgtatagaagcataaaatctttaaaatgaacaatttttatttgatgaattaaatatgtaaatatgtttcaacataaccattccatcaaagaatggttttgaaagcaacgaacatatctttatccagatatttttctcttctacaagcaacaacggtaaatataataatcataacgagaggtattatcgagaagcatggactcgtcaaacagccccatgcgtcaaccatttcgttaaacaaataataccccataaaagcaacagcagcgtcacaacacacaaaaacaattaagtcaatggtgaaaatcgccgaccaactttttgccaaaaactcactaaacgaagaagcaaagacaaaagtaggcaaagcaactaatgcataatatataaatacaatgatttgacccatgacatcaaaatgattttttccactcattatgaatccatatgcccataaaataccaataataccatcaacctcaacaaaaaaagttggtaatacaataggatatattaataaaataaataaaataattcttagccatgttggaagatttgaaattcgttcgttcattgcaaagaagcctaaaaatattgagccaaacttacgactttcttcttcaccatcttcaactatccatgaatttaagatttgtccatattgaaactttgggataaaagtcctaaacgggattactatcaacattaaaaggaacacaataagaaacattccaattctggaggtgaacgttaagttgggccaccccaaaactttttctttattgagttgaatttcatctccaataacaaaagtcatttcatagttataatctccaaagaattttaaattataaataccattttcttttatattaatattatcagaatataaagaaatagtattatttgtatttatatatctattaaatttcaattttttggttgtgttttcgttattaatttgataatttatatttaatgtttgatttgaatcataaactataactcgaattcgaatgtccttttgattaaatatcgataatgtacttacttgattaataggaattggattagtcacaaaagcattttgtaaaacgtcatctatttttaatgaatgataaacaattcgaccattatcaatagtgataataccaaaacctttatgtttaagaagatctgatgcaacaacttcaagcattccattcgtatggatgaatgttgtttcacttggatgtgtatgacctgtgataagcattgaacaattattattcgttataatttgttcaagtgttttacctgttgaagatgtacatgtgtatttatcccataagtctaatggataatgacaatgaattattcgcgttttcgtttggggattttgaatgaaaaattcttcaatgttatccaatacttcatgtggaggatatatccacataccatacttggcattaatggtcggataacgaaatggtgaaatagaaataatttcactttgagctgtttcatattttgatacataaaattctttctgagctaaattataagttttcagataagaactataattaagaaaataatgatgcttggattcatagttataaatacgatattcatcatggttaccagcaatgtcaataaggattttgctgatgttatacttatcaataacagaatgataattaagataatcttcttcactttgtttgggataactaagttctgtgggtttgttgtcaactaaatcacctgtaatgatgacactggatggctcccatttcattgaataatttaatgccatatcaaaatgttgagctcttgatgatacctcatgatttatatgtgtatctgcaaagctggcaataatttcaggatttaattcatcattccattcgatatttgtagtagatgatttaattgggtctatggtttttgtggttggcataaatacaccaattaaaaggacgattattatgattattacccaagtatattgtgaaaataagtaaaagagggatctcattttattaaatgtaaaagagaccgaatctatctaatcgttgaaaaagtcgaattgattgtaaagtggcggttaatttaacactttttttaaacgtgcactggcaaaagcagaaaaaaatgtcaattcggaattaatttttattttgattatgataatgttcttggttggtttggtaaaagaaaaaaaaattataacactttatcaaaatttttattttacatctttaattgatctacttttatatctttatgagaagaggtgtttgatttcatctgagaaagtaaatttgtttgttgtttctgcggacttggaatattgccctttgaaggagatgacgatttttgaattgtctctcttattattgattggagggttttctgaagagcctgtgctgatggtgccacgcatttttgagtaggatttgtttggggctcttttttaatggtaggagattgattaattttgaaacattctaatttggattcatagtaatttattaaagcatcataatggtgttcaagcattttatttcttgttttgatttttacttctccctttttattttttattttgaatactaaattattattatattttgcaacaccaataatttcaatagcctcacttccttttttaatgtttgatttttttgatttccagtaattttcaagaatttgtggacaatttagattttcctctttttcccaagtggattccgatacaggatatcctttccattttagaaggtatttaattccgctttgagtatgtttatgatccataatttgttctacttcatacatcctgcttgtatttttcacatcaaatgtcatttatctgcaaatgaactattgtttaaatgcttatatttacatattcatttttaatttcattaaagaaaacaatatttgattgaactacaaatcatcttaaagtctcagttgttaaaactctggaattatttgatcatttaaatttatcatgcacttttaataatgttattcataatttgatttattataagttttaaaatatcttatacatttgatattgattattaataatataaatttcgtttcaatttcgtaataaaaatgaagatttgacgtttaaagaagaatacaaccaaaattaaaattttcgtttgtacttttttcaccaaggaaatgaacaattttgatggaatacttttgttgtgcaatttgaaatgtagttaaagatcgttaaaatatattcaaaattttaaaaaaatattccaaattattcaaatgaataattttttctttaatcattttttcttcagttaaatgttttaaatatttacttatgaataatgcaagtgtagaaaacacaggtaaatatgcaattgcaggtggaaatgaagaaatcattcatttatgtgaacaaaatcattcatcttttgaaggtgcatatgaaacagcaattaaatttcaacgaaatgatatctttaaatatctttatgaaaataaaattgaagatattaacaaattaaaaaaattcggagaaaaatgtgtttcatattttaattatgaaatttttgcatatttagaaaaagaaggaaagaaaattaataaaaatatcattaataaagcagcaaaaattggaaatatttttcttgtaaaatatttccataaaaataatttacttaatatattaaaaattagaattctaatattgtattggaatttatctttgataaatttggttaatgtttttcgtgaatgaaattcgaatgtatgataataatgaatattaattatgtcggtttatttcatgagttttcaaaagctctatcgtttttacagaatgaattatatagtaatgtatagtattttttcggtttaacttttcaattgccagggtttgactacacagttcttcactttcccacaattaccgccgtcaaacgaaaaagtttgagaacatttcaaagcaaccgctaataacgatgtgacgcagaaaattcaatagtttaaaacggctgacaatagaaaaatatctccaacaataactcaagagaaaatcatgtgaaaatgaaatctaacaaatcaaatgcgcaacataaacatttgattataatatttgaataaaattttaaaagtttgctttaaattgcaacggatttgatgatttttcttctcaatttatccgataactttttcggattaaacaaattcaatcgatatttgttcgaagtaaaaaatttgactgcatagaaatcagatcaagaaatggaaaaacagtttgaattcatgaacctatctcctctccatatgtccactctgttacatcggtacgatatggttatggagttaaaggaacatgttgctgccacagaaaagacttttcaacattatgctgaatgtggtcgacaattatgcgagtgtatggaaaaactttccggcacattccagcgttacgatgaatttaaatccgatcctgcattacaaagcatatcagaattacttatttcattttcaagtaccttaaagagtcattatgaccaagttgatcaacacatcattacctctttgaagacttttattaaaaaagatattggccgagttgaagaagacaatcgtcgagtttcacattgcattgatacatataacaaacttgttgaacagttcgttcaaatcaacaagaaaaagcccggtgctgatcaagaagagaaagaagcccgtatgatggcctcacattggcaagctgtttattccagtttcatgtttaaccgtagtctcgactatgttgaacgaaagaagttactagaaatcacaggaaccatgcttatgtttattaatctcgttgctttggcatataaagaatgtttatttagttttgatgatgccaaagattctttttcaaatcttcaacttgcacttccagtttcctctgatgaagtcaacaactttgaaaagaacacagatattcttggaaaatcactcgaaggatattatacgttatattggaagcgattaaaagtctcatttacacacacccctgccatcaaccacgaaggctatttatggaagaaaggcagtggttttaccaaatcttggcaaaagcgatatttcatatgtcaaaatcatacattatcatatttccatggaacagaagacagtgataagccacaaggtatcttacccctgttattgaccacagttaaacctattaaggatccagaacgccgattttgtttcacgatcatatcgcaagaaaaagtctatgtactacaggcgttaactgaatgggacatgaacgaatggatcgcagtcatccaaaacaatattcaatatctgttagatcatagtggggaagatatcaaagaaactactacatttacgaaagattctagcaatgactcaccattatcggtcgagtgtaattgtgtttgtgcagattgcggtgcaccaaatccagtttggtgttgcatcaattggggagtttgcatctgcatcaattgtagtggagttcatcgatcattgaccacatcagtttctaaagttcgatcattaaccttagatcgattagatcccaccaccaataagttatttttagcgattggtaattctaatgctaattccatattagagaagaacgttgggagcgagaaaatcaaccctggcgttacgaaagagaaacgagaagagtatatccggaagaagtacttgcagatgtcatattttgccaacaacggcgaaagctatgacatgcacgaagcgataagagatggtaacgttctcaaagtttactcgtgcatttgcgacatgaaaaagcgtcaaatcaatccgaccaacggttataccccattacacgaagcagcctcagccggtaaccagttgattactttgttgttggctttgaatacagataacttaaatgctttagatgaagaatggtcagctttggcttatgcaacttattataataataatgatgcagtcgaagtgttgttacaatgcggttgtaatccaaatgcttcacatattgtacacccatatcaaatagcaaaggaaaatggtaaccaggcaattatagcaatgatgttaccttattggaatgagaaaaatatggaacagcatgctacaaacttaaagccaccacatcctttgtcgtggcaagcaagcaatgatacaaagaataccaaacttgaaagatatgcaacaattaatttacttggagcaatggatttccagtaaaaaaaattacgatcgaaaaaatgttttttgttaatgagtcttaaagtgtttaaagacttcagattataaatgtaactatttttagtaaaactatttaatgaaagtagatgaattgaagaatttttcattcaaaatccccaaaagaaaacgcgaataattcattgtcattatccattagacttatgggataaatacacatgtacatcttcaacaggtaaaacacttgaacaaattataacgaataataattgttcaatgcttatcacaggtcatacacatccaagtgaaacaacattcatccatacgaatggaatgcttgaagttgttgcatcagatcttcttaaacataaaggttttggtattatcactattgataatggtcgaattgtttatcattcattaaaaatagatgacgttttacaaaatgcttttgtgactaatccaattcctattaatcaagtaagtacattatcgatatttaatcaaaaggacattcgaattcgagttatagtttatgattcaaatcaaacattaaatacttttagcatcaatatcaattcctttttgttcaagaagtaatttgactatttctatatgaccattttcagatgcaatcataagtgctgtttgaaataatttaaataatttccaaatattattttgaaataaaaaattattaaaataaatttcaaataaaataaataaatatctttagcattaatatcaattccttcttgttcaagaagtaatttaaatatttctgtatgaacatttgaagatgtaatcataagtgctgtttgaaataatttaaataaattccaaatattattttaaaatataaaatcattaaaataaatattaaataaaacaaataaatatctttagcattaatatcaattccttcttgttcaagaagtaatttgactatttctgtatgaacatttgaagatgtaatcataagtgctgtttgaaataatttaaataaattccaaatattattttgaaataaaaaattattaaaataaatttcaaataaaataaataaatatctttagcattaatatcaattccttcttgttcaagaagtaatttgactatttctgtatgaccattttcagatgcaatcataagtgctgtttcaaatattttaaataattttcaaatattattttgtaatttcaaattattaatataaattttatctttagcattaatatcaattccttcttgttcaagaagtaatttaaatatttctgtatgaacatttgaagatgtaatcataagtgctgtttgaaataatttaaataaattccaaatattattttaaaatataaaatcattaaaataaatattaaataaaacaaataaatatctttagcattaatatcaattccttcttgttcaagaagtaatttgactatttctgtatgaacatttgaagatgtaatcataagtgctgtttgaaataatttaaataaattccaaatattattttaaaatataaaatcattaaaataaatattaaataaaacaaataaatatctttagcattaatatcaattccttcttgttcaagaagtaatttgactatttctatatgaccattttcagatgcaatcataagtgctgtttgaaataatttaaataaattccaaatattattttaaaatataaaatcattaaaataaattctatataaaacaaataaatatctttagcattaatatcaattccttcttgttcaagaagtaattgaactatttctgtatgacctactttagatgcccaaataagtgctgtataaaataatttaaataatttccaaatattattttgaaatccaaatttattaaaataaattttgaacataacgaataaatgtctttagcattaatatcaattccttcttgttcaagaagtaatttaacgatttctatattaccttttttagattcaatcataagtgctgtttgaaataatttaaataatttccaaatattattttgaaattaaaaatttttaaaataaatatctttagcattaatatcaattcctttttgctttaaaatgtatgtaacaagttcaatatttcctgaaaatgaagcaaaaactaaaatatttcctggaagttgattatttttatggaaatattttacaagaaaaatatttccaatttttgctgctttattaatgatatttttattaattttctttccttctttttctaaatatgcaaaaatttcataattaaaatatgaaacacattttttctccgaattttttttaatttgttaatatcttcaattttattttcataaagatatttaaagatatcatttcgttgaaatttaattgctgtttcatatgcaccttcaaaagatgaatgattttgttcacataaatgaatgatttcttcatttccacctgcaattgcatatttacctgtgttttctacacttgcattattcataagtaaatatttaaaacatttaattgatccaaagaatgctgcataatcaattaatggaacatttttatgattaataaatgaacatctttcataaagtgatggttcaattgtttgatcaaaattataatttgtttgagatgatatatcttgaagtttttctatttcatcatttcgaattatttttgcaatttctcttggattaactccttcttcaattaattgcttatgaagttcaaaatcattctttgaaagttcttcataagcaatattttcttgatcaaataaatatttatattcatttgatttatcttgattaatatgaacaaaaaatggattaaatgtatttttgatgaattttgattcaagtaaattatgcttaatcatgtaattaagtaaataaaatgattcttgtgtgttttctttaagtagaaattgagaaaataaatttattatttttgagccgattttattattttcttcatatttttcaatttcttgtaataatctcaaatatatatcaaaattattactatcaatcagaagatatatatatatatcattcggaatataatgatatcataagataatggatattcttaacaaaacttgctgataataaaatttgatgattgagcaaaattatctatattcaaaccaaagattatgcttttgagcgctgtaaatgtttcccactccttttgagatttctgatttgatgttgctgattgattttgattcattttagaaaaacagaaagggcaacaaagccgtttaaaaaaccgccaaattttgttctttgaatattatttataatatataagaacaaaacagacggttgacactctaaccgtaatttctcctcgaaaattatcattcaatttcatctatcggagcggcttccagtttttcctagaaaatttcagttattttttctgatgtttattctttacatgtatcgtcattcaatattgaaaactttattattagaaaaagtttcatcttcgaattaaatgatttacttacgcactttttttttctaattgttcgcgctgccaattttttactatatcatgtcaaccagcgatctctaatgatttgattcatttttaagcaatttttttcttttttctcttctcttaatttttttcttatcttattattcactgtttttaagggactgcggtctaaacggtctcccccggaaatttatttttttccaagaaatctctgtggttgaatgtaatacttacaattaataacaaacaatatttctacctaatgatttacttattgtttattgaaatattaagatttttgataaaatatgacagataattaaattttatattaaaataagatgaaaaaatcgttatattacattattacaaattctaaaatataaataaatatttatctgtttttaactttttttggttattcataagttctgttcatatttaatctataaattcgaatttttcgataatgcaaaattataattaatgaattatcttagctttatacttggatttatattttgtaattatctttattttttattttaataatgttgtttaaattccaaaaatacgattaaaatccatcgaaataagcccaaacgtcaaaataataaaatagggtctgaaatatatttatttcgtaattatatagattaaatccaatttattattaataaaataaattacatggatgtataaattttttaaacagagtataatattaatatttattgaaatatgttaacaaattgcatttgaaatttttatcttcaaattttcaatatctctctattcgttgatttcgattgattttgtaattatatattttattttgttttgttttatcacttatatctatccctctattcattttaaaatttatttttttaaattgaatgcaatttgatcgatttgaattcaattttttgatgtgttttttaatgaattttgcgttttttgttttttctctcttatttttctggattctatattaatttcagaaaatatgttatcacattattaaatggaatttctcatattaatttcagtattgaatttttcttttatgatcatttgttcatcatttttttcaattttctacaatttcttctttttcagaaccatatataaggaaaatttataaaaatgtaatagaacgtttttttcatcttattttaatataaaatttaattatctgtcatattttagcaaaaatcttaatatttcaataaacaataagtacatcattaggtagaaatattgtttatttttaatcgtgagtgttacattcaaccacgagatttctcgataaaaaattcctataagaccgtttatgcttttatcgattaatcgttttctattcaatttagtaaaccacctttaaataagattttcttttctttgttgaatttgatcatttcgaatttttattaatatccctataaatcatttttttttataataatgattattctaataatgatagtttaataatttctgtcctattatatatatcaatcaattgatatatcaattatatagatgtacattgattttcccgttgattgatgcataatttttttgatctaagaacaaaataattggattaaactttgatttaaatctctaaatatggtttaacatttcttctgacattatttatattatctctcacagaaactcgacttattaaaaatacagatcacgatcgaaaggtggtaattaatgttatgtttcagaattatatttggaaattattcaaaacattgaacacatcacttatgaaagcatctaataatggtaatctagaaataattaaattacttattgaacattaaggagttgatattaaaattatgatccatgttcattataaaatgggtttaaccattttaaagaaaaagtgattgaacctcaaaacaaagcaaaaatatcttctttaataaacaatattttttaagattaataaatgaaccatgaatagctatttaattttatattgtaatattatattcagaatttaaagagagaaaaagaatgcgaaaaattgattatttataaattagagccttttcttcttgcttataagaatattgatctaagttattttttagatattaacttcaatcatttccatgattttgttttcgttattattgattttgtgcgtaatctgtagttgaaatattaatgttttttgaatgaaatataatattgtcttaattattgttttctcgaagttgatacaaattgtcatgtgaattacattattaattaatattaagattaaatttttataaaaaatattagttagatggcggagacactttttgagctctgctcaaaaagtggcattacttgttaacttaaataaaaaaatatatcatctttgaattcaaaaagaaaaaatgaaaaaagaagcaagatttggaatgcctacaaaaatgtaagggagaatatgacattatttggaaaaatgataataacaataaatttgatagcctattagtgataaattagagaataaagaacttttcttatgcaagagatatttttgcaatagatgatactgaatgagccaatagatttcaatatctctttttacccttttttgtatttgatgagaataacaaaaaataattttaaaaaaccattgagttttaacttcctttaatatctgataattatgaattttttatttttgcccgaaactttggcaatgaaaaggattatagatgaaaaatattttttagaataaataaaacaaaagtgttgatttgcattagaaagtgggaaacataaaaattattattatttcattgaaaaaaatattaatattaataaattggaaagctttcagagttaaattatccataataatgaggaaaattgtttgctaaattttcacatttggatgatttcgtaatatagagatattgaagaaaaaagatcttgcaaaatgcaacatgaaagcatacccatacacactttatgttggagaagttctcttaattccatttccacttccaataccatcaagatcaccgacagcttctccttctaaatcaccgacagctactccttctaaaacattttctccaacagaagcatttacgcaatcaaacacatattctcaatcgaatgccttcacaccatcgaatacgtacagtcagtcaaacacatatacgccaacagaagcgccataaatttattccttcctctctgaaagtatgttttaatgtaagtgaatgtttatatgaacaaattttagaacatattaaatgatgtggattcaaacattttccttatttcaacttgttcaattataatttttttaacacatagaattcaatgttatggatccataaaaacctctaaattttattatatatttaatgttgtagattatatataaaataacatggcaatttcaatccataaaaaatatataaatatttataatttgttaaacatgtttaatggataaattgtttcaaatatattcttgtttttgtttcaaagatttgcaaaataaattctttattatttgagttcttcggcaatcgattgtgtgctttactcatacgagatactgtataaatatgaaattaatatattttatattttaaataattattgaatacaatatgttatataaaaatattataatataataattatagaattatacatatttattaaaaaaaaatatttttcatataaaatttcatgaaataattatcttcgttttacttcatctttaaaaaaaagattttccattgaatcttctgatgtaatattactttcactattttgtgataacaacatacctccgctttgaatcgaattttgtgtgaaggaatgaatgatataaagcgtgaaaaatttgattaagctacctctgatttggcaagtttggactcctggtggagaaaaagaaatccgggtgatgtctgcttgattcgtttcatgtgcatctaagcctgtttcacttgaagaagaaaattattttgttgaagattgtatttttgtcataaactattgaaaattgaattcatatctggtcgaattatcattaaaaattatatcgtaaatcaaaactaaaaacaatcgaaacgtttggccaacacacaagtttaaatgtttatattaatgaaaatattagaaaaaattgaagatctttagttcttcttttgtgatctgggaaacttaatacactttttcaataaactattattgacttaaaccgcacatatcatctggaagaacatgcgaaaacgcaaaacaaatataagtaaaaaagaaaaaatatttcctcaaaacataaaactagaattattctctaagcttgaacaaataataatgaatctaacagaagaaaatataaatttgtcagctaaacatacaataaaattatttgattttaatttaccatattcatttaatcttgttataaataatttaatttattatgcatttttatcacaaagaaataagtgtactacgtattttaaatttttagaaataattcaaaagaaagaagaggaaaaaattaattctaaatacaatattattgaaatattccttaattatatcataaaaaataattctcaagaagctctatatctaactgagcaaatgattagacaaaatttaattgatgcaaacattacaaagataattccttcaaaatattttgctcattacaaaactacaactgaaaacaaagaatggttatgtggtgatcgattttgttcaacttttgtaaaaaattatgaccaactttcaaagaatgattttgaacttcataaaaaatatgttaaaaaaggacataatccgaatgaaattgcaaaaataattcgaaatgatgaaatagaaaaacttcaagaaataacatcgcaaaatgattttgactttaatcaaacaattgaaccatcactttatgaaagatgttcatttattaatcaagaaaatgttacattaattgattatgcagcatttttttcttcagttaaatgttttaaatatttacttatgaatgaagcaaatgtaaataatacaggtaaatatgcaattgcaggtggaaatgaagaaattgttcatttatgtgaacaaaatggttcatcatttatagggtcttatgaaatagcaattaaatctcaccgaaatgatatttttctttatctttatgaaaataaaatggataatttgtgtgaggaacatgatacaaaacctcataaaaattatctgaaatatgaagatttaataaaaattttgtgttatgagtggaaattatgaaatcctatcatttttagaaggagaaggaactaaaatcaatgaatctatcatcaaaaaaatcagcagaaataggtaatatatatctactcatgtattttcttcataataacaagaaaataccaaaaaatattttaatttattctattaaatcagagaatgctgaagttgtggaatatatcattcttaaacatagaaaagaaatcaattttaattctgtaaatattttttgtaaaatttcaatgctttcatacaatatttgataatgattaattaagttatttagaactcctttgatatatgttgctgaaaaaggttacacagaaatagttaaattacttattaaacaaaaagaaattgatattaatgctaaagatatttatttgttttatttaaaatttattttaataatatagtatttcaaaataatatttggaaattatttaaattatttgatacagcacttattgaagcatcatggaaaggtcatatagaaatagttcaattacttcttgaacaaaaaggaattgatattaatgctaaagatatttatttgttttatttaaaatttattttaataatatagtatttcaaaataatatttggaaattatttaaattatttgatacagcacttattgaagcatcatggaaaggtcatatagaaatagttcaattacttcttgaacaaaaaggaattgatattaatgctaaagatatttatttgttttatttgagatttatttaaattattttatatttcgaaataatatttggaaattattcaaattatttagaacagcacttattttggcatcttattatggtcatacagaaatagttaaattacttcttgagcaaaaaggaattgatattaattccaaagatattttattcctttacctaaaatttattttaatgatataatatttcaaaataatttttggaaattacacaaaatatttaaaacagcacttatttttgcatctagagatggtaatttaaatatagttaaattacttttggaacataaaagaattgctttaaatgttatagatgatttttatttattataatcgatattatttagagttactttgggttttaagccaaaatttaaagttttattatataatttgaaacaccattaatttgggcctcaaaaaatggtcataaagaaattgttaaaatacttctcgaaaaagaaggaactaatattaatgccaaaaatttttgaatgttttgttcaaggtttaaattaattaaaatggatttcttaataatgtttggaaaatattcatattgtttcaaacagcacttataaaggcatcttcaagtggatacactgaaatagccaaattacttttaggaaaagaaggaattgatgttaatgctaaagatattattttcatattttgtttagaatttatttatacaattggatgtgctaaatgtgtatttaggatttgtttaaaatacttgaaacagcaattgtgtttgctgctaaaaatggtcacacagaaatcgttaaattacttcttgaacaaaaaggaattgaaattaatgctaaagatgaatttttgttgttttatatgatatttattataataatttgatatattaagataatatttggaatttacttaaaatattttgtacagcactcatgaaagcatcgagaaatggtcatgctgaaatagttaaattacttcttggacaaaaaggaattgatattcaagctaaaactatttattaaatttatttaaaattcaaataaacgatataatatttcaaaataatatttggaaattatttaaattatttgaaacagcactcgatttagcatcttcaaaagataaccaaaaaattgttaagttatttattaaaaaaaattataattaataaaaaaattattgaataaaattatgtggatcaccacattaaaccgatagaattttttgagatgagcgtttaatgcattcaaaaagttgagaataccgtttatccagagccaattcaaaaaattctatcgtttaacggtcgtctgcctggaaatcatttatccacttaataaagacactgtcaaccaactctccctcttatggatttcttattaattttaaaattatttgtaatgtatttaatacatatcagattttaacatatacaaatttttatgaaaatataataatttttttaaaatttcctttgaatttagtcactttccatttaaattcgtgtacgatacaatacacaaacggtcatctaagcgaagactggatgtatcaattaaccacatctaaaccagtatatacaagaattgttgaaaaaatgtttacaatatttttatcttctgtttgattttgtgattcctgttgtgagtatcgctcactcgtggaggaacggatcttgatggatttgtaaccgaaaatcgattcaaaaagttattttttcttctttgaccagagtatccaataatgaataaattgtttcaagaattatcctattcatagaacaaataaattatataaaattgcaaagacagatttttgaatttttgctctgatctatagatattgaaaatcttgtataacttaaaaacagaatgaaaactctagaaaaattatataaattaatattgattatcattagttctatatatttattgaagttaaacttttgtatttaatcctaaagcccaaaaaagcattttgaaattttggatattgctcataaaaaataatacaacaaaatttggttaagataattttattgaatagaatgtgtatactaatttatttatattttttttaaaatttagtacagtggaaaatgaaaaaaattgattttctgatttgaaaagaccgtttatttggtcgacttatttaatacaacagacttattcatttgatgtttgtctcaacatttaataccgcttatttctttaaacaatttcaatttattaatttggcgcaataatttgtacaccaacatcagcaagaacaatttttgtgtcatttccagttaaactcattaaggaatttgaagataattttctgagttttacaaagtatactttcacatgaattcaaattttctctactaaccgtttattattatttttaacattgggaggaaatatttcacacgaaaaagtacaaaccaaaagaattgttaaaacggaattcactatagaagtattacagcaaatcgaaaagcttatttttgaagtgaatgaaaataatatttcaaaaacagttgaatcaatattagtattcgaaaataataagtttcctttttcatttaaacttttaatatgtcaaattatatatgtatattatatatcaggaaattataatattaacataatttgtgaatttttaagacaatttcaaatcaaagaagaagaaaataaagaaacaaaaaataaaattataaatatttttgaatattttctaatttgtactaaaacacaagaatcttatcatattctttataaattacatgaaaataagttaattaaagaaaaaatgactgtaattcaaaactcattatattttcttcaatgcattccaaaagaagaaatatgtaaaacaaaatccaaatttcaaaatgaaattttaaataattatgaaaaactttcacaaaatgattttaagcttcataagcaattcattgaagaaggacataatccaaatgaaattgcaaaaataattcgaaatgatgaaatagaaaaacttcaagaaataacatcacaaagtgattttaacattaatcaaaaaatcgaaccatcactttatgaaagatgttcatttattaatgaagaagtttcattaatttattatgcagcatttttttcagcagtcaaatgttttaaatatttacttataaatggtgctaaaacaaattatataggcaaatatgcaattgcaggtggaaatgaagaaatcattcatttatgtgaacaaaatcattcatcatttaaaggctcgtatgaaatatcaataaaatttcacaaaaatgatatatttttttatctttatgaaaacaaaagtgaaaaaattcataatttggaagacttaggaaggttttgcattctatatcataactatgaaatttttctatttttgataaaaaatggaatgaatatcattaaatttttaatcaatacttcattggaaacaggaaatatattcattttacaatatttcctgaaaataaatccatttacattaaatatttgcgatatttcatccatttataataataaagaactttttaattacttaattgctgaaaatatttttgatattaataaggaaactatatatttctttcatttaatgtttatgtaaatgatttgttatatcagaatattatttgaaaattctttaaattttttggaacagcattaatgtttgcaatagaaaatggtaagaatgaattatttaaattactacttaaacaaaaagggattgatattaatgctaaagatatttatttgttttatttaaaatttattttaataatatagtatttcaaaataatatttggaaattatttaaattatttgatacagcacttattgaagcatcatggaaaggtcatatagaaatagttcaattacttcttgaacaaaaaggaattgatattaatgctaaagatatttatttgttttatttaaaatttattttaataatatagtatttcaaaataatatttggaaattattcaaaatatttagaacagcacttatttatgcatctaaatatggtcatacagaaatcgttaggttacttcttgaacaaaaaggaattgacattaatgctaaaggtgtttatttgttttatttataatttattttaataattttatatttcaaaataatatttggaaattatttaaattacttcatacagcacttatgtatgcatctgaagaaggtagtacagaaatagttaaattacttcttgaacaaaaaggaattgacattaatgctaaaagtatttatttgttttatttaatattcgttttgataattttgtgtttcaaaataatatttggaaattatttaaattatttgatacagcacttattgaagcatcatggaggggtcatatagaaatagttaaattacttcttgaacaaaaaggaattgatattaatgctaaagatatttatttgttttatttattttatttttaatcgttataatattttgatagaatatgtgaaaattatataaattttttgaaacagcacttatgtttgcatctggaaaaggtcatatagaaatagttaaattacttcttgaacaagaaggaattgatattaatactgttaatatttattcttttcctttcatatttatttgaataattttggatttcaaagtttgattcaataaatgcttaaaatatttgaaacagcattaacacttgcatcttgtaatggtcacacagatgtaatcgtaatgcttcttaaacaaaaaggaattgctgttaataccaaaaatattttttttattttatataacattaattttaattattatatattttaaaataatatttggaaattatttaaattattcagaacagcacttatgtttgcatctggaaaaggtcatacagaaatagttaaattacttcttgaacaagaaggaattgatattaatgtgaaaaatgtctaattaaaatgtaaaatatttcaaatatagttttgaaataacatcaaaaaatatggaaattaaattaaattattaaaacagcactcatatgtgcaacagaagaaggatatatcgaaatagtaaaaaatcttctagaacaaaaaggaattgatattaattcacaagatattatattaaataataacgaatctcaaaaaaaattttaatgatatcataatatattacatatttaaattaaattaataaatcatcacttatattggcatcagaaaaaggttatttcgaaatagttcaaatactacttcaacaaaaaaggattaatattaatataaaagatgtttcaattgattaattaatatttcaattaacaattttgtgatttaaaagaaaatttggaaagtattttcaatatattttactccacttatgtgggcatctattaatggacataaaaaaatagttcaaatattacttaaacaaaaaagtattgatattaatgccaaaaatttatgctttttattatataatatttatatgaatctttttatatttccaaattatttttggagtttctttaaatatttgaaaacagctcttataaaagcaattgaaaatgaacatgttaaagtcataaaattactattaaaaaatgataatattgatatgaatattcatgatgttaaaatgatttaaatgattttcatattaaatatttaaaattttaagataatttttggaatttattaaaattaaaagaaacggctcttatgcatgcaactaaaaaaggaaacacagaaattgtcaaattactaacaaaatataaacgaaaaaagagtaaaaaataatatattttatatataaaaatgtctttatataaaaattttgtatttaaatagatccgactttatttcaaaatgtttaacaactgataataatgtttttgaacgattagaaaatcatttaacaattaaaaattcaactaatgggaatcaataaaatgaaagagcttttgttcgggaatttcgaacataaattaggcactaactacatcaagattaactaacatgattggacgaaaaattacttcaatacatcatacaaaattaggtaccaagtaaaattcttttcaatcttttctttatgttgtttgtgaatttgatttatcaaggaattgattcgttattccttataaggagtctaatttatatgctattaattgaaatacacttggaacaatataaataatttcgaatttttaaaaaaaacctataagaaagaaaattgattgccaaaccgaaatttcgttgttattagtcctaaaaattgaagaattgaaatgattcattttaccacatgaaaccaaatgaacattgcgactgggaaacacatctatcaataaatcaagcagtttttagtttgaatgaagaaaatttaaatatttaggtttaataatcagcagtaaaatatcttctaattaaagaaacaatttggcattcttttttggcaatgttataagcaattaaaggattttattctcacaatgttgaaagaattaaatttctgaaaaaaatgtttcttcatgaagaaaaaaaattttataaaagtcccaatcaaaagcatagaaaattgtataaaattcgaaaattgatgaattatatttaataaacttgaggatctggcccgaaaattcgtatgtactctttattgcttagatcttcgactttttcatcttcatcatttgcaaaatcttcgaactcaaaatgttccattcaccattcagagtattagtactgattctattccatgcaacaataatttgatcggcaatttcccatcgatcaatttttcctccttcatacttatgataatgttccctctatatttgtttaacgtaagctttcaatacaccaaatactttcctatccgaaggttgcaactcatctgtacttccaggaggaataaacgttaattcttttcctagttcagcagccttttcctttactttctctgttctgtgtggtgcataagtatcaattattaatgcacattttttcttaacaaattttttaaaaatttctaacactgattcctaacacttcaggaagcacctctaacatttctttttcttcctatcataatttttcgggctcagagtcgaaatcattcaaaaaggttaaaattgatgaaaataatatttttatttaaaatattttgattcaagtgcctcttttgctgttggcctttggttcatatccaatgtcagcaaagatttcatcagctcaatgagttcttcgctttgtaagtttgcacgttttggagaaaaaaacgtttcaatatcggcggttttctccatttcgaatttttgcgaatagcactcaggtattttctttccgaggctctccgcgtattcaagaatcctccttccgccaaagaacttcgtcatctcgaccaaatgaccccattgatttcgggaatcccatggaagtttaaaatcacaaagaattaaaagaatgagtgtgccaacagcccaaatgtctccttttgtcccaaacttttccgattgaaacagcatctctggagaacgcatggtacgagatccaatagatgatggcatagaagatgaaagccgacatgaagaaccccagtcaataatggtgacgtcgtcaaattctggtgaaactatgatgtttgacattgtaagatcagcatgaataaaacctttagaatggactgattcaagacattcaagaatagactttaataaaaatttgattcgttcaggagtgagttgatctattaattttttgctgctaattccttgtttaaattccataattagaatgggacaatcagttggtgcagctattaattttataacatgtggacattgttggatttcacttagtatttgtccttcattattggaaaaaatattattagatggatttagaatttttacggcaacatcttgattatcttgccaaatgcctttataaacgcttgcaaatcttccacgtcctatttcgttttcaattctcaaacctgggtagtttaaagaaagtgcataagattcgaattctttatcccgcatttttacatcgaccgtttataatatgaatgcaaaaaatttttttgttataataataaatcttctttcatattttttttttttagaaatgaaaataaaaatgcatataaattttattgcttcatttctctgaataattttttttcttttcttcaaatgcattttaataaacacaattaattaataaattaaacataaaatgttttctatttacatttttatttaaatttttatctaatccactttcatttgaattgtactttcgccacttttatttttcgttactaattttccgccttcatcgccccaaaagtattgtgtgttctccaccatttctgtgctatatgattgtttaaacgtaataacatcgccgtcatcagtcatcagaatattaattctaattaaaaacaaaattttatcatcaaaacatttcaacaatgcgaattttccacttaagtcgaaatcgattgaagaaatgttattacaatcgattttatcttctcctttaagagaaattccatttttatattgataaacaatcaatttcaaagtggaatttttatatatgtatgaaatatatttaaactttaagttaaacgaaataattttacatttgttattcaattcggaaattaattttaatgaatcatcttcatttaataataagaaaccatccattaacatgaacaaaaattgttcgatttcagtaacattcttaaacaataataaaattttcgagttaaacaaattaattaatttcttaaacaaaacataaatcaattctttattttgatccttaattaagtttttaataaaaataatacatgaagaagtcactttcttaaacaaaactttaaatgaataatcatccaaatgattattatttaagttattaataatcgagaaaaaaagttttttaaagaaatcattagttaaatattttccatatctatcgattcctctcgctaaaagttctctaacgaaaggaccgaattcatttgattgcacaccggatattaattgtatcacattactttgtatatactcatcatttaatttatccaaaatagtatcagctataaaacatctcaaaaaagtaaaaacatttcgataattcggaaaacattttgctgcatcccttaatttatcgatccaaactaatctcaatttagaatcataagaagaaactaatctcaaaagtaaatcatgtcgatatatatcacatgaaaacaaaaatgtcattaaatgaaatatcgatggtcgttggaaatgtgaaattttttgtatggcgcttatatccaaatgaaacatttcttcgatataatttgatattattttgttctctttcattgcagtcgatattattattcgacatgcaaatattatcgatgaagctaatggtgatatttgccaatgtgaacgacgattaaatttaatatttgggaaatgaattgtttgaacataatgatgacctacgaaaccgaattggaattgtaatttagaatgatatttaaacttagtcttaaagaaatgtcgagtattttcagatagtactccaaacaacaaagaaaagtttggaatttttcgaatgatattattaatttcttctttagaattctctttaaatatattttggataactttactatatttgtttatatgaataattgggatttgtaatgataatgacccgatttttaatggttgtatattaatgccataacattcattcgatatgaatgtaaatgggatatattgttcatttaaatgatgcattataataaactttttattcccagtaactatcgattctaaattaccggataataatgaccaaaaatataatgaattagcttcaactaataatattttcgtaggaggatgataccaaatcgatttaattcggccatcatgtcctgtcattatacgtttactttgtaattcatttaagtttatcaatgacaatacattatttcttgtacgaaatattacacaattatcaatttcggtattcgtttgatattttactcgtaaaattgatacgactggcattgtgaattgacaaaaacttgcttttaattcaaacgattctaaatcgaatataaagactaaacaatcatcaccagaagtaattaaataattctttgttgaacacattgatactactctgccattatgttttgtagttatataaaagttcttcgatggatgaatccttcgaatatgaatttctccattttctgatccttctgctaatgctataatgttatcattcttcatgataaaacattgcgctgttattggattattatttttaataaacgcgttttgatgtattgaacattctttaaaattatgtgatgaaatacatataatatcatcaaaccctaagacaatgttatctttaaaacctgtaatgatcggttgatctaatggtgatgatgttacattgataatgttatctggcttcataacagtagctttacttgtttggatttgattgattttggtggataatgagtcaggtataatgttctctttgattaaatcaatgtttggatcttgtggattagaaaatggatttaataaatcatcaatctcattgaccatgttggaatacgtttgatccatacattcggttttactacgtaattgatcaggattacgtattaatgatgaaacaatgtcaatatgtgtgtacgtagattgagatttatgaacattgtaaactgacaaatgtccattcatctcaatcaaggcaaatttggtggtgtttatccatatgcattggataataggtgagtcagtgtcactatgatatgatgggaaatgttgatatttcaaatcaatgagataaaatgattgtggacagatcgctaaaagataagaaaaatcgggcgaaggcgttgctgagataaagtcattgttctcaggtggagttataagacggattttttgtgtatttgtgaaattcggaaacttggtggaatatgtagcacaaccattggaatcaaatgtaaaaagccattctgtgcattgagtaacataaaatgaaatacagacaacaaaactggaggatggatgaatcatttgggttattgaaccatcacttaaattaacaataaaaataggcgcaaatgctccagaaactattgcaaagtctacgcataattcagaaattgtcatcctttgacatccattcggtaaaattcgatcaaatttacggatacaaattccatcaacaacactccacacacaaattgtaccatcaaaagataaggatgcgactccacatttgataattggaatcttgcaatttgcaaattgaacaatttttgttctatgtccaaatgagcatgaaattggcatttctctgtcatgtaaaataaaaaaccttgctatttccccataatatgatcctgcaaaaattattccttcaatatcttctttgaaatcatatgcttctgtggtaatattactaatttcacacacatgtagggctgaaatgttgaattttaatggcttcaaacgtttccaatcaacgagggaaacacttagatcaggaacagcccacataaatttttagggtacccccattaacatgtttagaatttatccaaacaaacttaggcaattccagacaaacaaaaaaaaatggaaaacatcatcaacgaaaagattgatgaaatggaaatcaagacaaaaaaggttgaaatcagattaaacaactatttgaaaagaaatagtttaccaatttatacaaattctaaaattgtaaagaaatcaaataagacatgttccagatatttatcagcttttgcagtactgctgattgtcgtacttgttgttattgccagaaactttttgaacttcgatagatttatttattaaatattagattttaaaaaaatcagtttttattttcaagatatgctttcagcttctgtaattttaaagaaagaatatttaaagcgtataaatttatttcatttttgaattaattgtgtacttttatatacattcatttttttaaataaaaagtagcttgagttgtgatttgttagcaagcaaaatgagtttgttttttttcataacttatgaggaggagatttttaactcggttcgagtaaaataagaaaatcctatcgtcattgaaagtatgaacatttttttatagaatcatattcacaagccaaaaatggtcgaagctccaattgataaatcaaagatacaataccgtagatataaaggagaggaagaaatccaagcaatattcaaaataattgatgaagagttatcagaaccatacggtctttttacttatcgttatttcatggattgttgcccacaacattgtttagttgctacatataacgatgaaattgtcggtactataataggaagagaaacacccaaagaaaactttaaaaaaggatacattgcaatgcttgttgttcttaaacaataccgtaaatgcggcattggaagaaaccttgctgtccaacttatcaatgaaatgaagaaaacatgcaaagttgtatcattggatgctgaatatgataatgttccagctcttcatctttatgaatcattaggttttgtaagaacaaaacgtcttttcaggtattatcttaatggcaaccaagcatatcgtttgaaaatatggttcccataaaaaaatgagtaaaactaataatgtgataattcacaaataaaaaatgttttttaagctctcatatagtttaagagaaggttgtaatcatatgttccgttgtcttgatcaaatgcacgagttaatgtgatcgctgcgtgtggcgtaatttgagggacaaaactattaaaaattgatttagcttcatcaacactaacaataccagtctttcttttatcgtattcttcaaaaagtgctcgaatgctttttgtactttgctgacaaattgtagttaatttctcaactataagtgtgatgtttgcctcagggaaatcatcagggtttgcttccataaggttgaatgtatgaggtgcagcatcaattaattcaaaaacgcgaccagatacatggatcttggctccaacataaaatgatgaagcatcaaagaactgattagtaactggatccctaaggcgtgttctttgaaggaatttaccagctctaaatccagaattaggaacttccatttcaaaaacagcaattgttttatcataaagataaaatgatacaacaaacttacgtctaagatcttcagggtacctagattgcattttcgcagagaagtttaaaacttgagttctttcgtcatccattggttaatttgaactttaacgtattttttacacattctattcaataaaattatcttaaccaaattttgttttcttattttttatgagcaatctccataatttcaataatttttgggctttagaattaaaaacagatgtttaaataatatatatatatatatatatatatatatatatatagaattaatataattttttttagttttcattctgtttttaagttatacaagactttcaatattaatagaccagagcaagttcaaaaatctgtctttgcaattttttataattcatttgttctataaataggatgattcttgaaacaatttattcatttttggtagttaagcatttttactttgattcacaataattatcacatatccatttttactatagtttgcagcttttgatttgagtgttagcgtttatagaactcgtacgagcacgttcaatgaagtgcaacatgttatattaatttcatgttagcttcaaataacataaatctattaaattgttattgaacacataaattaagaaaaacatgatttacttgttcttggcgcatatgtagaaatcagaacaaaaatttaacatattaaaaataatccatacaaaaaaaatttattaatattatgaaataaattaaaacaaattaatattggctgtattacacagagtgaataagaataaaaacaaatatttttctaaatcaacaaattaatgaatatcatctaataccaatccatcatcttcttcaattgtaccagttggagcacgattaagagataaataaccaaattggaatttaaagaagcttctctgatacttagaaattagtattagctgataaattccaaatacaaagaattctaaaaaatgtataattatcattcctataattacaataaagtcaaaagcacttctggtttcaacaaaaaatatccataaaaaatctaagattatcattggtattgctgttaaaattaaaaatgcaacaaataacggaacattcccagtattaaatcctcttgaaattaagagtctaaagaattctacgactgaaaataatataaatgttaataaaaatgtttcatcattaaatcttacgaagagtaggcaaaaaaagatcacgaatattgcagcaaaatatattttgttgatggtgatgatttcttgtaagaagacaagtcttggatcaccaccaaagagcttcattgaaatcccagttctgattgtacgttaaaaaaattctatcgtttataaacgttcgatctaattctgattgattctcgcatcctttttatgaacatcaatacatatatggactttatatgaaattattcattttgctttttcaaccaaataagttttaaaaaaagtttattatcagaaaacgagtgattaaatgattcacttgcttaaaattaaaatgaaaataaaaaggcaatattttattcagtctttttgttttcatggttaccaatgatgattgtgtgttgtgggtagtcattcttaataagaaggattttcaagaacaatgaaaaaactgtgatatattggaatacagcgccaaggctgtacattcgcttagatttcctgaaaacttggatgagaataagataagaaattgcaatcagaaatgaaatatatggaagtgcaaatgaaaatgatttgactttgatgcctgcctttcgagcgagaatatcagtgattataaagtatattaaaattgttaaaaagaatacatttgctgaatgaatgtgtatgtaaaaatgatctttaagtgtaacatttgctattgttgctaagctaatacatattacaggaatcatgcatgatgtaatgctaagaaggatgcttttcttgttcatgcaactacgaataattttttgacgaaggctgaacaaaataaaaccaacaaacgctgtaatattcattcctattacaaaaattctgctttgaggaaagctattaacagtttctgatattgtctttattgggaacaaattgtgtttagaataaaaaatgacccaacttattatgattgatgaggacgcaaatattgttacaaagtaatataatgggttaagtgatttaatatttactgttataggcatttgaaatttggcagaaaatagatttggagcaccccaatagaaaaattgatcgttcggccaaacaacggttcgttccaaatttttaattcaaaatgtgttacataatctttacaaacacatgtaaaagggaatcagaagtttagatttgatgttagttaattatagttttattatgatagactataaaattcatgatttcactttttgtaagggaaacatcacatgatatttttcttctgaataactgcctaatcctgtgttgcccatatacttttcccaacggcctcttacaacgtaggtcccatcaccgtgagaatgcattttatattcagcgctttcaagtgccccattgattttgactaaaagatgatcaagcaattttttgacgatcgaaaagcacggaaaaagccattttcaacggttaataatatgaaaaagtaaatctttttgataaaaatgccggctcctctcaaaatggcagacgtttgtgtcaaaaatgacgttgaaccgcatattattatcaaaaagtgaaaacatcaaaaatttgataacttgtttgtcaattatttcaaattttgaataattagaaatggttgaattataattcaattgatatggcatttttttcctacctaaaacacagttaaagccatttatcagttcacaaatcaaatgttcttcctccttattgtttgttctttatcagatttccaacgtattgttttcacaaagaatcttgatgaatgcaaacctgaaatacgagaagaagaattgaagttggattgcacaagtatatcatctgaaattttttgtgataactatatcgaatatcttaaagtatcaaacgataacactgtttgcgaatttgataattcaaagctctcaaagattgagagtttggtaaaatcggattttgtatcaataattccgatgtactcatattcggaggaaattggtgacttttcaagtatttctggaaaacatagtgtatggattggatcatctaatggtacctttgccagtgctgatgtttcaaattcaattccacttcttgttttcgaagggtctcgttataaatttaaagggaaattcaagggcgatcacatagtattttataatcttaattctcattcatttaacataaatgatattgaagcaaatcatatttatagtgatgatctttctttaattaaagcatctaatgcaaaagaaaaaacatacattgtgggaaaactcgaaaagattgtagttagcgacgatacttatacaatacacactccaggaggatttacggatacattatcatcagatatttcgattatggtagatccatatcccatatcatcatataatattgaaattgaacaagaaaaaggaataagttctgctaaaacattaaaaatattatttgaagaaccagaaatagcatttaattctaatctttatggtaattcatatatacttgagaaaggagataaaattaaagatattgacaaactcattgaagcaaaagttggatttgattttaaaggtgattgggataatttaaaggattttaagttggatttaacaatttatacatcaagtaaagataaaatcgatacttctggcattccaaattctgtttcatatgaaataaaagaagatgacacatttgggaaagcagataatggcttatcgaaaggtataatagctgtcattgtcgtagttgttgttgttgttgtaataattattgttgttgtcattattatcgtcattaaaaagaagaagaagcagagttcaagttaaataccttaaataaaaactgaattcattttaattgttaaacaaaaagatagtatttgaataataaattacagaagtacattctgaaatgaggttaaccaaagttggcaaatacttggaaatgataaaaaataaattaatgtgatacatatattactacaatgtatgaaatgtgtgatttcagtatgaatctcgaaaatgtaataatattctcagaaaagattttactgttaaaaaaatatttatttaataaattctataagaaaataacaattgtttaattacaaaatatttatttcaaacgcaaaacacattgttttaatatacaaattactatatatcttaaatttctatgatcgaagtaatataacaaaactacttcaactcctaaatttatttaatccattgatcatcatcttcatccataatttctgcgataccattggtagtctcattaacttcgcttatttgatctgatggacattgttctttatttgataatgaatgtgtttcataatgttttttgtgcttaatgacaaaatatgtaaatcctataatcagtaaaacaactgcaaatgatccacatattattccaattaatactttaataggaagcgattcgttttgttgggggttgattttaatcattgtataaaaattagaataaaaatgataaagtgaagaataataaataattgtatattcatatgaaataatatacgttggataataataatattgagagttatttaatgaaattgttatagtacttatgtattttgcaaaaaaagaaatatgttcagtaactgaaaacgaatttatcaaaacaaaagaatgtgtaattgtcatgtcatttgatagcgaagcagtaaatgtgtttgacttagtaaaagtattactttggataaatgaatttgatcttgaaaatgtatttgattttgaaaatgttttagaaaatgtatttgaatatgaaaatgtttgtgttggccaaggaagacattcatcaattgttattcctttggaaacatttaaaccgccaaaagtttcatttgaatatgtttcctttgtcatcactgatttagctgcaattccaacaaaagtatttcaccataaaaataaatacatttaagagagaaacatgatgaaaatgcatcagagccaattgaatcaacattttctccaataaaaattgtttcaaccgaaatacaatttcgaaatgaatattgttcaatataagtaattgaatttggaatatgaaatgtttttgttgaatttccaattggataaagaattagttttgtaatatttttattgtataaaacgccatcattttcataattagaaaaatataaattttcttctgaaactttaataaattgaagacttctgcaattttcaaatgaacttgatgacattgaagaaacagaacttggaatatatatgtttttcaaatttatacaatctgagaaagcactttgtccaatagaagttaatgattttggaaatgtgatttgagtcatttggcatttataaaacgcttgtaaacctatttctgttaaatttgctccaaattcgactgtttccaatttagaacaattacaaaatgacatcattccaattgtttttactgaatcaccaatttgtacatatgataataaaggccataagtagaaagcaaaatcaccaacttcttcaacgccattaattacaacatgctcagtaacatccttataatcacatgtaaattcacttggttgagttatattaagtgtttttgttgaattattaaatgtttgcgacgtattaatgaaaaatataaaaattaaaaatgaaataatatgtttatctttgctataggtatatttaataaaataatttcctgctaaactattaaaagtaaagaaaataattacaaaatcatatgaaacgatggttaaaaatattatcactttggaagaaaaaatatttgaaactgctattgaaaaagaatgtaagaatccattagcttttggattatgaaacttgtgtaaattatctgataaaaatgcattaaaaaataataatttttccaaaaaattgatattatgataatactttactgttttaatgtgttctatgtgtttttctgttgattgtataatagatataatattaatatgatgaattccttttatgctttgaagattagttccttttttgtccataattaaatgaatgtcatgtaacagatgttgaactatacctacgaacatcgttactatcaacaattgaagatacttagagtatatcatgctttttttttctttatgactttcttgaattaacccaatttgttctgaatttttctgttgttatcctaggatttaacgcagttattcacaaatatttgtgagaatgccgattattttcaatgtaaattttgtgcaaacgatcttggcaatggagtcaataaccggaatcgtttggtgcaaaacagaaattgttaatgaagttaaatcgtggattgtatcacaatttaataacattatatggacttatctaaagccaactctcacaggaccaatatcatcaacttctttttcgcgtttaaattttgggattattgatagtggtgatatacaagacgaggaatgtgtaacaaaagtacttatgtcattgtgcaaagcctaccctgatattacattcaaaattaaaacagcagaaggtgattttttaatgtttgaaacagctcaactcgtcgatgaatcagtcacaattcctgatcaaacttctgttgttcataacggggagttacatcatgtcgatgattcgatttcatcatttccagatcttcctatgcatctgaacgacgaaacaaagttcgaatccaaagtacaaacagcatttcaagcgtttatatcacagattaattccacaaatttttatcaatacaaaaatttattcattccagaagatctcaagaaactacttatatatgatcccaaactcatctccaccatcatacgtaagtccagtttttccaagagcgttgactttcggcgatatacatattgtgagcattcgatcaaatttcggaagtatcaatttgcgtatttagattctatggatgtcagagttcctcgatcatttggattgctttgtccaacccaaaatcggtcgcttcgttacattcgtttttcatttcttcttacagtcggatatcataacagcgaagaagaactttcgaatgaaataaaacgatcgcaaaacataaaaacggaagaaacgcaacatgaagatgatgacgaaagttggctcaatgatttccaaaagccagagtacagtttcgaagacattgggacgcaaatggctgaacgcgttggtgaattcatgaaagagatttcgcaatttgactctgttgaagcagacggtccgataaactttgatttcgactcgtacaaatcgaaacttgaacatttccttgacagtagtagtgatgaagaggaagaagaagatgactatgaagaagacgaacttttggagcatttggaagacgaagatgagaaaatacttcggaaagtcgccgatgggaagatgaatgcgaacgaatatgtttcgagttttcttgagcagtcttatgaaacgcagccaatcgatagcgggcccactagtgatctgatgcaattatttaaccttcgaaaataacgattttgtgcgtggctgaaattcttttgttgggttatgtattgtaattgttgataaatctttttgctgacgagttataatgttcgctttgtcttcatttggtatggagagaagcatttgattccggaaattgattaacgtatcaaatgttcgacgttgttcttgtgttgtgtatcgcatagttacgtcaatgcattcagattcgcttaatgaaattacatatttaatttgcgtgttccatcctttttcatagagtaatggattatcgatttggttctcatatggatcaagatggataaaccgatctaatgattcgtcccaaaattcaagccaaaacaaccgagcactgacaccagtgactcgaatgatgtaacgaagggatttcaatagggacccaaataaaatattgaattcgagcctatcgccaattggattttcaatgagcgtttgaatttttgtgtagcgaggataacgttcgccagaatgacaagtcgggcagcgtaaaacagacgttataaaggcaccttttccgagttcatccttggttggtaaggaatttttctcaaaaataagagcggtgttgcaacgcttacaattgagtgatgtaactttgtggaaaaattcattggtaaaccaatcaagaatttcttgtacgtgtgaaatgctagagctttcttggaaaaattggcttggaagaattgatgttgtgactgcgttagaataatcatcagaaatatttttgaagtatgtggataaaaaggatattgttttcaaaactttgactgattctggatctagctcagatgattcgtatatgattgagggaaataatttcgatgaataatttttgattgcttgatactcgaaattttcaaaaatttctacattagaaacaaatggattaaaaactactgacaaaacttcagggcaaaaataatgcattttgtctgtatacaatgaataacttggatatgttttttcgaatttaaagtaagaagatatttcatgaaataaatcaaccaatgtcatatgctcaaactcagatggtgaaaactttctggtgagcttcttagatttataagttagagtaacagccctcattttgtggaacgttgaggtgcaaggcagccacttttatgtcaaacaaagttactcaatcagtgaaatcattaaacggtcaaacttcactattgtgaactgaacattaaagaacgttaaaaaaaatttcaagacccaaccaatttttagctttttgcatagtttatttaggtaaaaaatcgaacctgaagtttcgtacatacaaatttgtccttaagaacttagcttaccaaaacaaataaactgttgacaaaaccattggggaatcaggtaaggtaagaatcttgcaatttgtgtttaaaacttttatccaaatcgtaatcaaaatcttaaaacaacaaagttgtgccaactattaatcaagttgaatgtcatccattttgtcaaaagatcgaagccataaagcatatggaagaattgagatacaaataagccattaatcaccaactcccacgatagaaatatagttaagatcatgatcagtgtgattttataaacagataatacagtatttacaatacaagatatcttgtatccaaattgaaattgtaatatatttttgatctgagtttggtcattgatttttcgaaagaattaatgtatcttgaaatgaagtttattcatttatttcacttatttaaaattacaagtaactccaattaataggaatatgctttttgaataaaagttaaaagagacttgtgcttgttcattgaatgaatcttctttatccaaaacgatacactttttgaataccaacgtttgaccaaataagtgactttttatcaatgtttttgtgtgtaacgatacaaattcgtatcaaccaaaaggaggaaaaccatgtttttttggctactgtttcatgcacaaagccaaaaaatataccccacagtaagcataattaatcattcatattggaaccaatatcgcatttgttttcctcctttcaactggtcaatacccaatggaatcaatcaaaaacaacttccattattttgggcacagccagaaaactcaagacatttccgggatactaattccagtgagcattgtggtattgttcgaattgttaaaaatggttcaattaaacttccttttccatcaatttctaatgttacacattttattaatactaatcatcctccatctcattcaaaaacacaacgcttcaataatttgcttatattatctggtcattggggtcattattttcaacatttctttgataacattggccctcaatttggtcttgtttcagttttagacaacataattaatatcagcaataccactgtcataggggatacctcaccattatttccaaatgttccaaaactttggaatcgcatgaacatcaaaaaatttatatcatctcaagacaaaacttacacagcacacaatctcatttacgtagagtcctgtccacgtgttcatccctatttttttagtgtcttacgtgatcaattgttattgcaaatatccaaacccaaatacatcatatttatttcacgtaaaaacaccaactcttattataatcaacgatttattcttaaccaaaacagtattattaatactttaaagtcactttatggaaatcgcgtctttgtatttgaccataagcaacatacattaagtgaaaccatagcaatatttggcaaagcaattgcaataatcggtgcgcatggcggaggtatgtataatcaattctttgccccgaagtcgtgcgttattgttgagataatgcccatcaaagaaaacggtctctatcccgatcaaaattcattcaaagatgttccatcgttctcgcatatgtcggtgtggtctaattccttgttgattggtcaaaagttttacagattctatcaagtaacaaagtaccctaactttagagttgatgtacagaagtttaaacggttcttgatagacatcgaagaaataactccaaataattacccaaatttcgagttgtagaataaatgtattttatatcgatttttgatatttacaaaataaataaaaaccttaatcaggatgaattattcatcaggaatgtgatatacaatgatcggggaattaaaatatgttgaaaaattaaattgcattagtatatgcaagcaaacttgatcgaagaaaactcacgaaatttagatttaattagcaacagttatcatcacagaaaatgaaaaaacaattgaaactttttcgttatctggttgtaataatttaacatttgttcattttacatgttatcaatcaccaactgacataagttataaacaccatcagatttatgtatcaagaggttcatttgttgaagaatgttctcaatatgtttgtccaacacatgcatttactcaatcaaatgcatttattgaatcattacaatctgatgtaacgtatattcaaacattaattttaatacaaacagttatttccaaaaatattttcacaaatacttttactttttgatgtttaaaccattttattctgatgtaaacgaaatttgtttgggcaaacataaccaaactgggcaatcgttttttgctacagacaaaccttgtcaacctaagctattctaacaacctttcttagataaaaaatagatggagcaaaatgtcagattatgaagaaaaaattatgatataagaagctaacaaaatcatataaattattgatttttgtaatttcttcacattttttgagtttcaaattctggtgaatgcagttaagaagaaaaaaattgataaatatcatatgctgaaaaagaaaaagaatcaaagatttatgaataataaataaaacattataattcacatatatgttgaaaggataatagcaaaataaaattggatgggaaaaaagaatgtacattatagcataaggatatttttaataaatggatgcagatttccaacgatagaatcaaatgaatgaaaaatctttatgatcctatttaatcaaaacatttttatttttagagttcatatatcatcccacttaaatctattttaatctcgcaaaatataaagccatcaaaaagcgggagtcttgaaaaagttcgaattattgttcactttttgaatggtttacttggaaattgaatgatttttggtttcggtacacaacactcagatgaaaaaccacatgcctaatgatgggattaccataagcacaggagataaaaagttggaaaatttatcaaccggcttgaaattcctaattaaaattgagaaaaatatattcggtttaaccgaagaaaactttcagccgtccattaaaaaaatattggaattattcgattcaaattatccctttacgtttaataccattataagtaacatcgtttataatgcattttcatcaaaaaagcaagtatttgatatttacttaaattttttaaagaaacttcaaactaaagaagaagaaattaatcaaaacacagttaaattaatagcaatttttatcaaacgtatatctgcagcaaacacacaagaatcatattatttaatagaacaaatgattgaacaaaatttaattgatagaaatataactaaaaacattaaatcaaaatatagggggtggaaaaagtccgttcgtcagcttttttttgatttatattagatattaatgaaatcaaattatataaataaaatttataataaatatattatcattattattataatacttttttccaagtaaatatgatgcatgaagtaaaactactttttttcatgatacctctgaaagaggacgtttaatcattttgatgtcagttccaattgaggaattacgttctgttgtccatttcctttggttagaatcaaatgaaaatcaagacatatataggcgattatgtgctgtatatggtgataatattattacacttcgaacagttcagaaatggacaaaaaagatgaatgaacataccttctcaattttcgaacagaaaaaaacagggagaccaagaagatcggatttcgatcaaagaataaccagttttatattaagttatccatatgcatcgacgaagaaaattgcgaagaatgtaggcgcagatccaaaaacagtgaaaaatataatgattaatattttagggatgaaaaaagttaacttcaaatggatttcacataagttgactccagaaattaaagccaaaagagctgccattgcttctgaattatttgaattcctttctagttcaaatgactactaactaagacacatattgacgcaagatgaaacctggatttattttgttaacgggagaaactcgatgtggattgaatctggagtgcaaaaaccatacaaacccaaacaaactattgcctccaaaaaagtaatgatatctgttatatggtctataactggtatcaaatcaataacaatgctcccgataggccaaaaatttaatcgaatttttttttctgaagttgtacttgaagatttggctaaaagaatttcaacgaagggatattttttgcatatggataacgcccggcctcatttggttcatgaaaaattgaattaattggggattaaaagacttccgcaacccccgttttcgccagacctcgcaccttctgactttttttctgttcggatatctaaaaaaaatgctcgaaggtgaggagtttgaaaatgaagatcaactttttcaaaaggttgaaacattactgtataatattcctaaagacaccttcagagccgtatagaatgaatggatgaacagacttttaattacaattgaaactcaaggtgaatacatatcataataaataaacaaaatttcttttacttttttattcattaaaaaaaaggctgacgaacgcactttttccaccccctatattttgctcattatcaaccaaaagaagaaaaccaaaaccatttttcatttgggtctaatagaaatgatccaaaagaaaaatactttttggaaaattatgaagaactttcaaagaatgattgggagcttcataagaaatatattaaagaaggagttaatccaaatgaaactgcgaaaatcattcgaaatgatgaaatagaaaaacttcaagaaatatcatcacaaataaaatttgattttaaccaaacaatcgaaccatcattttatgaaagatgttcatatattaatgcagaaaatgtatctttaattgattatgcagcattctttggatcaattaaatgttttaaatatttacttgtaaataatgcaaatgtagaaaacacaggtaaatatgcaattgcaggtggaaatgaagaaatcattcatttatgtgaacaaaatcattcatcatttgaaggtgcatataaaacagcaattgaatttcatcaaaatgatatctttaaatatctttatgaaaataaattagaaaaaatacaaccaaagtcaaaaatttctaaagtcacacattatttggtagatttttgtattcaaaaagataattatgaaattttagcatttttggcagaaaaaggaattaatattaatgcttgtaatataaatgaatcagcaagaaatggaaatttatatctcgttaaaaatttccttcaaaataatcaaattccaaaaattattttgccatttgcttcagaatcagaaaatgttgaactcgtgaattatgttttagaacaaaaaggaattgatattaatgcaaaaaatattcatttgaataacttggaatatgttttaattttttgaaatatgttttaataatttgcaacagcacttcatatagcagttagaaataataatatagaaatagtaaaattacttttagataaagaaggaattgatgttaatgcaaaatatattcatttgaataatttggaatatgttttaataattttatatatgttttaataatttaaaatctgtattaataatttgaaacagcacttcatatagcagttagaaataataatatagaaatagtaaaattacttttagataaaggaattgatgttaatgcaaaatatattcatttgaataccttggaatatgttttaataatttggaatatgttttaataatttggaatatgttttaataacttggaatatgttttaataatttggaatatgttttaataatttgaaacagcacttcatatagcagttagaaataataatatagaaatagtaaaattacttttagataaaggaattgatgttaatgaaaaagatattcatttgaataatttagaatatgttttaataattttatatatgttttaataatttataatatgttttaataatttggaatatgttttaataatttgcaacagcacttcatatagcagttagaaataataatatagaaatagtaaaattacttttagataaaggaattgatgttaatgcaaaatatattcatttgaataatttggaatatgttttaataattttatatatgttttaataatttaaaatctgtattaataatttgaaacagcacttcatatagcagttagaaataataatatagaaatagtaaaattacttttagataaaggaattgatgttaatgcaaaatatattcatttgaataacatggaatatgttttgataatttgatatatgttttaatgatttgaaacagtacttcaaattgcacaacaattaggttacacagaaatagtaaatttactccttgaaaaaagtacaaacgaaaattctaattgtctttttcaataaacatcaaatcttcactttcaataagaaatggaaatgaagcatatattgcttagtaaattctttactaaaataaagatgaattttttgatgataatttcaatgattttttgatttacaactatctctgtaaggttatattccacaagagatattgataaaccacagaaaaaataaaccaagataaataattataactgctatcatttactttgaaattctaatcaccataagtagcattcattaattcattattttaatgtatcaacacaaattccaataaattccttattacatttccactacttttaacagatggtatgcagttaatagagtctgtagtagaaatatatttattttcattattttcattatctaattcataagcattaactgctataaatactggttttcctataataaaattatcaatattttcattatattcaataggtgcgttgggtttaattgtcttattcatttgaccatcaccactactgcttataatttcttttctatactgagaattttagtaatgccaaaaactaagctcattttgataggaagcaatcctccaggtatatgttccaggagcttcagtagaattattatgatacaaaatctaaaaatatgcctgttcccaaaacagaattctgatatagcacaatatcatttgggacattcgtatgagttgctggattcaaagtattaggtttatctgtaatatccttataactatgaatatgtccatttaatgagaaaaaactaacatcaatataattaatagaattacaatttatattgccattgtttacattaaaactgatattatcatcgttattattaagtataccaaaatataatgtattaccagaagttcttattccagctataatcactattataatcattactatcatgaaaatcaacacaatctccaatctccattacaccatcactattgatagtagctatacgattatatgttctactagtaataagtttgatgaaacagttaattcttttggggtgttaattaagaaaagtaaacttatagcaatatctgataacgatttattagatttcataaataaatatataagaagagtattgaaatataattctattataaaatttatcaataatgattttaaagaagttaatgaggaatctttttgctcaaaataaagaatatgataaacatattgaacaagcaaaaaatgaatctaaatttgaaaaagaaaattatgaaaaagaattaaagcatggacaggaattagaaaaacaaaactatgaaaaagaacaagctattaagaaagctaaggaagaaaaagaagaatcacgtaaaataaatcaaacaatagagacaaaagactttagaactcaatggtttaaaaaattaatatgttttaaatgaactcaataatcatcgagatattctttcggcatgaattaatgatatgggaatgaatatacagaatataacaagcagctattgaacagagtgatataaaaagacagattaatgaattagaatttaaatatatttagaattagataataaaaagaaagaattacaagaattaaataatagaaatgtcgatgaaacaggattatctcaatcagttaaagttagacatcagaattatttacaaagaatggcaatagatagaatgcaaaaaagaagtgaacttttaaaagaaaatcatgaattaaaattagagtatcaacagatgatattaataaaattgattaaggagaagcaaatagattacaaggaattatttgagataatgaaattaaaacaaggaaattaattatcttgattctgattatgatgtttatgctgaaacagaaaatattaaatatgatgaaaaataaaaaaattctcattcgaaagctaagatttttgaattagagaaaacacaagaagaattggggtaattacccaatgataaagatattaatgaaaatttgaaaaaaatgctgttgatgaacttagaataaaacgaattaatgaattgaatgatagtaaagaaaaagaatatcaatcaaaagttgaattagtgaaaaggaaggcttctagtaatgcttatctaaacgaagactttatcaaattagctaaagaagttgctgagaaagaacagcaagctatgaataatatgtaataaaaagaacaacgagatatattagaaaaagctcgtcgtgaatcaattattttacaatagcagttaaatgcagcaagaactactaataatttaaatgatatatctgttatggctcaaattggatatcatttacagaaattaacaaaattacctaggaaaaggacttgtagaacaaatgattgttttcagacaaaatattataattagatgtaatatgtttggtaaatctggttgggagagctatattattatatattctcaattgagaatcatgattttaacatattttatattggatatgatataactcatgagtttttacaaggtccgaattcagctttgaaacgattgatgaatagttaattaattttttatcttatatagatgtttgcacctcaaaatcaacaacctaatgtaatagatgcatgaacgaacatttagaggactggtataatgcagttgatgaagcactaaagttatcagagattattcctgaaaaatctgaatattctacagcaacattctacgaagatgttggaaaaataaataagagcgatattacttacgtcgatataatcagatcgtttccaaatgattagtttaaataattcatatatcactttagaacaagaaattattattaacgttagtttatagtttatctgacgaagctaaggctggaaatgattgttttgctacaatagataaaataagcaatcatgatccttttgtacatggtgtatattgtgatttttcagcaataactgctagttaaaatatttatgtaaaaattccttgtcgaatctcattattttatttctgattattatttaatataagatatttgagctatatatataatttgagcgtaagtgtttcccattcgttttgagatttctgacttgttgttgctgcttgcttttggttcatcttgaacatataaactactcattaacttagtattggattttgtgaatattcgctttttctaaattttacttgatcggtttcagttaaaaacactttttgaatactttcgatcggtgagtgagcttaaacaaacacggatatcttggatataaattggagatcagtaataaaacattgtttttttctttaatgagtatatgaatattatatataaaattacaacaaatttgaggcgaaatttatgatgatataggggttgcatccaggtacgatcaaaatcaactttttcaatactttcgaaaaaacatgtttttgtatctcacatatttccatgtatataataaattataaaatttattgttgatccaggaaataatactacatggacttcaagtttattatgttgtttccgtataaggtaagcctaaataaatttatcaatataatatataaatcaaattatcgtaattttttgatacaaacattacatggcattatattttatagtgctagaaatcaaataaattaaaacaaaatcaagaaatccacaaaacgaaatgaaaaaaattaagtaagtctgttcaaagacaaaagatacaaataatattgagtgatttataatattatcaaaagattctgacaaaataaagttcttataatttcataatttttatcatttggtgttatatgcaaatgtcttagataatattttaaacatatcaaaaaaaaattttccatacgtacatgaattatgtgaatacaatttttcaacattgttgtaacccgaaatgttttctgaaaatgaacggtctccaaattgaatacttcacactcgggaaaagttgattggtgcatcaattgttggcgacggttacagatcggcaataaattttacggtgtcaaattgacgatagatatacgataaaacgttttgaacatgttcaaaacgttttatcgtatatctatcgtgaaagtgacattggtgtgaaatataattgaattgcttacattggtataaagtattgaaaaggttgaatgacattttgacgtgacgactttttgaatagattttaatcgttgaatattttgttagtcgtgtgtaaactatataaaaagtgaagaaatattgaccgtttatacggataacatatcgggttattacaaacatctctcaacataacatataattattttgatatatttgccatacttttataagttcaaattatatatatatatcataataacaataatttaatcatatactcgttttgtctcatatgtaacatatgaggttggaccaattgaaccttcgactttttgtgcggaaaaatacttccgttactataagactattaatattgaattataaaagtatattctgattattaacggttttggggcggtcgacgaaaatcttccgttctcaacactgtattattgatattttgtattgatgtaggcttttaacctcacggataacctattgaatcactaattataaaaatcgattttttcaaagaatttcatagatttcactatatattatttattttgttgcatcgtcttagttcttagataatatattagattattaaaaatcgttttgtatcaaataaaattaataaataaataatatcctctgttgtatttatgaggttcagcatgcaaaatttgagaaaaatctgcatttgctgcttcatatcggcaacgatagacttcggtctataacggtcgccgatacgatagagtgaaaatcttgaatttaatagttcactcataattaaatagtttacttaattgagcgatttcttagaatttccatacgcaacagttacttagatattcttcctaaaatgaaccaaaatcaaacagcaacaacaaatcagaaatttcaaaacgaatgggaaacacttacagcgctcaaaaaaataatctttggtttgaatatagataatttttctcaatcatcaaattttattatcagcaagttttgtaaagaatatccaatatcttatgatatcattatattccgaatgatatatatatatatcttctgattgatagtaataattttgatatatatttgaaattattgcaagaaattgaaaaatatgaagaaaataataaaatcaacacaaaaataataaatttattttctcaatttctacttaaagaaaacacacaagaatcattttatttacttaattacatgattaagtataatttacttgaatcaaaattcatcaaaaatacatttaatccattttttgttcatattaatcaagataaatcaaatgaatataaatatttatttgatcaagaaaatattgcttatgaagaactttcacaaaatgactttgcacttcataagcaattaattgaagaaggagttaatccaagagaaattgcgaaaataattcgaaatgatgaaatagaaaaacttcaagatatatcatcacaaacaaattttgattttaatcaaacgattaaaccatcactttatgaaagatgttcatttattaatgaagataatgttacattaattgattatgcagcatttttttctgcaattaaatgctttaaatatttacttatgaatggtgcaagtgtagaaaatacaggtaaatatgcaattgcaggtggaaatgaagaaattattcatttatgtgaacaaaatcattcatcatttgaaggtgcatataaaacagcaattaagtttcatctaaataaaatttttaaatatctttatgaaaataaaattgaagatattaataatttgatatttcaaaataatatttggaaattatttaaattattttatacagcacttattttagcatcttataaaggtcatacagaaatagttaaattacttcttgaacaaaaaggaattgatattaatgctaaagaataattagcttaagctaataaaattttggatatctttatcaagaataaaaacctttgcataaatataacaacaacaacaacaacaacaacaacaaaaaaaaagctttttaacaaaaagaaaaaatatttaaatatcaaatttttaatgatttacaactttttgtttctttttgtccttatggttatgggcccatctcacaacgagtaatttcccttcgacaaatttgccattaagctcattcattgcagcgactgcgcttttgtggtccgccatcatgcacaacgcagttccctcctccataagaaatggagacttgacagtgccaaattgcgagaacatgtcggcaagatcgtcgtttgtcttgatgttgacggaagattttcaatatacaaattgtttctataaaaatgtttaaatttttgctgattttgttttgatcttggttttttgaaattattatgaacactattcattgcattaggttgtggattttgctggcgttttgcttgatggttgagtggtccatttgttggaatccttgttgctgatttgaataaaccatttgttgacttggaattgatattgctgggatcctatttgtggatccatcttagatctaagtgtatcatttgctgagatgggtagatattattatagatctttgccaccagattttcgccattggaaacattaataacggttatggacgttaattacaaaagacgataatatcgcactcaacttttatactctcgtaaaaaaagtgacagatgagaatcaaatactttgaagcgcatctacgagaaattgaacaaggagcaaatgcaataaggatgcttaccgaacttgaatcaaaaaaactaagtgatttatttttaacttttgtcgtcgatatagcaaatagaaaagaagaccatatttatcctgtttcatcaaacattgaaacagtcacacagaacgaatcaactaaaattgcaattgaaattccaaatttttcatttgatccatctttaacatatgatgaattaacaaatattggagcttttgaattatcagggaaagatgatgatggaattcctttctctttatctattcctgttttctgttcagatgaatttcatattgaaattttatcaccaattgcaaatcattgagatttcaataaaaatatttatattgttttatactttatcacagtaaataatggttaacctattattttttaatcatcctaaaagcaaaaaatgattaattaagttatcattatttctatagaaacaatgagtcgtataattccaacacttttatgcggtagaaaatgataaatatctaaaaagtaacgaattcagaatttggtatatgttattttaaaagacaaagaaaaacatgttttccatgatatcttcttgaaatctttaggcgctgaaattttgtagaataaattagaatgtaataatagcaaggtgatagtggttataaataaaaaggaaataattcattatttgacgaattctcttacagatttaaattgttcaattttttgaggggcaaattttctaattcaaaatagaaaataatattcaatatttattaatcaagtgttcgagaacgaaaaatattataaaaaggatcgttgattgactctgtcctcactcaacatactccattaacgaccaaagctttccttgactgttcgatttttcattttcgtttagttttaagaatctctacacataaaaaaaattatgaaataaataaatcatttgattgttttaatttttgttatgacttttacttatttaattttttatctaaaccaattcatttgtggtctttcattatgatttgaactttattcgtcaaatattattccttcttgttgtttaagtaaattaattatttcaggatttcttgtcaacataattgcaatttcatattataaaaattaacaccaaattaatcgaacgaatatcgtaacattaaaacaaaagtcaaaagggataaacaattattatcgatattcaaacagatatctttttgctttataagtaattttactatttcgatattattatattgacaagcgaacattaaaggtgtccaaaataataaaaataaattccaataaatttataaaaactgaaaatatttctaataaatttcattttgcgcattaacatttgcacctttttcaagaagtattttaacaacttctgtttgcgcttgacttaaatcaccataaaatgagtcacgattcaacgccgcgttcttagcagcaattttggccattttaattaattgtttctcaaataaaataaacaaatactcaataatgaaaccaaaccaaaagcattataaataaattccaaatatattatattaatatgattcgtatttagatcaactccttgacttttcatgatcttatggatgaaattaggtcccatttcagtaacttttttacatattaacattaatgctgtataaaatacattaaataaattccaaataacattttgaaatttgaaatgatttgaatttattttgtttgctgcatttacatcaatatcttctttcgttaaaagtaattttactatttcaatgttttgattttcacatccatatattaaagctgtataaaataatttcagtaaacttgatattttcatattaaatgtcaaatcattatagtaaatacgtaataaatttaagaaatattacatatattaacatcaatattatcttgttcaagtaataatttaacgatattaacaaaatctttttgtgatgcataaattaacggagtattaaatttttattataaataccaaaacatttaaaaaaactaaaaatttaataaaattaacacaaaattatattaacaaatattttggacattacaatctacattttgatgctcgagtattaatttcataactaccattttgtgcagcaacaattaaaactgtttcaattaatatatgaaaactccgaatattatgattaaatactttataaattaaataaatatcaaaaattttgggtttacatttcgaatattaacatcaatatctttttgttcaagaagtattttagctacatcaaaactattcttagccgaagcttccattaaagcagtccaaaacaaattaaataaatcccaaatttcaagtttatacataaaaagattcaaattaatatcaatatattataacaaatacttcttgaattaatatcgattccttcttttgataaaagtaattttactatttcgatgttattatttgttgatgctttcattaaagctgtccaaagattcccataaaaacaccaaatttattatattatacattatattattcaaattaacttcaaattgtgtatcaaaacgtttttcatattaacatcaattttttcattattcaaaagtaatttaacaatttcattgttattattctcaatagaatacattaaagaagtccaacataacaaaaacaattttcaaattatattataaaaatttaaatatgcatataatatattatcataagaattaacatttatgttttcttggtcaagaagaagttttaatatgttaatgtttttattttttgttgcaattattaaagctgtttcaaatatatttaatcaattccaaataataaatttaaactaaaaattatcaagttaatcattaagttaatattaaagtaatattttgtgcattaatatcaatgcttttatgctcaagaaatagtttaacaacatcaaaactattattttttactgctattaaaagaggagttgcaaataaaatgaacaaattccaaaaattttacttaaacgtcaaataaaatttataattttttcttatattcatatcaatgttcttattttctaaaagcattttaataatttcattttgattattcatacaagcaaacaataaagccgaataaaattattttaataaactccatataattaataaaaacattaaatcattcgaagttacaactttagcattaatatcaatttcttctttttcaaggaataatttaacaatttctttatgaccttcaataattgctatcattaaagcagtataaaaacattgaaataaacaccaaattataatatcaaattttatgttaatattaaaaatatttttagcattaatatcaatatctttttgttgaagaagtaattttactacttcaatgttattcttcataacagcaaacattaatggtgtgaaaaatattttgaataaataccaaaaaacttgttaaaacagaaaattattaaaattaatataaaataaatcaaataaagatctctcttattaacatcatctcctttttcaagaagtaatttaacaatttcgacataaccattttgatttgaatttggaactaataatttaataaatttaaatgaatttttttatcagatgttttataaattttatcttcaatgaaaccagtattaattggtgtacctttagcacatgcataaataagtgctgtaaaaagaaaacttaataaattccaaaaattatatttggtcacaaaaacattaaaagaaactaaaaatattataatacaacatcaactgttttaatatcaatttctttctcaagaaatgattttattatattaatattaccacgagtgcatgcaataaggaacgctgttaggaataattaaaatatgttccaaatattaatttgatatatcaaatatataaaatttacacaaataaaaataaataaacgttttttatatgtacattaattccttcttgttcaagaagtaatttaactatttctgtacaaccattaaaagatgcattcataagtgctgtttcaaataatttaaataatttccaaatattattttgaaatactaaattattaatataaattttaaacaaaacaaataaatatctttagcattggtatcaattccttcttgttcaagaagtaatttaactatttctgtatgaccatttgaagatgctaatgtaagtgctgtatcaaataatttaaataatttccaaacattattttgaaatagaaaattattaaaataaatattaaataaaacaaataaatatctttagcattaatatcaattccttcttgttcaagaagtaatgaaactatttctgtatgacctttccaagatgcccaaataagtgccgaaaaaataatttaaataatttccaaatattattttgaaatagaaaattattaaaataaatataaaataaaacaaataaatatctttagcattaatatcaattcctttttgttcaagaagtaatttaacgatttctatatgaccgtaattagatgcaaaaataagtgctgtttgaaataattaaaataattttcgaatattattttgaaatattaaattattaaaataaatatcaaataaaacaaataaatatctttagcattaatatcaattccttcttgttcaagaagtaatttaacgatttctatatgaccgtaattagatgcaaaaataagtgctgtataaaataatttaaataatttccaaatattattttgaaatatcaaattattaaaataaattttaaataaaataaataaatatctttagcattaatatcaattccttcttgttcaagaagtaatttaactatttctgtatgacctttttgagatgctctcataagtgctgtccaaaataatttaaataatttccaaatattattttgaaatatcaaattattaaaataaatattaaataaaacaaacaaatatctttaacattaatatcaattcctttttgttctaaagcaaattgaacactttctatattacccgattgtgaaaaattgactaaaagattttttggaaattgatgatttcgtagtaaatatttaactaataataagtttccttcttttgatgaattttttataatagaatcatccatatgtattccttcttcttcattgaaaaatgaaaaaatttcatagtttccactacttatacaagtttcgcataatattttcagcttttctgctcttatctcatcaggagacttcatattcttttgtatattcattggttgattcataaaattaccaaataacccaaaaacaggcaacttatttccaaacattgaaaattgatttgttggaacttgtttcggttcttcttgatcaagtttttcgattttattattataaatatatttaaagatatcatttttgtggaattttattgctgtttcacatgcgccatcaaatgaacaattgttttgttcgcacattttaattatttcaatgtttccacttgcaacggcatatttcccgacgtttgtagttttagctccattcaaaagcaaatatttgaagcattttattgatccaaaaaatgctgcataatcaattaatgaaacatttatttgattaatgaatgaacatctttcataaagtgatggatcaattgtttggttaaaatcaaaatttggatgtgatgatatttcttgaagtttttctatttcgtcatttcgaattatctttgtaatttcattcggattatgtccttcttcaattaatttcttatgaagttcccaatcatttgctttaagtttttcaatatttgcatcgaatattttttcgatcttcgtaagcgtaggatctctgttgaatacagttgattttattttgttacgatgtataaaataagatgagcatatggatttagatttattttcgtcaattatccctttgctaatcattttctcaactaaataaagttgttcttgtgtataaggagacttgtaaattaaatagttagaaaatatttttaagattttagctttatcattatctttgtttatttgctcttcttttgattggagtgattctaaatatttgaaatatatgtcactaacacatttggttgaaacaaatgaagaataaactaatatagatatggcaacattatatgaatagataaaatcgggttcaataagtttcattgtttcttcaactgaagcattaagattttcttcatttaatttaaatatgatttgagtgattgcaattagcttttgcatctcagtggattgattgttagctccttccatgaacaaaaagtaaaactaaccgaccaaggcaccacttttctatagaaatattctgttgcttttgtatggagaactcctttgtgttgtgctatcgtttctaaaacagttcatttgttgattcacaccttgcattgaaatatttcaaaaatattgtttaaacaaacgaattcatacaaaaaagcataaaaaccgttattttcagagcatcgtttactatcattggaattccaatgattcattcaattctattgcaatttgcaacatgataaaaatcaaaatagtgaaacaccatagatcaagattgcatgtgagtcaatataacaacggatttcaaacttcaaaattcaatttcttcagtataaaatagtttaagaattgataggaaatataataaatttttttaatcatgttactgcaatataatcgcaagctaaaagatagataattttaatttgtaattttgtttattgaacttcatcaccaaagaactaagaagtaaatactatgcttctacattaatatattgatgaaaaaagaaaaatttaaaaaaaattactttgttttatatgtttcactttttattggttgtgtattcttctttgaagtcatttgcaaatggatcttcttcaatgttttcgagtgatgttgttccgatgtatttatttatttctgtttcattttgttcgctattttctgaactttgttcaacattttgtttcttttttcgcactaagatgataacaagaacaacaaaacaactacaattattgcaatcacaactccaacactaatgtaaatatttgttttattattatttatatcattatcatcagtaaaaagtgtaaaaaaattcgaataaaattggaaatatgttgaataaattattacattatattcataataaataatatttgtataaatgcacgtaaatgtcgaggcaatcgaagaaagaagaagtgtatttatatttgtaattgtgaaaaaagaaaatgtttgtgtatatgaaaaagttaaaacaattgaagaagtacaactcaaaaaagtttctgcatattcatgtatattactttgtgtgaagaaagtatttgatttcgtatatgtattactttgcataaatgtgtgtgatttagtaaataaatttgggttggtaaatgtgatactttgtgtgaatgtaagcgttgagattggattacatccttttgatatggcatctttaactacttgtaatgtatcaaatgtttcattgcctgtgtaagttggtatcaccataactgtatttattgaaaaatacattgttgccaagagttggctctgttttgccataaaaataaatacatttcatactagcgcatgatgaaaatgtatttgaggaatacattgttatcataattacatatatcatcaaaagaagtcgaatttttataacctattatacaaacaaacggataatcctaagaataaatgaaaatattatattatatacataaatgtcattttaatcttaaacatcatttgttattattatgtaaagacgtttgttaaatgcattacaataatggcaaaatgttatctttatacatttataaactgcgacaacatatatgtgaattcaagtttaataatgtgatacaaccaaatgaaataaattatgtaattcatttatttacacaattcttcatcaagaacatcgctgtttctaaaaatgaaaatttattattttattaaacacaaaagagtaaaacgttttaattttggctttccatcagatgaaggttaattctcgacattgcacttctcagctgcagacctttcgaagggtttcccaattctatcgcgatcaaatttataatttcgtccgcgtttccatttccgttcaacaagaaatcgaaagttttgttccatatttcattgttccatctttttggacaattttcgacgttattatttaattggatttttgtacaaaagtaatgaaataacaatgcaacattaactctgtcattattcccattgttattattaatgttttcgcaattacagagtataattccttgttcgatccacgaaggattattaatatcaaattctttcgtgagttccaaacttgtgattctatttaataatgtgttcatattaatatttccatgtgataaaaatttctcttcaagatttttgatgatgaaaagcatttgcaatagataaaaatgcgcaatgagttcgtcagttccacgcggtctattatgacaatattcgattacgcgttgaaatgtgccatatttacaatatttggtgatgtataaattatttgatatcagtttaccaaccaaaaaatattgcggatttgtgggcataaatggaattacttcatgtgaaacttgcttaagatggaatgtgctcgaattatttgcgcataaatatgacgaattgctaattttggaaataatattatacgtttcgccgtcaattattatgctatttccgacttcgattctgttatttggtgttgaattctttttaggtaatgataaaaatgaatcatcttcatttgaaatatcccttttctttcttaaggttgatgacgccgaaggcggtgcatcaccaaaatcatattcagcgttttgaaatgaggatttaactggttgaggattatcataattatcaaattggggtttcttttgtaatttgcttttgagtatggacataggcggcggcgcattgaggaaatcatattcgtcactttggaatgagtttttaatcggctgcggttgatcaaagtcatcgtcaaatggaattttggttttttgacttttcttaatttgcgacgagttattaaacgaagttttgtttttaagtattggcgaagctgaagcagcgtcagcaaagtcatattcgttgttttgaaatgcggatttaattggtagcggattatcaaagtcatcatcaaatggaatttttttggatcttttgggcatcggctgcggtgagttatcgaattttgttttgtttttaagtattggtgaagccggagcagcatttaagaaatcatattcatcattttgaagtgcagatttaatcggctgtggattatcgatgtcattattaaatggaattttgctgtttttcttgggtattggttgcagttgaggatcatcaaaatcatcatcaaatggaattttggttctttccttatgcactggctttggctgtggtgagttatcgaattttgttttgtttttaagtattggtgaagctggagcggcatttaagaaatcatactcatcattttgaacattatttttgctttgaaaggcagatttgactggcttagagtcatcaaaaccaaattttctctgtgagacatctccattaaagggttggtttggtacgaatagtggagaatcaatttcatcattgccttgtggtgtaaaatcaactagttcaagaaaatcatattttggaggaactggttgccttgataaaattgatttacaggatacgcccgttgtattgaatacataacttacattgtctaaaacaccaagatcaagaatgggctggcttgaaagacgtatttgcatcctttcaataaatccactgtatactttttgaagaaattcattcggctctacattttgttgttttgctgtttcaaatatatcaagtgaagaaataaagttctgttggtgctcaaatagaattgcaactgttgaataccataaagcatttttatgacctacaccaattgaatgacatgattttaaaatttccaatccaatcgaattttcaaagccagcaacgaatttaacaagtgatattattaaccgattatcatttccaagttctggattatttaataatacatcttttaattgattttgtaaagaaatccattcacgcggaattctattcgatgctggtttggtggaatttatttgagaaattattttggtaaggacaggatttgaaaatagctttagatccatttgagtaacaactatacgtttattattaggggatgaccgtttatttcatttcacaatgcataaacaaaatattcaataagctatctcaaaacaatgtaaacctatgaattataaaattcaagttcttcatcatttgtacaacattcagtttgcttaatggtgtggtcgtactggtagaaatggtgtcgcgttaattttttgatgtaaaatttttaacaaaaaataaacaaaacaatatttaaaaacaattctattcttctgatgcagatatcagccacgaagtccacaaatctctaaacctaaagaacatttttgctccttttctcaagaatccagagattcctttgttttcatctttcatctgattcatttcttcatcagtccaaccgaactcttccttcattacatttatcacttctttgtctccactgaagtatttcactaataactccgaaagtttcgatctttcgtcttcttcttctttatttacattttcttctttttgttttgtcggttcatcgtttttcttattatacatttcattatatttattaacaagtgcttctagctcattttcgaggtcatcaacattcggcaattctttgtttaatgctgagattcgttcgaattcggaacggttacacgataaacgttcttcgagaatagaaatttcggaatcgctagaaaaggtgtcgtttgcggtggattcgaagcgattgagttcattgagaagttgggtataaagtatacgttcttctgttagttcatgttgaagattttcattactttgtgatgatatttcaagctgggattcaagttgttgaattgaagattgaagttcttcattaaggtgaactttggagttgaattcttcttgaagaatttcatgagatcgatttgcagattctttatcaacatgtgataattggtcgctggtgagaagttcagttaaggtggctatgtgagattgaaggtttccattgctttgttgaagttgttgtactttttgctcaatttgagatatttcttgatcaagggttgaaagagaacgaaaagaatcatagagcgaatttagcttgagctgctcttgggagagattttgtatgttttggttgatctcgtttattgaaagatgaagttgtgtaggatcagataaaaaattggttcctgggaagaagttagataattttttcatagcctcataatattgaaacagctgcttattgacagttttaggtgttgatattgagtcagtttcttcttcttcaattgatgaagaacctaataaatctgcttcagagatttcttcttcctcctcttcttcctcttcttcttcatcatcatattcaattgtaattgcatcttggattttttggagaagtcctcgaagcatttattgaaaacgtttattctgtctctctgtgacgatcaaaaccactgaatttgtacttttcaaatttaaatggtttactcaaacatatgcatggtgaagtgatgcttaacgtacggtaagaacgtcataaatttattgcacaaagaagctccaaagattggacaacaaagtttttccaaacacaaatttataagatttattttgttagatttctattatgcaattgtgccttccttatttttcaaaaaatttactgttcgttatagtgatttatctttatttttttctttaaagtgaagtgacattgctttttgttcggcatttaacggtctacattgtattttagaacgatgcgttcaaattggtaaaattaaaaaacgatatgacgacttcacatttccgcacactcaaatgacaagcccgaaaattcttgttcatcttggcgcatcggaaataccgaagcagttccaagaggaatccttagaatgggttaagaaagcagttgaaagaggttacgaagttgccaaaacaggtgccaaagctgttgatattgtagctgaaacaatatgtgttttagaagattgtcctgtttcagatgctggtattggtgctgttttcaatgaagaaggtaaacaccaaatggatgccggaattatgactggtgataagaaatatggagcagttacttgtataactggcgttcgtaatcccattaaagtagctcgcctcatggttgatgatcccaagtactcaattttaacagatgaaggtgccatgcaatttatcaaaaaacacaatattcctcttcttcctgatgaacagttcgaaactcactacaacaggtacattcgtgattcttgccaaggtcatcatgatccacttgatttatttgttattccagaacatggaactgttggatgcgttgtaatggatacatatggtaacattgctgcaggtacttcgacaggtggtacaccattttccccaaagggccgcgttggtgattcatctcttccaggttgtggagtttgggctgacgatgaggatgcctgctgcagctgcactggctatggtgaatcaattcttgtcgaacttcttgctgcaaaaactgcacaacgttctaataatatgtctgcaatgaaagcagctcgtgaatcaatcaaagcatttgcaaagactccaagatctgtaggaggagtgattatgattactaagaaaggagaatatggattataccataatactgtacatatgccttttgcaatgctgaaggaagacggcacaatagtaagtggtctatctgtcagcgaactgggagactttgaatgagtatcctaattagttcgcgaatgaataaaataatagttgaaatggagccataattagttttttgtgtttgaattgaaattgatcgtatacgaaaaacaaaagcaaatacagttacttctctccatattgaagagaaacatgtaaagttttaagccggcagcaacgttagaaatgagtcagatacccttaaagtgcgctgaagaactgtttataagaatcagtcaagttcaaaatggcgaaaaacaagaagacgaacttcacaaaaataaacataataaaaagtataaagcactctttgtttatttaagttgcatctatttccacatatgatacatggaaattgatcgcaaccctgcatctctggacattaggatatgttttttatttattaaagtgatgttcaaagatcatcttttatggttttctctagtttttacttcatcctatttcaaaagaattagaaatatatattggcattaaaatcagataatgctatttaattaatttaattttaatcatattattgatatcaatgcacctagaaataaagctttatttttgaaaataagaagataatcaaaaaatgccaattaagcatttgggtaaaaatattggaataaaagattatttgcataaacacacaaaaaaattaataacattttatacataaaacaaaaaaatttacaaataaaaattacttcgcgatatcttcagatcccttattcaacatatttcttgcttgatcaatcattgaatcaattttatctaatttctctttcaaatcgtccaccaattccaacgcctcattatttctttcgaattctattttatttgcatctctcgacttaacattattattctcaacgttttcgtcgatattatttttttgacttaaatctatttcaagatttaattccttaaacaaataatttaatgaattatatgtatcatttatcgcattttcgacatctttagacaaatcatcaaaatgaagaataccattaaaaatacttgcgatatcacgacatagtatttgcacgtcttgttttattgatgaaattacattaattcgttgcgcactttgtggaataacattagtaaataaatatgaaactgaataattgaagtcacttaacttttgttgaaattgagaaaagttaaattgcggcgtttgatctaataatgcattctttgagagttctgatgcactctttgatatgcgataaatgtgtcctaatgcaccattaactgttttgattggaaatggtggaattggctcagaaaaataatgtgaaaactctgcaaagacttgtgatatatgttgcatcttttgtgacaataaatcaaatagcggatgtgtttttcgagagcttatgtattggaattgttcaacaaatatgtcaaattcttttaatagatttctggcaattcgataaagagtggcggttggtcgaactttcgttggtgattttgatggcataagattattaaacattagccgagaatattgaataaaactattaaatactttttgtgtgattgaaaattggattaaaaaatcatcatcaatttgatctaaataacacgcctttgaaaaccttatagaggcttctgataaataatcccaactatcttgtgatggtcgaagttttaatgttgatgaaaaataatatgaatttgaatcatctgctgttttaattcgacgtggagttggacatgtttgtgcaagttgatttcttggtgatgaaactgtacttttttgccgaatatttaatgttttccctccattcatgttggagttaacgtaaagatatgacatgttacatgaaattcttaatggagaaagtaaattatgttgttgaagatatttctcctgaatggagggctttagccgaacaaatagaagtacctaaaaaagttacatcaaaagagcaaaaaattattccagaaaataatttttcattatcacaaattctttgtgaagattcttcattaagagctattccaatttcacttaataaaacagaagaaatgattcaatttacatcgttattaattgaagaaatcaatcgatgtattacaacattaaaaacagctgagcaaaaacgacgtgaaattgcatcaaatgctgaacttattcatggtgaatgtgattcacaaatggcatctgagcaaagacttacaatttttgttaaatcaatagattccattttacgttattatgatgatttagaaaagatttcacttgattttaagtcaccactttatactgttttaagtccagactttccgacaaatttacaaaagattgagcgcggcatacaattttttgaagcaaatccgaactatcgtgactccaaaatgtttctagtaaaatatcaaatgttacaaaccaagtccgtagaagttattcgtgaacatttaatacttactctatcacgactttcatcacgcatttcacatcaatccgacgaaaccgccatctatgtcaaatatatgagcgttgctccgttaacaaagcgattatttgagcttagtgaacgcacgccaggttttaatgatgtgttatcgatatatcgcgaatcacgtatttcattgcttaagccatttttaagtattcccattacagatccgaaagaaatacgatcacaggcatcaaaaatcctaacatatgtacggaaagaatatgaattatcacgcgaattttttaattttaatggacatccattatatatccgatgtttttgtgatttagtgagtgatattggacaactttttagtgataattgttgttcattaatcttaaaaattaatgatgttcaaacattatgtgagataagtatagtcttaaaaggagatgtgttacaagaagaaatcggaagaattcctttagcttccgaaaagcttcgtaatcatttcttatatatcttaagtgtaacacaagaacgattaatgtttcgaatagaattaatatcgaatgaaaagactattgatgttgataaaactatacaattactttcattaacttattatgcattacctcatgaaacatttaatgagtgtgcatgtaatttaatgaaatcttgtttgaacacattaaatatcgaatcgaaaaggtttaaagaagattcgattgataaatcgattttccttttaaatcattatttaattctaagagataaattaaaaaacttcgattgccaaataattggcactacacatgaaatagattttgaacctttatctgagtttttatggagacttttaaaattcgatccttctgtctataaattaagtggcgaacgcggtctatttaatagtttaagtggtttgtcgagaattgtttcttctacttttgatgttagaaaagaattagaaagtgcaacttcattatgttttaaatctttgacttcttattcaacacaacttttgttgcaacctttgttaaacttaaaattaagaaatggaaaagaaaaagaacaaattttaaacgctttggaaggtgtgaatttggcaattgatgaacactttaaggattgtataggagataaattagaaaaaggaattccaaataaggctcaaaaagatgctgtgtatgatgttctgcattcacatttgaaacaggtcgttttggattgcgtaaattcgttcggaaatattgatgatgacgaattaaaagtacagattaagaaggtgatagagagaattaataaactttaattgtttttcataattaaattgttatttgttgaaatttcttattattggaaatgaatgaacttgttttacaacaaagatatcagaaaattataaacgaaaataacaaactttttatttgcaaaagaaattgatgtaagtgctttaaataaataattatgcatatatgtactagcctacatgtatattttcgggcttaaggaaaagggaaatttggcgtaccctataacgatatcatcatgaaccaaatttggtggtgcctttgtgcggtcagctcactataaataaattctgttggagcacacaccaaactttttttatttttaactgtccacattcttgaggattttttgtgttaaacttttattatacagttccaaacaaggaaaaaatcccactgaccagaaaacacccgtcagaagcggtataccgttgcgacgtacaaacgtgcacaagccaaaagacacctattggcctaagaaaataccgactttgataaaaatttacttataagtgttggccaacagaagaaacccacggcacttttaagctgctgcggttatttcaattgaaattgcgttgtaaaatgtatcgtcgctggcataaaaatttatgtgagaataaaatgacacaatcgattttgtgaatacaaaatgttttaaatcataacatcaaaatatttcgatatttaaaataagctatatgaaatttcatatatattttctaataataaaaacaggatggagtcaactatcgccaaaaaaaaagaaaatttatgctctttgagcgatgttattgatattcattcaattttttttgtgaattaataatttgataaaaaatagaattgaacaggttgaattaatttaagaattagaattatgtttatacagttatattaattaatgaaatctctaatgagatttacattagaaaactcttaaagctgtttacgaaataaatcatttctaaataaatattgaatattatttattaagtattgttttacagatattgcaatcaatatctcgtatcttaataatatagaaattacttcatataatagagtcttatatcgtttgtttcatttgtatcaaaaaaagtcaatcaaagaactggaaataaaacaggagataatcatttttatagtgttaaatgctttcgtgagtatatggtcagagaaattcaatatttttagttttcacacaaattgttacaacaatttgttaatttagaagtcatttttaacttgatccaatactttgaaacagaaaaaggagaactctttatgattgaacattagccataatatattttaaaaatttattcaaagaatcgcgaagttgttacttattcaagataattatttttcatatgacaattccttagatgtatttatttgttttctatttctaagatcagacacatttcaatggcaaatcatcaagtgatatctctgtttatagctcagattgcttcataaaaatccaaaattgtgtttttgataaacatcagaacgagtccatcggcgaacgatacgaaggaaatacagttttttgtgtaaagaatatccaatatcttatgatatcattatattccgaatgatatatatatatcttctgattgatagtaataattttgatatatatttgagattattacaagaaattgaaaaatatgaagaaaataataaaatcaacacaaaaataataaatttattttctcaatttctacttaaagaaaacacacaagaatcattttatttacttaattacatgattaagcataatttacttgaatcaaaattcatcaaaaatacatttaatccattttttgttcatattaatcaagataaatcaaatgaatataaatatttatttgatcaagaaaatattgcttatgaagaactttcacaaaatgactttgcacttcataagcaattaattgaagaaggagttaatccaagagaaattgcgaaaataattcgaaatgatgaaatagaaaaacttcaagatatatcatcacaaacaaattttgattttgatcaaacaattgaaccatcactttatgaaagatgttcatttattaatgaagataatgttacattaattgattatgcagcattctttggttcagttaaatgttttaaatatttacttatgaatggtgtaagtgtagaaaatacaggtaaatatgcagttgcaggtggaaatgaagaaatcattaatttatgtgaacaaaatcgttcatcttttgaaggtgaacaaaatcgttcatcttttgaaggattaaatttcatcgaaatgatatctttaaatatctttatgaaaataaaattgaggatattaataaattaaaaaaattaggagaaaaatgtgtttcatattttaattatgaaatttttacatatttagaaaaagaaggaatgaaaattaataaaaatatcattaataaagcagcaaaaattggaaatatttttcttgtaaaatatttccataaaaataatcaacttccagaaaatattttagtttttgcttcattttcaggaaatgttgaacttgttacctccattttaaagcaaaaaggaattgatattaatgctaaagatatttatatgttttatttaatatttatttcaataattttatatttcaataagagatatttttttaattaacttttatttacggaagtactcccatgattcttaataacccattcaagtctttttattaatgcttcaaacatcatttgaagagcttcaaaagtgacaccttcgaatatgcatataattacattttttgaatcttcttctgaattctttctaaatattattctgaatttatccccacactctttaggtttccctttgtcattccaaaaatcgcatgggcttagatctggtgaataaggtgggtgaggaattctattaagtttttcatctctcaatttttgagtaacaatttgactcattatgaatgggggagtttccatatggacacatatcggccacattgaaataatgtccaaatattattttggaattttaaaatattataaataatattgtaaataatgggtaaatttctttagcattaatgttaattcctttttgttcaagaagtaacttaactatttcaagatatctatttaaaactgcagtatttcaaatatcacaattaaattctaaatttcttttttaaacccaaaaattataatatcaattttgtataatacatatgaatatctttaagtttaaagttaattccttcttgttctataagaaattgaacaattcctatataaccttttatagatgctatcattaatgatgttctaaataatttaacaaaattccaaatattattttgaaatatcaaaacattaaaatatattttaatacaaacaaattaatatctttagcattaatatcaatcccttcttgtttaataatatattgaacaagttcaatatttcctgattctgatgcgaaaactaaaatgtttttcggaatttgattatgttcaagaaaatattcgacaagatataaattaataataaattacctgttttcgctgatacattaattatatattcatcgaatttgatttcttcttctaaaaatgatagaatttcataattaccaatattaatacattgataaatttgttcttggaatttaatatcagataatgtttgagtgttacttatataatatcctaagttttaaatggaattttgtttttaattaaatatgttaataaatgttgttgattgttttgatctagtttttcgattttgtttttataaatatatttaaaaatattcattttgactcatccggaaagatattttttgaaaaggttttaacagtttacatttttcatattctgaaactgattcaacaatgtgattttgcagacgatttttgttgttaagcactgagaaaaatgatgatattttatgttttatatattgaaataaaaaataagtatagagcttttcatactacgacacgttaaaacagaaaggattgtctcaataaaaaatatttttggattgagaatacattggtcattgatttttctatcaactgcttctctatttctagaaaaaaaatctctttataaatatataaatatccgagtaattagacaaaattattatattctaatggaaaaattgaaacatatataaaatctgatgtcaaattattaaaagataacgaaaattaaaatacaagtataagtgattcaataagtgtattttataatttttagtaatatataattatatcacataatcaaacaaatcattataatatttaaaaaaatatacccaaagtaattcacatttataataatatctgtattgcgtaaattatgaaaattgttaaattttatgaaaattaatgataagattagatagtggaatttacgcgaatatttggaatttattacaataatttataacagaacatatgataacttcttaaataggtcagaaagttatacctaaattactttttgcaaaaatcgaattcaatgccaaaagtatttcatattacatgttcaaggggttcgaagtcaaatttgaatgagtgtacgaataaaaatcactcaatcatctcatatcgtatccaaataacaatatcagaataaagcttgctcaagaaaccgtggtattgaattatattcgaaaaaaacagaaaaatcgacattatcacatagaatgtcaaataaattgaaaaatgtgatatatttgaaattcgaaagcacatgagtaatatgagataaaaggaatcgataaatgtatctcgagtcagtattttaaagataatttgcaaattgcatttgtatcgatatttattcaatataattgaacattttgctaaaataggcaaataaaaatatataaaaaaaatcatcaaataaattcaatgatcaaaaattataatgttcagaaaaaaatatttagtttgtgccaagatatttcaagaatgaactcatacagaaactatttaattgattataaattattaatcaggttaaataagtacatcaattaaagattacgaaaattatcacatcattcattttttcaataaattcataaattcaagaaaatcaagatttcatataattatttggaatgaataacaaataacgattttatgaaaaaaaaatataaaatttttgtttcttaacaacttaagaatcatttaatttggctgttgacaaatatattacaatgatgtaaataaataatgtatatattctagaaaatagtaaaattttgataatattcaccatcattcaaattcgctcccatcgtcacttatcgttgttgctatcgtttgatataaaccatgcaaaagtcgattattgtcactttttggaatgaaagaataaatttatctcgtgctaatcatgatattatttctagatttatattaataatagatgtaactatgtatatatattatatattcataatatcaagatcgtaggatgatccctatatacgatgagtggaaattgcaagtcgagtttaatatattaatactatagtattaatagtgatgaaatttcagcgtttttgaaagaaaaagaattaattaattatttgatattcattttaactctcaataatattttcatcttttacaaatttgttcatgtacttatagagtgtaaacataatcattaaaattcaacatatataaatttaattggttggttttaacttaaaaaatcttcattgtaaattcattaaaattttcattttattgttaaggtataaatcatctgttagcaaatataaataacatttacaaatcattgaatatttacaacttaattagaatttttttctttaggtttttcatctaagaaaaaattaaattttgtcatgaaaaaaaatatttattaaaaattaaaaattgcattacctacaaatgctaattcaataaaaattatattttaacgaatcctttatctaagaaatctgttccaaacggatcttcttcgatatgtgaagtttgtacaccagaaaaatcggttattgtttccggctcttcattcgtagcattattcattttacttttgtccacttgagttttttcatattcatataaatacatgtcatcgatgacgaacttttatctttagcatgtttaacaacacaaccaagagtaccaataattattaaaactataagaattggaccacaaatgattcctattaataattctaatgaaattttattattatttgaatcataattatcatttaaataaaaaacagtatagaaatctaaataataactatagaatgtggtgtatgtaataactttataaacataaaatacaaataatgaaacaaaatgtgtgtatgtggtaacgctaaaagaaattgtatctgaattagttaaatatgaatacgaaattattgtttgtgtgactgtcataacataaattaatgtttgggaataactttgacttatagtgacaccatcagaaatattatgtgatgacatttgagcatgagtaaaagcatctgaagaagtgaatgtacttgtcgcaggaaatgtaagtgttggatcaaatgtcatcgacggataaaacgtagatgatggatcaaatgtagatgttggagaatatgtatttgaccctgtaaattttgatgttggtggaggggtacatccttctactgatgaagtaaaaatacctaactgaccaaatgtattattttgatatccgtttgtcaccagaacatttggtgatcctgaaaaaacatattctccgccaaaagttggtgatgtttcaccataaaaataaatacaattaaggctattgcatcgataaaatgcgtaatcaccaataaaatttacattttctccaatggaaattgattccaatgcagaacattcataaaacgcttcatctccaattgattctacatggattggaattattatatattgtaattgatcacagtcataaaacgcttcatctccaattgattctactttagcaatatcaacatttgttaatttagaactttcaaatgcttttggaccaattgatgtaataaattcaggaatgtaatatgttttatctgtttttgcaattggataagaaattatggaataatttatgatatcacaaagaacgccatcatatgaaaaatatttattttcattacctattattacattaatatatgaaagattattacaaacagcaaaaggattatcaccaatatattctactgaacttggaatttctatagaatttataccatgacaataataaaatgcttctgttccaattgatttaagtgttgaaggaaatgttatttcagatatatgataattcccttgaaatgctttatcttcaattgataaaactgtttcaggaaatacaaatgatccattttcaattcctgctggataacatataattttcgttatttcatgatcataaagaaccccatttaatgtacaaaaattagtattatcttcagaaacattaatatattgaagacctttacatgagcaaaatggattaactccaatattagttacgtatgatgtaattgtaacattatacaatgaatcgcaataataaaatgctaaataatcaattgttgtcacacctttaccaaatgttactgattccaatttttcacatgaatcaaatgcacatattccaataattttaactgagtcaggaatcataatgcttacaaatgaagagcaacgtgcaaataaataattttcaagtttttctattttatcaaatggaattaatgttaaattatagcaatatgcaaatgcgtatgttccaattgaagtaactgagcttgaaatagtgatattctttaatgaagtacaatatttaaatgcagaatttccaatggatgttaatgtatctggaaatgaaatattatctaatttactacaatatgaaaatgcattattagaaattgatcccaagctagaaccaaatataacattagctaagtttaagcagctgtcaaaagcataaattccaattgaagtacatgcttcgattccaacaatgcttaataaaggccattcatcaaaagcaaagctagggatgcttgctatttgatctgaaatcacaacatattgagtcagactcatgtagttgtcgctaaagtctacatttgattcgatagtaagtttcccagatgtttcatcaaaagattgaaaagaatactcaacaaaaaaaagaaacatgacaaaatgagaattcttacttccacttaatgtgatgtcaattttaagatgtttggttaaaaaatatatgattatgtagatagttagaattaaaaataaaatcgtgtaattaatgaatttggtttcaaatatgcctgcaatgctagtgcgttttggtgcttcaatattccatggattaagagtatctgaaaaactattcattattggagttttgtaattttcaatagggaaatactgaaaatacacttttggtgcctgcaaacatttgtctcttagatagttttgaagtgaatttcttgggaaaagaagtagatctctatgcatatctcaaaggcagaaacaataacaagtattcgagactgaatctacggtagctatttcacctatgaataagactatgtgcagtgataaatgttatgatattccagtatgtccggaaaatgccaattgctcataggctttgtgaacttcgcaacatacataacagtatagagaatcatatttggtttgtatttattgaggtcagtatgtttactgggatgaagttcttcctcattcgcaacactttgaattcactttttgataaatgacatttgataaattgagtgacttatgatcgtttctataatttttatggacattcctcctccacctcctccaccaagtccatcagttttgcaactcgttcctgatgaagctcttgcaattgaaaagttgtttttagaattaaatgaaaataatctcgaattaatttttcagaaagtttcaaaagtattagaagttccaccaagttgtcctttactctatgaattttatattactcagtgtatttatatggcttattttacgcaaaataaagatgcaaaattatacatttcatttttaaacttgttatcaaatacaaaaaatataagtttttcaaaactacttaaggtattaaccatttatctttacctaaaaaatacaagtgaatcagaatgtcttcttaacgaaatgatcgaccataaaatgataccttcaaatctttattattatttaaaaattataaataaagaaaacaaagaaaatcagaaagaaaatcatatattggagattcttcgaaatgataatttagaagaattacaagaaatgtcaacgcaaaataaatttgacttcaatcaaacaattgaaccatcacattatgaaaaacattcatttgttaatcataaaaatgtttcattaattgatttttgtgcattttataagtcaattaaatgttttaagtttttattaattaatggatcaaatgttaaaaatacattaaaatatgcgattgcaggcggaaatttagaaattattcacttatgcatacaaaataattcgactattagctatgtattagaaacagcaattcaatttcatcgaaatgacgttttttattatttttatgatgaaagaaatcaaaaatttgaagaaagaaaaaacttaatcattagcaaagatttaaatgaattaggaatacaatgcttaaaacacattaattatgaaattttatcttttttagagaaagaaggtttatcaaaattaaatctttcactccaagctggtgcattaagtttgcataatcttccatttatacatatattttatgaaggaaaaatgattaaaaaagaacttttttcccaatttcttggatatggaaatcctatagtagtgaaatggctcatcaaacaaaaaggaattaagattgagaatgtcgatgttaaattacataattctatgtgataaatatttatttaaaatttcattaatttttttgaaaaagcatttttatgggcatcaaagtataatcatgaacaattaattaaatactttttaaaacatggaattgatgtaaatcataaagacattaaattgttttgtttaatatttattttaataattttttatctcaaaataataattggaaattatttaaattatttaaaacagcacttatgaatgcatcttttaatggtcgtacagaaatagttaaattacttcttgaacaagaaggaattgatattaatgctaaaaataatatttatttttattattttatgtttcaaaataatatttggaaattatttaaaatattatggacagcacttatgaatgcatcttttaatggtcatacagaaatagttaaattacttcttgaacaagaaggaattgatattaatgctaaagatatttatttgttttatttaaaatttatttcaataattttatatttcaaaataatatttggaaattatttaaattattttcgacagcacttatgattgcatctgaaaatggtcatacagaaatagttaaattacttcttgaacaaaaagaaattgatattaatgctaaagatatttatatgtattatttaatattttttttaataatttgatatttcaaaataatatttggaaattatttaaattatttcaaacagcacttattagagcatcttataaaggttatacagaaatagttaaattacttcttgaacaagtaggaattgatattaatgctaaaaatatttatttgttttattttatatttattttaataatttaatatttccaaataataattggaaattatttaaattatttcaaacagcacttatgagagcatctcaatttggttatacagaaatagttaaattactacgtgaatacaaaggaaatgatattaaataaatcataattttcagttattattattattaaaaagatatgatttttttgaaaaatacaattcagaagataatgagatctcattcatttcacatttaaacggtcgtttcaaaataataaaaaaagaattttcagataagaaatcaataaaaatgcgaagaataataattatattaataagtgttctcagagagttcctcaaacttcaaatcctgcaatattttttcaacggcagtagattgcaaaaatactctcgttatgaaattttgactgttcaatctttccaaattcgatatgatttcgaccatactttttcgggaattttggaatatttcctatatagtaatattgtatgttagatatgtttattttctaaactattatcttgtatcatttttattgaaatttttgagaaaaagtgaaaatacatgaaaaaaacacacttctccaaggtttatgcaaacgcaactttttatgtgaagtagcgctcgtctttatttatttgtgaataaaagtatttgattattttttaagaatattttttatacaaatttttacgaatgatcaataaactggtgaagtgaaaaatgcagataggataagattatttttcatctgttttttgttctcgattatattttttctcgtttttccttgatattgaatatttctatgaatagcttgtgattatttgttttcgtatttttatcattatcgaatgttttttatttaatttaaatatatttttgtcttttcatcatgaatgtgagaaatttgaagtaatttataatattttacaatattatttgttaaatccatcataattatatcatattttacatattttattttgataaatatcaatcataattaagttaaaaacaacacatgatgtattttcttgtttaattttctgagtcgttaatgaatcagacatcgatcgaatagtactattaaattaataggtttcgagttgatatctttatccttattacctttattcatgaaaaatgatcgatttatcatatttaaattcaggaataccaaatataaatagtgaggcatctgtcaatagtgatttttttatattttatatcatgactatatggtcattcttgaatttttcgtcgaaaaagccaatttgtgaggtgaacgacatgcatgcattgaaacattgaattaagaaaaaccgtgcatattcaaatcacgaattttaattcaaaaagtttactaatgaattttgaattattcaatttttttttttttttggaaaacatgactgaaagaatgaagcataaaaaaaattcagcagtacaaatatatagtcaggctggctcatattaatgaatatagctagctagaaactgtggtattgactaataatcggagaaatagagaaattaacatcattacataggatgacaaatattaagttgtagaatgtaatatattatgagataaaaggaatagataaccgtaactcatattcgttatttaaaaaacatacactaattaaattcgttcataaaattatcaaattagattgaacatttatcgaaaatacgaaaatttaaaaaaaaatgcaattgataaattcaatgatcaaaaatcgtttttttcagaataaacagaaaataatgtatcgtatgtaccaagattttacaagaatatgtacttcaacagaaaatattttattaactattgattatgaaccatgtcgaataagtatagcattaaagtattttgaaagttattacatatatgatatatcatttattttttcattgaattaataaattaatttcaagaaaatcaagatttgatatgcttatttggaataaataacaaatcacgctttcatgaataaatctcaacaattttatttgttgacatatcacaagtaacacttaccaaatttggctgccttcatcaccacaatgatcatggaaaatattaaagcatagaaattcaagacacttttcggatataaataacgtattttttgagaaaatggtaaaaatttggtgttgccatttttttcctttcaaatcccctatcgttcaaaaaccgaatcatcattaatattatttaatattattttttttgttttataagcacataaaatcaaattcgaaacaaatgaaagaccgaaatctacaattgatgaagaatgtgggtgtatttgatattcgatatttggttgagatttctttaataaccgaacagttatagaagcattattcggtttaagaatgaaaatttcgtgggcttaaggagaagttataattaaatgatgaagttgatatggttttttggatataatttaaaaagtttatccacaatatatttagttcaggttccatggatcaactgaatcatagggggaccccataaaccgtttatttttcaaacaaaccttctcaattcacatgccgatcaatttgcatagaagtttagtaaaacccccatccgagcggtttatgactgctagctcaataaattcagaatatgtaacaaaaagatcgataccttttgagaagatcaagtttaaaaatttaaaaaatatttttataggtaggatcctaccttttatatgtccaaaggatttccttgaaaagcgagtaaaaccgttcccagatttacactttttatagaaactttagaaaaattcgtctttctggaatggaaggttttgatgaagacagcggaagttttgaaaagtttgattcagacaaagaagaaatggcctcacgtgtttttacattacttccaacaaaaaaatacagaagcaacaaagtatctcatcaaaaatacaccatattaaccttaattccattattcctctaccaacaatttcgtttttttacaaacttcttttacctagtaataactttattacaatttataccagcattacaagttggtttattattttcgtatgtttcacctttactctttgttttagtcatttcctttatcaaagaaatgtgcgatgaagtacaagtaatgaaacgtgattatgagcttaattcacagaaatatactttaatcacttcagaagggcctactgaaatcaagtctcaagatcttcgcgtaggacatataattgaagtagaagcaggcaaaagggttccagccgatttaattctcctcaaaacctccgaagatgtcggctcagcattcattaaaacagatcaacttgatggcgaaactgattggaagctacgccgatcacttggggttacccaaaactgcgccaatctatttgatcttggtaatattatttttgaagttgagcagccacaaccaaacatatatgagttttcagggcgagtgtattatgatggctcatatcatcctattggcattgaatccacagtttggtgtgatacagtagttgctagtggtaaaattatcggtgttgttacatatacaagtacagaaacaaggtcatcacttaatgcgtcaccgcaaccgataaaaagtaatcacattgaaaaagacatgaacaagtattccataatattatttatattattatttttattatcatttatatccactgttattaatggattttcatccaattttattgttttatttatacgttatgtgatattatattcatatttaataccgatttctatgagagttaatttggatttagctaaaatggtatttgtgttaagaattaaaagagataaagatattgaaggagcgattttacgtaattcttcattagcagaagaattaggtcgaatacattttttgtttactgataaaacaggaacattaacacaaaacgaaatggaatttaagaaacttcaatatgataatataattgcggataaagacactaaagtatctccttgtccattatcatttttagcattatcattatgtcataatgtctctgttactgaagaaggttttcaagcttcttcaccagatgaaatcgcattagttaaacatgtatctaatatcggatacaaacttataaatcgaactgatgatctaattgagattcaacttgaagatggaacaatcgaaagatttaacgttttagcattattaccattttcttctgtctggagtcatatgggaatagttttaaataattcgaaatatggaaatttgttgttcattaaaggttctgatgttagtgtaagtaaaatgtgtccaccaaatgaatggcttgatgaagttgtaggaaatcttgcacgagatggattacgaacattagtatttgcatataagcaattaaatgatgaagaactcgaaacatttttaacagaatttaaagaagcttcacattcgatcattaatcgaagtaataatatcttagaaagtttccaaaagatatcgaaatcaatggaattattaggcgttacaggtgttgaagataaacttcaagaaggagttccagaaacacttgaagcacttaaagcggcaaagattaaagtatggatgttaacaggtgataaatgtgaaacggcaatatgtattgcattatcatcacgtttgttttcacgagattgtgattataaaataatacattcgttaagtgaacttcaaagttatatcgatagtccttatgtaccaccattagtaattgaaggaaaagaatttcaagatattgaagtcgttcctgacttctttataaaagtagcaatgcgttcatctgctattgtaataaatcgttgttctccatcacagaaagagaaagttgtaaaaatggtcatgaaacaaaataaagatttagtttcatgtgctattggcgatggaggtaatgatgtatctatgatacaaacagcttcaatcggtataggcattgtaggtaaagaaggcaaacaagcttctttagctgctgacgtatcgattaataacttttcgcacttgcaaaagatgttgttttggtacggatcgaattgttatagacattcgtcaagattaagtcaagttattattcatagaagtattttgttgacgattgttcaagcgatttattccattctttttaattcgataccaactccggtttatgatgattggagtatggtcggattctcaactgttttcacgagttttcctgtgttttgtcttgtttttgattatttcgtcgatttaaatactgcattatctttccctgagttatatataaaatgtcaaaaaggcagatatttctccttgaaaacatttttgatttgggtttggcttggtatttataatggtttaataataattttctttgtgactaaactttttaagtttaaacttggagtcgatagtcgaagaattcaatctgtttcttatacttctttgatgctgattgaattgattttgattgcaattcaattgaatcattttaatatagtaacaattgctgcagaaataatttctttcgtgttttatgtggtggctgtgttcgtgattccaaaaggttatgatgttaatttcatgataacaggtgagttcgtgtggaaagtattgataataactttggtaggaaatataccattgatatgttatgaaatttattcaaaatgttgttacccttcaaatgaaattagtttaagaacaaataattcaaatttggatggagcttcggcacttttgcttctctaaataattaataaaatgtaagttgttatttaaatttaaaaaaaattaaacaacgaatcagagagtaagggttctgtttcatgaaaatatgattgtaaatacattagtacaaatgattgtgtatagattacattaatttatgaaaatatattcttctttgtaaaattttggaaattgtgagcacaaatttgtgatagttcatttttttgaattaataataatcatccaaaaagtggcattagttaggaagatccttattaattcttcgaataacttacaccaaactcgaaaaaagtgaataataaaagcaatcatccggcacgaaaaaacacatcaccaattgataatggttttggtagaacaatatttttcaattcatcatttgcatcaaacaataatactaacaaacgattaacagtagcaccaccacctataacatcatttgtaaataataataacacaaataataacacgaataaaccattaacagtagcaccaccacctataacatcatttgtaacaaataataacacaaataataatacgaataaaccattaacagtagcaccgccacctataacatcatttgtaacaaataataataacacaaataataacacgaataaaccattaacagtagcaccaccacctataacatcatttgtaacaaataataataacacaaataaaccattaacagtagcaccaccacctataacatcatttgtaaataataataataacacgaataaaccattaacagtagcaccaccacctataacatcatttgtaaataataataataatacgaataataacacgaataaaccattaacagtagcaccgccacctataacatcatttgtaacaaataataataacacaaataataacacgaataaaccattaacagtagcaccaccacctataacatcatttgtaaaaaataataataacacaaataataatacgaataaaccattaacagtagcaccgccacctataacatcatttgtaacaaataataacacaaataataacacgaataaaccattaacagtagcaccgccacctataacatcatatgtaacaaataataataacacaaataaaccattaacagtagcaccaccacctataacatcatttgtaaataataataacacaaataataacacgaataaaccattaacagtagcaccaccacctataacatcatttgtaacaaataataataacacaaataataacacgaataaaccattaacagtagcaccaccacctataacatcatttgtaacaaataataataacacaaataaaccattaacagtagcaccaccacctataacatcatttgtaaataataataataacacaaataataacacgaataaaccattaacagtagcaccaccacctataacatcatttgtaacaaataataataacacaaataataacacgaataaaccattaacagtagcaccgccacctataacatcatttgtaacaaataataataacacaaataaattattaacagtagcaccgccacctataacatcatttgtaaataataataatacgaataataacacgaataaaccattaacagtagcaccaccacctataacatcatttgtaacaaataataataacacgaataaaccattaacagtagcaccgccacctataacatcatttgtaaataataataataacacaaataataacacgaataaaccattaacagtagcaccaccacctataacatcatttgtaaataataataataacacaaataataacacgaataaaccattaacagtagcaccaccacctataacatcatttgtaacaaataataataacacaaataaaccattaacagtagcaccaccacctataacatcatttgtaacaaataataataacacaaataataacacgaataaaccattaacagtagcaccaccacctataacatcatttgtaacaaataataataacacaaataaaccattaacagtagcaccaccacctataacatcatttgtaaataataataatacgaataataacacgaataaaccattaacagtagcaccaccacctataacatcatttgtaaataataataatacgaataataacacgaataaaccattaacagtagcaccaccacctataacatcatttgtaacaaataataataacacaaataataacacgaataaaccattaacagtagcaccaccacctataacatcatttgtaacaaataataataacacaaataataacacgaataaaccattaacagtagcaccaccacctataacatcatttgtaacaaataataataacacaaataataacacgaataaaccattaacagtagcaccaccacctataacatcatttgtaacaaataataataacacaaataaaccattaacagtagcaccaccacctataacatcatttgtaaataataataacacaaataaaccagtaacagtagcaccaccacctataacatcatttgtaaataataataatacgaataataacacgaataaaccattaacagtagcaccaccacctataacatcatttgtaacaaataataataacacgaataataacacgaataaaccattaacagtagcaccgccacctataacatcatatgtaacaaataataataacacaaataaaccattaacagtagcaccaccacctataacatcatttgtaaataataataataacacaaataataacacgaataaaccattaacagtagcaccaccacctataacatcatttgtaacaaataataataacacaaataataacacgaataaaccattaacagtagcaccaccacctataacatcatttgtaacaaataataacacaaataataacacgaataaaccattaacagtagcaccgccacctataacatcatatgtaacaaataataataacacaaataaaccattaacagtagcaccaccacctataacatcatttgtaaataataataatagcacaaataaaccattaacagtagcaccaccacctataacatcatttgtaaataataataatacgaataataacacgaataaaccattaacagtagcaccaccacctataacatcatttgtaacaaataataataacacaaataataacacgaataaaccattaacagtagcaccaccacctataacatcatttgtaacaaataataataacacaaataataacacgaataaaccattaacagtagcaccaccacctataacatcatttgtaacaaataataataacacaaataataacacgaataaaccattaacagtagcaccaccacctataacatcatttgtaacaaataataataacacaaataaaccattaacagtagcaccaccacctataacatcatttgtaaataataataatacgaataataacacgaataaaccattaacagtagcaccaccacctataacatcatttgtaacaaataataataacacaaataaaccattaacagtagcaccaccacctataacatcatttgtaaataataataacacaaataaaccagtaacagtagcaccaccacctataacatcatttgtaaataataataacacaaataaaccattaacagtagcaccaccacctataacatcatttggaacaaataataatacaaacaataattcaaaaataactaaaacaacaacatctccaacaaatggattttcatgcattattattaatgatacagaaaataacaacaaatcccattaaggtttcaccgcaattgaccacttctcctcctatttcatattcattctataagtcaaatgtttcaccaaatgaaaaatcacatttcgcaaaagttaatacaaatgcaatacaacaaaatttatgttctcctctttccatagtatatattccttacccatttgttgtcacatatacatacgggatgccaatgcccgtatatccattttatcctttatatgatgtacaacagtttccacaatatgcatatgcgtatatgccaatatgtctacaaacgcagtctcggcaaagagtttaataaaaacaatttttttttctggttgtaataatgaaaaggaattcagccacattttcaattttatttggattccttgtaatcatatttgaatgaatctgtttcatacttcattctatttataaatgtgtaatcaatatttttaggttttattcaaattttttcatccagaatttaatctaaagtggttgcagaaaggtttcccaacgatagaatcgaatgaatgaaaaatcatcggatttatattcaaaaactgaggtgtttgggaaacctttctgcaaccactttacatatatttatgttgtatttaaaattttgttaatcattatctgcttgcaacaatttgtttggttgataaagggaaatgtatacaataatcttataagatatattactatatttgagataatttctattgttaagaatagacttacaataaaggtctcaatattttcttattttattaacgaacctgtaaaaaagaaaagacgctaaataataatgagtttttgtgtacattttatcatatgatgtattttgaattatttcatcatcataattcaacctaataggcattaacatgtcttgaaaattgcaattcaatttatattctacatataaaactaatgctatttttaatgattcagtacaaaacagaacgcgttttaattttgatataaaaaatggaaaaaatgctgattttatttaacgtggaaaaatattttgttgtggaggaaatatcatttgagggtaaggcatttggccataagggctaaacatttgtccataggggttacacatttgattgtatggaggatttgcattagtgtttgttgttggaacacacgcaatgcatggaacataataatatcctggaatataataaaatggaggtggcattgtcttcactatgttcgacgtggtgttttcgagctctttaaccagttttgaaacatcttctgcatcaagatcaggaaccacattttcaattattttctctaacccttgcttattgtcatcttggggaggatccttctttgcttttttgtgatgggtttcatgccgtaagaactttttctttaattttgatctcgaaaaattattatcgtgattttcagatggttgtcgcccaaagctgaatgattgcggccactctggtgaggtgcttggtgtaaatgatccaaactctaaagaagaattcatatcaaaattatttgatttatttttatcctttgaaattataaaatcaaaagaaggaaaagcgatttttttgggaagtgaggaattactgttttttgaagaaggatctggagttttgttggtatattgttgttgttcatcatttgataatttttcccattcatcataaatggttgcaaaaaattcgcgcatattttcaaagttactttcaccagagtctttttgttcaatgtttttctctttttcttggcgaaatgattctatgccttttcccagaagcattacttgtcacttttctgataatttgcacgtttaaatatttccatgaatcaaaactttcacaaaaaaaagttttgcaaaagttagcaagctaatttaactagttttccaacatatttgactcttactcaaatcgaggatttatcaaaatcaaaaattcaagtttttttgaaaattaaaattttgaatgcattttttaacaagtaagctgaatgcactttttatctcagaatttaatggttttaaatatttaagaaaaaaattgatagtaatcttagttattatccttaggatgaaacaaattctgaatgactcataaaaaaaacttcagcgcacatactgagaaagttaaaacaacatgtttagatgaaaatttttgttgttgaaacgcaaaaaagtcacatgtgatgaggttatttttttgaggtgtaaattgaaagcgagttttggctttttgagaaactttgccgcaatttgtttgagttaaaaatggctatcgcttttttaaaaaactgacacccatattgcaaaaaaactggttttaactttcctcccaaaaccttaaaaagtcaaaaatgcttttccgatattagaatccatcattagatacactatgtttttttaaggtgaaagtatctcttaattgatattatcctcgtggataacttaatcaaatgaaaagtaaaagcacattcactctggtgaagccgcacgcacaaattatggcttgaattttaattattttctatatcataaattaattaaaatttgttattgttaaatttttttgatgtattcctgcatcgccattattgaactcaccaagcgttttgttatgactgagttgacgtaaaatgtatatgttttgcaaaaaatcgcctcgaaatttatctctaaatagaggcgccagaatttatctttttctaattttttgaaaaagttattttattcaactgggtaaccaccaatatttgaattgattcgattcaatatcgacttctatccgataaagggttttctattaaagaatgagcgagcaagagcaaccgaatacaaacaagaaagctcctccaaaggcaactccaccaccagtgcgtccaccaccagcgcgccctcctccaacacgaccaccaccagtacgaccaccttcatcaactccccaagctgaaacagaaagttccgaagatgaaaaaggtgcgcctgtacctacatatctaaaaaatgtaatatccccaattcgtgtaaataatgatttacctcttcctccatatcgtgcaggtttccgtgaacaaattaacaaaaagcaaaaaggcaagggcagtaacaaaaaggcagccaaaaaaggcaaagcaaaagaagaagaatccgaagattcttacatggaagaggacgacttctctgaaaccgattctgatgaagaacaaagcaagccaaagggaaagaaactcgacaaatctagttcaaaaggcaaaatcgaagttaaatcaaagaaatctgattccaaagcaaaggctgatgaagatgacgaagaagccaaatacaaatcaaagaaatcatctgacacagaaactgatgaagaagataagaagaaattaaagactccaaagaagtccaaggaagctgataacgaagaagctaaaaagaaagaaaagaagacgccgaagaagtccgaatctaaagaaaagatagaggaagaaaacgaagataaagctaaatctaagccaaagaaggtatctaagaagacatcagacaatgaggacaatgaagaagctaagccgaaaggaaagaagacgccaaagaagtccgaatctaaagaaaatgtcgaggaagaaaacgaagaaaaagttaagaagccaaagaaggcaccgaagaagacatcagataatgagggacaatgaagaagctaagccgaaaggaaagaagacgccaaagcaatccgaatctaaagaaaatgtcgagggaagaaaacgaagaaaaagttaagaagccaaagaaggcaccgaagaagacatcagataatgaggacaatgaagaagctaagccgaaaggaaagaagacgccaaagaaatccgaatctaaagaaaatgtcgaggaagaaaacgaagaaaaagttaagaagccaaagaaggcaccgaagaagacatcagataatgaggacaatgaagaagctaagccgaaaggaaagaagacgccaaagaagtccgaatctaaagaaaatgtcgaggaagaaaacgaagaaaaagttaagaagccaaagaaggcaccgaagaagacatcagataatgaggacaatgaagaagctaagccgaaaggaaagaagacgccaaagaaatccgaatctaaagaaaatgtcgaggaagaaaacgaagaaaaagtcaagaagccaaagaaggcaccgaagaagacatcagataatgaggacaatgaagaagctaagccgaaaggaaagaagacgccaaagaagtccgaatctaaagaaaatgtcgaggaagaaaacgaagaaaaagttaagaagccaaagaaggcaccaaagaaatctgactccaaagaaaaagtagaagaagataatgaagaagctaagcctaaaggaaagaaagcaccaaagaagacatctgacggtgatgatgaagaaaacgaagaaaaagttaagaagccaaagaaagcatcaaagaaatccgaagccaaagaagaagaagcagttaagccgaagggaaagaaagcgccaaagaaggcgtctgatgatgacgaagataatgaagaaaaggttaaaccaaaaccaaagaaggctccaaagaagtccgagtccaaagaaaaggttgaagaagatgacgaagaagcagttaagcctaagggaaagaaagctccgaagaagacatctgacaacgaagaagataacgaagacaactccaaacccaaagctaagaaagctcccaagaagaccaattccaaatccaaatccaagaagtcacaaaagaacagttctgagaacgaagaagaaagcaaatccttcaaaaaccgtgatgaagaagagtccacatccaagaagtcgcagcgtgccaagaagccaccattacctaaaggcgaagaagacagtgtctccgagaagaggctttccaagaagcgtccgcctaagcgtggcggaaaagttcgcttatctgatacgtcatccgcagaagtatccgctgatgatgaaaagaagaatgcacgaaatattaagaactctaagtcacatcaatcattcattgaacaacgtcatgaagatgacatgacgaagtcgaaacttaaacgcgatacacgttcagtttcaatgtttccaccacaatcgcaacccccatcaggcgaaaacaaaatcatatcgacgaagaaaagtaaaacgcaatcagatgaacgtcttgaagagatatatggcgaaatcgaaaaagaagatgctgaaattgaagttgtatatcaatttaattctaatcctaagaagaacattggccaattatgtaagttctttgataaagatgaatcaccagaatcgattgcatatttaatgcatcatgttgaaggattagtcggagaagttattggtgattatttatcacgaaaagaaaatggcgaaatattacatgcgttctttaatgctattgatcttaagactgatttcattgaagcgatgcgtcgttcattaagtggaccattatatttaccaggcgaagcacaacaaatagatcgcgttgtgcaagcattttcacaatgttatatggaacaaaatccaggcgcgtttaataatgatgaaaatccatacatattatcatttgcgttaattatgttaaattctgatttacataatccgaatgttcaacgacgaatgacatgtcaacaatttattaagaacactaaaggctcattaaataatgacgacattagtgatgaagaattaacgaagatgtataatgcacttaaagagaatccatttaaattctcgaattcatcaaatgaatttatggcattatcagcaccttcacttaaaggttatttacaagttaaaatggccaaaaagttcacaaagttttcgaagaaatatttcgtcttagcgaattcatgtatgtattatttcaaagatgattcacaactaagtaaagatcagccgcaaggaatgatacaattgaccgaagttgaagtaactatggaaaaaggttcagataatgtaattttggtaacaacaactggatcacaaatacaaaatgtttgcttcgaaaaaggtattccaaatatgataccaaacgtgaaaaaggtttacttcaaaacaacagataatgatacgtgtatgaaatggtttataagaatgagaaaatcagtgattatttcatcgttccaggacggtaacccaaatgatgaattcaacgctgaaaacgtctcagatgcataattataatattgattaaagtacgatcgatatatatataatattttcgcatttttttttaattaaaaatgtttttgtttgtgatgttgtggaaaatatattttcaaattaataaaaaaatatttttttttgatttaattaattttaatattcatattatttataaacatggaattaatgtaattaaatatattaattattaatattttgtatttgatttttttttatttttatttttctttttttttttttttttttgttttgttgtttaaattatcaaaatttgtcacattctaagaattaatatgtaatatacgcttgaaaaataaaaatattttttcatcataaatatcccaattggtcggttttgatgctttgatcttcatttcactttgttttcactttttaatagaggcggccagcaactgtaactcaaacagaagaaattctatggcatttcgacatgtaacaaatcatgatgatgatgacgcctggcgtcataaccgttttataattatgtcaaatattgaatgcaaagtattcaaaattacggttgacattagcaacaagtcattaaatgcttggatataactttttcatataaatcgatttaaattgcattaaaaaggattttgagttcacttgaatcaatgttaaaccaatttcaaaatgaagatcttccagcttattggagtttattatctgaaaaagaacaaaatgattatataaaactcaaagaagaaattgaaccattgtcctcacgtgcaacaaaagaaaaattgaaaaatcattttcaaataatgcttgattcaattaaaaaatatgtttttcaacatgatggaaatgatgctattcgttcattagtttgtggtattatatggatatcagatggaatagctatatgtaatagaaatttatctaagttaattggtaaatgcaaatcatctattaacagcgggcttttaaatcttggatataaaaattcatcaatcacaacaaaacatggaacagaattagtgaaattgtttccatttatgaaaggaaattgtgctgaaatgagacaatggacaagtagaataaataaagaagaagcatatcattgtcaagcattattcgcttcatactttgaaaatgatattccacaacaaacagaagaacaatttgatgaaacaaatggtttcttccaaccagatgatggttatgaatttacacaaagtgatgaagaacaatttgcaaatttcaattatggttttgatttcttagatgtttattaaaatgttttttatgcttaatttaatgttttatttttgaaataacagtttgaattttataatgattgtttcctgtaaaattatgtatttaaaacttaagtaacataagatgtgctttgattttcataataaatttttgatttatttgacgaatttattataaagatgtaacttacaaaacagaagtttgcagaaactcatctcaatattaagaaatgtgtaattaaacttattgacttttaagcttcataaataatatttcagcattatttaatcaatagattttaatgttcttaagtttctaaacaaaaaacaaaatgcattgtttaaatatttgctaacaatacgaaacagtgacactttttgtaaaaagccgttataaacatgacacttttaatgtaaatattctaaacgttccaatgaaatgacgctgaacaagatgcacattttcaaaggatgcatataaaaaactgattataaacattgagcaatgttttattgcattcgaattttaatatggcaagaggctatttattttttatgacattaacatcaacgcttaaatgcgaaagttaaaaagtgacgattttgtgagagacctgtaattccaaaaaacagaaatattttcattaataattaatatatcaaaaacatcttattatggtatccattaataatgaatgttatgtataattagcaaaaagatataaaatttattaattaagatttttggaattcttgtccttgttacaacagcacttttgacttttctgaggggtgatgtgtaaaacaaaagcttttttgcctaatctttacggttttattcaaacccaaattttgaattcaaacacctaaaaaattatcaccaaaaatggatgaaaataattctacaaatgaaaacaatatccaaaacgaagtagacgttgttgtacctcaaattccagatgttcctcaacgacctcgattattttttgatgatgccacatctttatatgaagaactttcaacagactccaaagttgacaaagaaacccctttctcatctgatgagtcagactctgacttttgggaagaaacttccacgtcttcagctattaagtcagataatgcttccaaatccgccaatgaaaacagtgaaaaaaagagcaaagttcaattttccaatataaatcccgaatttctttcacccacacgcccttccagtacatcttcagattcatcccgtgtgttagcatttttcccacctcccaacagtcctccacccccacccaatgagtgccctccatctcaacaaaaccaatcagccactcttactcccgatgaaatcatggcatcacttccacctcccgaaatccagcctccaccacccgaaccaaagctatcccctgacgagatcatggccagcattccaccgcctgccactgctcctccaccacccgaaccgaaattgtctcccgatgaaatcatggcgtcacttcctccacccgaaactcagcctcctccgccatcagaacacaagccgaccgccgacgaaatcatggcttcgcttcctcctccagaagtccagcccccgccgcccggcactgtcacgcccgagtccatcatggccgcgcttcctccgccagaagttccgcctcctccgccaactaatcgcgccgagtcgccgaaccagccgcttcttgagatctgggagggagttctggagcggtacaagacgaatccgcacaaaaagcaaaaaatcggacactttgtacgccgcggaatcccaggcgaagtacgaagtgatgtttggcttattctctctcacggaacaattcggaagaggcattctaataagacgattaatgattatcttttgatgccgtcacttgactgttatattgacattcgaaaagattgtaatgagatcacattacccattttaaattatcaagaaatgagtgatgactttaagcattcgttatgtaatgttatgtatagtgttatgcaatatttcaagcatgagatgtgttattattgtgagttattatatgttgcatccatatttgttaaatatatggatgaagaaaatgcgttttattctatgattggcattttaaataatccgaaaatattatataaacatttcttcatgtgtgggtcacgaagaattataatattaaataatgtacttaaagaattacttcgaaaagattataatgaacttatggattatttggatggaaaagatatcgatttatgtgatgtaactaaaaaatggtttttgactgctttccaatctgtacatttatcaagaacattcttgataaggatattggaaggatttatgttgaacggactgaggtttttagtatctgtggcgtatattgtgttgaagattcaccgtaagaaaattttgaaaatcgatgaaagaaatgaaattttgaaattgttggaaaatatcggagaatcgaataaaatggaaaattggaaaaagattataaaagcagctcatagggatatacctaaaaagattttcaatgaattaatgataaaatatacaaatgaaaatgaggaagaataaaataaagaaattagtaaacattggatttaactctttgtgtttgttttaattaactctattactaatttgtagattattcaggatttgatccaagaattgacactcttgttcactttcaagtacaatcataataatgtgtatattattggaaaattcattaattcattataaatttatataaaagcattttttgaatgaagtatagaatcaaatatgaaaaaatgtttattttaaaaaattaaatatcagttgtgctttgttatgacttataatattttttgatgtcagtacaagcttctcctgatttactcataaataaatgaattacatcaatttcgttgttttcaattgcatgcataagtgctgtcttaaatattttaaataatttccaaatattattttgaaatattaaattattaaaataaaaaatatatataacaaataaatatctttaacttttgcatcaattttttcttgttcaagaagtaatttaactatttctgtataacctttttctgatgctatgataagtgctgtttgaaatattttaaataatttccaaatattatcatgaaattttatattattaaaataaatatcatataaaataaaataatgtttttagcattaatatcaattttttcatgttcaagaagtaatataacaatttctttgtaaccatttctagatgctttcataagtgctgtccaaaataatttaaataatttccaaatattattttgaaatatcaaattattaaaataaattttaaataaaacaaataaatatctttagcattaatatcaattccttcttgttcaagaagtaatttaactatttctatacgacctttataagatgcatacataagtgctgtccgaaataatttaaataatttcctaatattattttgaaatccaaaatgattaaaataaatacaaaataaaataaataaatatctttagcattaatatcaattcctttttgttcaagaagtaattgaactatttctgtatttccgctaaaagatgctgatataagtgctgtccactataatttaaataatttctaaatattattttgaatttccaaattattaaaatatattctaaataaaacaaataaatatctttagcattaatatcaattcctttttgttcaagaagtaattgaactatttctgtatgaccattttcagatgctttaataagtgccgttttaaatattttaaataatttccaattataatcctaaaactccaaattattataacattttttaattaatatcaaaatatatcagtttcagaattaatatcaattcctggttgtgcaagaagtgcttttacgatttcagtataaccatggcgtgatgcccaatgaagtgctgtttcattttttttaaataaataccaaatatcataataaaacatcaaaaattgaagaaaaacatgttttgcattgatattaaacattttatatttgatttgccattggataaattctgcgatttcttgaggcatttggtggcatttttttcgaaacaataaaagcacgttaatgatacacataaagtagtcaatactaaaacattaaatttcttaagcaaagaatcaaaaaataatatattaaaatattccattgccacaataaactacaaacgaatcataaaaacaaaaaattattgcgtatcattttataatcaaattaaaattctattgttgtcaaataattgacatttaaattgtctgtgggataatagtataagttggaattgattttccgtctctaattttagtttcacccaattcctgtacattaaatccagcagagaacaccaattcatatacagctcttgtaatatgaatattattaacatgacctgtcaccatcatttgtaatgtcatatccattactgatccaataacttgtaaagatggtcttgagaaactcattacacctgccacaatggggccccccgtgtgcaccccaattttcagatcgtattcaattcccactttttcagaggtcttcttaatttgagacaacaaatcgatacaaaatctaattgactcttcagcgtgtctatcgggcttattaatttcagagaacaaaccgccgatgaaagtgtaagtatgattaaatgaatttgatttacaaagtaaatcatatttttgtatttcttcgtcaaaagtattaaatacgttatcatagaatacaaacggatcaaaattctcattatcattaatttttggaataattgaaatttgaccaatagtcacactttgaacaatgaatgaaattatatcattttcttgttctaaattattaattaatttctcaggtaatactttcgataacattgcagtaatttgcgcttgttcatgttgaagtattctatttctcatgaagatttcagtacaatccgaaaacacaattgcaattgattctatgtccatatattcatgatcaacattcgcagcgcgatctggtgttagacaagaaatgttacaaatgaaatgtccagtttcacctgttttcattttgatggaaatgttttcagtaaattgcggtgatcgtttaccatttaatgcttcatcaatatgttgcaaaagttttccccatgaatcatcattttcttcttgaactattaaatcatttatatacattccttctattttatcgaagttatcataattttggaataagttcataaatgcatcattataatcaacaattacaaattctttgttaatgatgacaacacctttcttaagtttcttaagtataaattctgcattaccataaccatttcttaatctttctttaacttttttgcctgtttcgattaatgtaatagcattttgattacgagaaatttgttcaggtgaaaaatataaataaaactttaatcccatattcattttaaatctttgtaaaacataatatattataattaatatacatgttaatacactccaaactatagctacaattaataagatattattaatcgaatcatatttttggatttcatcattagtataattcttaactaaatatatatatggattaatacgatattccatcataaatgatatatctaaataaactaatgataaatattcttcatcattaactgtaactggatttaatttaccatctgcatgattacctaagaatgttaatgcttgcattaatattaagtcaatactttccgagaatttcgatgatgcaatgttttcaaatggtgatttaatagataaaaatgcattatctggtgaaaaaacatcatcaaatgttggaaacatttttaattgttcatcagtagcttgataaaatatattaatacctgcaatatcactccatacactacttgagaaatatgaaactgaatattgtaaataagtattagcattaagataaaaatatgatctattagtaggcgattgatctaataatggatatatatctatttgtgataatcgatcaagtgcatataatccatttaacataaaagtaaaaggcatatataacgttgatattaaattacctactgttactgcagaacttgtaaataatattgaataataatgtattattaatgtacataccaaaataccaataaatgaaaacaaaaatattatcattattaaaatataattatgagtcttttgattagctccatgattaaatttagaaatatgtgttaaatcatcattagttttatcatcactaccaaattgattaattacattacgtatttcagtattaggaaatgatataaatgattgtgctactgaatcaaattgtgaagataaatgatatacaatataaataaatggtaatgatactaatactatagttaatattacacataatgccatatattcattaatatcttgtaaattattttcataattatatgaagtaaattcaacagtatattctgaacaatttaacattacttggaataaaattggaaaatatgtataaagtatagtaaactctggtgaaaagaaaaagtcatgaggcgaattataattcattacttcaaatacattcattaacatattagatattaatgtttttgctgccattccttcataagcttcataatcattaaataaataaacaactctttgtgctgcttcatcatttaaatctaaacttgataaagaatttattaatgaattaaatttatcttgaactgtacctatatgtgaaactataaaatcttttgtgaaattaattttaccaatatgatcaggatataaattaggagctataattttcattatattatcatcattaggatcaatatatataggataaccttccataaaatgtggataaaaatcaatttcatttgtaagtaatgcaacatcaaataagaactcttgaatttgtgttaagaaattaatagatgtatcaagtttattagtaaaaccatttttgaaattataataaaataatacatataaaccaattgatataattacagtaattattgtaataataataccataataaattttaccaagtttagaatgtgatattaattcttgcattgatttcattaagttttgattcgattcatctaaatcatcatctttattcttcattaaattagtatcaaatttagaagataatgtattatttttagtgtctacttgttgtaatatagtataaagtataggaaatgtagctaatgcattcgacatagcaaaatctggttgtgttctaagttctttttctaacatatcgattttgtttttaatttcattaatttcattataatcacgtttaaatatttgttgatatttcaaatgtaaatttaagacatctcgaacattcggatattcttgatttaattgataaaaatcattatctaattcattaatataatcttgtgctttccgaatatcttcccaaaaattcgatatattattttgtaatatattttcccaaaaccttcgcatatatatcatgaaatcttccatttgttcattaatatcttcgatttgttccatgacatattcagatgtaatagtttgtcttgaacgtgctacatttcgaaattgatataaatatgaagacttttgtttaaagtttgtagttttagcaattaatgctactgtccacatcatttgtctattattcgatggaaacattgataaaaatcgtgcataaaataataacaaatattgattattagggaatcgaatatttgcccaatcaaatatttccattttaaatatgtatggatgacataattcaaatgtagatctcattgcactaattaatttaatcggtgacttaaagttatcatttaaaatactttccgattgtattggattatccatacattgatcaaaaatatttaatgtctttaacataaatcgattattaattaatctaaagaataaaaatgatgcaataaatacaaaaactgatacaagaattggtacttctggtttaaatggatttggtaataagaaattaatgaattgtaataaacaaacaacagctgctgttaaatgtaaacttgaaaatactaaattgactgttcgttttgctaatggtgaaaataaaaataaatatataactaaaataatatgcatgattaataatattaatggaaatatacatcgaatttttccgggtataatagcagaacagatcccagaaacagaacaaagaatggcacatgatgtaaaaatggctttggccccatataaccattcttgcattggtacattccaaaaaattacacgtggtgacacaaaaaataagattaataagatactactacctgatataaatatccctaaaactaatgatacgatactaagggcaatgtcttgacctttaacaagggaatatatgcaatttggtagggtcgaaactaaatatggaagaattattggtataaaaatatcaaatataaaaaatgaaaaatataactctccacgccctatccttttgtttttctggatttttaatacactcgttgaaagatatataaaaactataaaaataagaagctcaatacaaaacgcagctatcattctggaataatggagagaaggattaagcccttcccaaaggtaagcaagtacattaaatataaagctgaaaaagttgtcacttggccataaatcagtacaattattaaaataagctggaataataagctgaataccaaggaaaacagcatatatgtaaccaaatgctggatgtacaacaatacatgaaagtacttttgcgaaatatgtttgtaaattatttagaaaagtaacataaaagggaacatcgaggattgaatgtttcgattcgactgtagaaaaatcaatttcacctgctttattactcccccatgattgcatatcgagagtactctcaacagatgggaagcttttcatggttatggtaaaaaacggattttttgaatttttcagaggtaaaatcagaattaattgaaaaggaaataaacaaccctcagaacaaaactgtaagattgttgatcagctttgtccatccacaaagctcttcttacattaatattaggaaattcaaaaatgttatacgataaatgaaaagatgttcacaaaatgaaatttaaatttgttattaatttgaattattaaaaatttttcttaaagatctcaattaattacatgaagtaaccaataaaaccaaaaatgatcaaatatatttataaaaaaatttttaagatttctggtttacaaataattatcaaaatcaatgaatacaaagcgaatagtataaaaaatccaacatgatctttgtcaacacttttttataatgcacattataatattattgtattatgtatttccattttgctttgtgaatatatttgttaatatgtaaattgttataacatgtatatattatgattttgatcattaacatatgtttatatcaacttttgttttaatacaattctttctattgttaattgcaaatatttgatcttagagttgattttaatattattagcaatatgcttcttttccatttcttattgaaaataaagatttgatgtttgtagaagagaagtctgaattaaaattttcatttggaccttatattttttccaagaagtaaaattactatttctttgtaacctctcatatatgcaatttgaattgcggtaaaatattgttaaaacatattccaaattattaaaacatattctaaattattaaaacatattccaaattattcaaacaattacttttctcattaacatcaattcctttatctaaaagtaattttactatttctatattattatttccaactgctatatgaagtgctgtttcaaattattaaaaaattttctaaattattgaaacatatttcaaattattaaaacatatataaaattattaaaacatatacaaaattataaaaacatattccaaattattaaaacatatttcaaattattaaaacatatataaaattattaaaacatattccaaattattcaaatgaatatttgttgcattaacatcaattccttctttatctaaaagtaattttactatttctatattattattttcaactgctaaatgaagtgctgttttaaattattaaaacatattttaaattattaaaacatattccaaattattaaaacatatataaaattattaaaacatatttcaaattattaaaacatattctaaattattaaaacatattttaaatgattaaaacatattccaaatgattaaaacatatccaaaattattcaaatggataatttttgcattaacatcgattcctttttgttctaaaacatatttcacaagttcaatattttctgattctgaagcaaatggcaaaatatcttttggaatttggttattttgaaggaaacaattaacgagatataaatttccatttcttgctgattcatttatattatcagcattaatattaattcctttttctgccaaaaatgctaaaatttcataattatcctttttaatacaaaaacttactaaatcatttgttttatcttcagacattttcggtattgattgtgttttttctaatttattttcataaagatatttaaagatatcattttgatgaaattcaattgctgctccatatgcaccttcaaatgatgaatgattttgctcacataaatgaatgatttcttcatttccacctgcaactgcgtatttacctgtgttatttacatttgcattattcataagtaaatatttaaaacatttaactgatgaaaaaaatgctgcataatcaattaatgtaacattttcttggttaataaatgaacatctttcataaagtgatggttcaattatttgattaatatcaaaatttgtttgtgatgatatttcttgaagtttttctatttcatcatttcgaattattttcgcaatttcatttggattaactccttctttaatatatttcttatgaagctcccaatcattcttcgaaagttcttcataattttccaaaaagtattcttctatttgaccatatacattaagctcaagtcgcaggtagattaggttttcttcttttggtttataatgagcaaaatattttgatttaatgtttttagttatatttttatcaattaaattttgttcaatcatttgctctattaaataatatgattcttgtgtgtttgctgcagatatacgtttgataaaaattaaaattagtttaaggatattttgattaatttcatcttctttagtttgaagtgtttttaaaagatttaagtaaatatcaaatgcatgcttttttgatgaaaatgcattataaacgatgttgcttataatagttttaaatgtgtagggataatttgaatcgaataattccaagactttattagtggattcctggaagtttttttcagttaaactgaatatagttttctcaagctcaattaggaatttcaagcatgttgataaattattcaattttttctctcctgtgtttatgttagtagtgtcgtcattaggcaaatgacaaatcgagtggggagttgtggtttgacattgcagtgtcattaaataaactgtttcttaacgtacaatttatcgcctttttatgttttttcttcaacaatataattaaaaaaatatgttcaacatgcgcatttggatacaatattaaatattgaatatcccgtaaagtagtataatacttttcgatttgcgaaaatttatatttacaaattaatactaaccggcgcctgaaaataaacgtccccaagaactttttgccattgacttttttaaatgtttataatatcggctttcgtgtaaagcgctcaaaaagtggaggtatacatacaaaattttcttcgataagtcgtaaaacccactttttgatatatttcacatattaaataaatttaatgagttatatcaaaaagtgggaaaggtgaaatcatgaaaaccatttccttcgttttgtaaataaatcctgaataaacacaacaaaaaatcaatacaaatttattttaaacacaatgtctgtatttctttatgttttttttttgaaaaattatatttttcacatattgctatattaaaatgacttctgtttgtctttgctcaccatgaaaaattaatgccacgtgaatgaagcgcataaatgtatgtcagtaaaatgttctactacttaggattcagttaattgaaattttttgttggaagtacagaaagtactccaggcacgtctgttgtttccaccactgttggtgagcttagctccaaaaaattttctatgtaccgctcacatctggctggtttaatttctccatttatcaaaattagtcttccattaggcgctaactcgtaaaactctgttccattaggtccttcatatgaaacccagtgagcttttatatgaaaagtcggacggcctgttttcatgggacctagatctttacaacagttttgaattgaattacttcactttgaataaaaaacggcttttatcaaagaaatgaaaaaactgtaattattagatgattcatcctattatttcatgcaaaaaaaatgattttttcaagagctgcttgaagcaagtcttttgattgtgttttattgttaaaaaaatatttagaaatgattctaaattttttttagatattgatgatttggaaaagttaaacaatgtaaaacaaaagaattgttgatgtttcttacaaattaccaaatgaaaaatgtttttagaagcatgtaaatgtgaagattttttttgattttcattttacttaaaataataaaatattgatatttaaattaattataaatttgaatccattttatatatctttgcttttgtagagaaaatatataaaaaaatcggatcgcataagaatagatgaaaaagaatgaagtttgaaacgttgacatcataaatttgaatgctttcttctcaaaaaaaacttttttcaattgggtgatgtcaactctcaaaaaaaaccgctttatttcaatggaaatggaacaatgccaaccacaaaatatctaagtggcgaacattctgtggcgaaagcaacaaattgcgtattacaaattcaccgaataagaaatgtttctgctaaaaccaaaattgtaattttcagccaaaaaattttataaaataaaagatttcaaaaaaagaaaaaaattaattattttcaaagctctgattataatgcctagcaaacttattacatcattacaggtaaataaattaaatgatacaaaggcaatgttaatatataaatgtagatattaatattaactttagtaatgtgaaggggaatttgtgattcctacatgcactgtgaggggttttattacgactttttgattttcgtacatatcaataattaaaatgttaaggtgtaactgatgaataaacatggtgctggaataagctatcagtgttataaaaagaattgattttgaaaagcaagaataaaaatcaatttgataaattaaagcaataatttccataatttcgtcaaacaatataacgtgtgattataactaatggagcaaccttcatctgaacgatatcgtaaagaatttgcaataattgaaatttcttatttccaaaagaaaaaataacataaataaacggtctcctaattggcagactgtaaaaattctttattcgaatttgtattctagtcgaacaattacctaattttcacagtgtgacaaaaagctcctataccctgtataattgaaatctaaattgaatttcttaaggagtggtttaaatcaaatttgaaaatttgaaaaattttcagaaggaacacatgaaatcaatcattcgagtgaatttgatcaaatatatagcatttcattattggatttaaatcaacgtctttcgcagatttgcctccgttcaaaatttgttatttcagattcagttgtgacattagaattcgaaacactatataaaagtccagaatcagaaacacttaacatggctattggctttctttagcgggatgcattaaattctcatcaattaacgttggagcaattagattttcatcattttctgcatttttaaaacgccatttgaactttggaattgaaggttttgcattttatgtatgttattcaacatgaatcagaaatcaagtagatcaaatgaaccacaactggaacttaaacattttcctgttgtccaaatcttaaatttataaagtatcaaatgaaaacaaacagtattcacattccaatgatgatggaattctttctgataaatgatgtgttaacctaaatcacttactaaaattgaagattatgcgtttcatcagtgttctattcacgaaacagttaatattgcaacaactggcaaatatgcactttataaccacacatctttatgatgaattattagtaaactttatcttttcatatatttttatgatgagttggattacatcgtttcttgctgttaagcaccaaaatcagtcagttccttaattatgaagccacaaagtcaaattatcgctaacataaccgataacatagttttgattggtttacttaataaaatggccgttttgtgtaaaaccgttaaattaaatgctttacctgcttcaatcgaaagttggtacaaacatgtagctctcttctgggggcctttcatcatttgaccggcttggcggttctaacgaagtgtatgtttcatttggtttcaaatcgtatggattttgttgatcgaatgatgtataagtttgtgttggcggaatgtatgtttgttgtggctccggtggaatgtatgtttgttgtggctcaggtggagcatatgtttcttgttgaggaatgtatgcattcgttgatacttcagtgggtggtggttggtagcttgcatattgagggggttgttcttgtggttgcatttgttgctcatttgttgtttgtgattgatctggtattgttgcaacaattggattttcggaacagagtgctttgatagctttgttatcctcaagaatttgagtcattgtggcacgcatctctttggctaagaacgtgtaagcgtgtttaagtcttctgcttttgaatttcgaaaagcggtcttgaataacaagaagttcttcatctttcttgatcgcttctgcaagtacattggctttcttttctttgtctttggcaagttcggcttcagctttgattcttttagaagatcctttttctgatagaatgcgaacttcctccttttgcttttcatactttgtgcaccgctctttgtagtggttcctggcttcgattgatgccattgaagctctataaagaactgtgaaacgtgctgcaatatcattgaaatcttctgccattctttcataagcatcaataaacctttcttcactgtttatggagctataaaacctttctgttatttgtttcatccttggagaaaattctggaacttcatgttcaacaatcaactcaaggttattcatgaattttcgataatgtttgatttctcttcgatagtgttttacctcgcttcttgcattttcgacaacagaattgatgttagcgaggattttctttttggatacgcttgacattgaaatgatgatcacttttgtatattttacaaatgtaatgcgaaccaccaaaggaatggtgataaagaaaagtgacaaattagtttcatgatttgatttaaagaacttaaatatttaaaacatttaatcgagccaaaaatgcacgataatcaagtaatgaaacatgttcatgattaactccttcttttacatattgcatacgaagcttccaattatcttttgataattcatcaagtgctgagatgaattccccaatgagttttggtcttgaaaatttgttcattaatttgtttatttcttcttttgttttatatttagaaaaatataatgtgttcatgttctttactgaagatggttcaagtatttcttcttctatcatcctttcaagaagaaaatgtgattgcatttctattctcagtaaatattcacaaaatattagaacaagattagcttcagcttcactaatgcttttacctttttcatcttctttttcttttgaagttaatatatatttaatatatatatttattttcattatttgattgagaaataaaagctgaatagataagtctagaaacaagatagttaaatttatatagggtgtccggataaattttagtatcagcgtttgtgctgaataatattttctaaaattttaaatataaatacattaaatgtatgtgatattttattttaaatattggatcttatttttatttggttcatgagttatagtaaaaaaaatgatacaaaatccgtttatttttaaaatacgtttaaaatttcatttttaaaatgagtgatcatatgaaacatctcgtcatatattggtacagcaaaaatttgaagccaaatgatatatatataaaatgttgtaaaaactttggtgaaaataatgttcactatagcacaataacagattggtgtagaaaattattattaggccaaaacattctggtaataaaaactggcagcggtttatctacagataattttattgaccctttaatttgtgatcaattagtacaaatgccatttcacagtgtcagaacattgagcacaactttaaaaatcccaaaaagtacaatccatgatcatctccgcaaaatgggatttgttgtgaagcatttaaggttcgttccccacacactttcttatgaacaaaaattacaacgtattgataagtcaaaacaacttttggaaattattcaacaggcacgtcaccaatcttggaagttcttcttgacaggtgatgggagctggttttattttacagaagattttgaaattcaatggctccagcctgatcaaaaaccttttacaagacctagaagaattatttcaacaccaaaaagaatgctaacggttttttggtctcctttgggatttagaatagttgagatgttaccttatggtaattaatttaataggtcttactttactgaatctattctaaagaaaattgttaaaacaaatcctcagcaaaaggaagggcggccgaaaagaaaagttgtgatgcatatggacaatgcgacacctcatcggtcaagggaaaccaagaagtttgccatcaaaaatgggttatctttatgccctcatccagcattttcgccagatttagcaccatcagacttttatctttttggtaaagttaaaaatgaattaaaaggttcagggtttgtctcagaagatgaactttttgaggcaattaagtcaatattggagaagatcacaagagatgaacttgaatccgtctttagagaatgggaaaggagactccaagcctgtattgataatgggggtgattacattgagtaaagtttactttactataaaaattttgtttgtagcattttctgatattaagatactaaaatttttccggacaccctatatgtcagcctacctacaaataaattatttgttgcttgaactgattgatcgaaatttttttcgttgagattgagattgattctaatgatttcgaaagttccattaacaaaataatgtttcttggtgtagcaattaattgcaagcagagcacttttaatgtagctaccgtagatatataaaaatcttttatgtctactgctctttaatgtagctacagctgctcgatatatcatgcaacctcgatgatttatcatcacttcagcagttttgctaattctcgttaccattttgaattttttcgtagccgtctcgaaggtgctgtaaaagcatttttaaaatttatatatagaataaaaaatttacagatcattctcgaagaaatgataacgcaacatcttcccaaaaagcgaatgtaaaagattaaaaccttaacctcgccgcgttctttgcgtggaatggcctatagccatgatcacattcttcaattttcagcaatttgtttgtattcatgtagaccacccatacaaattatgccatcttaattgcacatacgttcgacaatacctttttgggttgtaccacttaatagcacttagtcatcatccaatctaacgaaatcgacgatcaaaaaaacttgaaacaaaaataacgacacaccggtgtgtggttctgcagaattggtaacattaatagaggtggtattagtacgaattcaagaatgtgcaataaaactttgtaaaaaatcgaattccgtttctatattttattgaaaaagtgacatcaaattctttcatcgtattagggcaccctattttgcatactggggatggaagaagaagacagaacaaatattttttcagcagtattctcacgatatgtggaaaattcaggccttcatgtaatttatgcactagcagaattcgagaaaaaatcagatactaacgaaatctcaaataatcaaatccttgaatcaatctttgaatattttccacgaaagttatctttttatataacaatgatttcagaaattacagatatgtttgcctttggaagtaatgaggctttacaatatttatcaaaaatcattaaaggtcttcttaaggattccagcaatactcctttttcagaaatacagggcatgtctccaagttttgatccccaaaatcgacatcacgttttacttttttattattttgccatgttttttgttacagatttaatatgtcatattgttgctaagtgtggacctggaaaatctattagttttgttttacgcgctggttataacttttcaacatctcaacattatttaccaaatcttggaattaaaattatccgtcagtggtctgttatttattccatcctttcagaaactgatttccctgcagtttcacaaattttttcattatttgcaactacaaatgatctaacaataccctttattttatatcgattcattcgttttgattgtgacaatgggtatggcgtagtattttttgaccaaataataacagcttttaaacaacttataaagaaaaaagcagtgaataatttaattttagaatcaattggttccatgattttaacacttccatattccgaagaaaccttccaaaagatctatgcattaatccgtcccttaaaaaaagaaaagaatatttcggatggtgttttaactttacgtttattattattatttcgtcttccaaaaggggcatcccaattaagccgctttttccacacaaaaattgtaccatatgcatcagacaagcaacatcttgaaaacagtatttttaacttttttgtattatttcatgcacgaaatagtgatcccagtagtttcttttgggaatggggtcgaaatccacgcgcatccaaattaagttatatcaaatctaaatcagttattgaatttccacaagaagatccacgatcattaacatcattatttatgaacacgttttttttaaaatcggatttttcagtttcacctaatttgtttaagaaagttttagtaattttagccgggattgactttaaatattttactaaaaacatattaccgaaattcattgaattaaataatagtgatccacgattcattaccatgttacgaattattccattagttaattctgatgattttgtttctaatgcatttcaaccagttacaaaagaacaacaacaagaatttaacttagcgataaaaccaaaagttaaattatgtttaaatgaatgtgagaaagaaatcacacaacaaaatttaatatttttccaagatcccgaattaatgttaacatcttcttcaagagaagcagatcaaaagatttcgttgatattagaagaatggaatattcatgagtttagtgaacttttagttgatcatattcagaatgaacattatgaaaataatttcacgttaattgggaaattaataccttctttaatatatgtattagatccaactgatttttcgaatgtttcattaatgaaattactcatcgaactttgtaatcataataatcctaacgttgctttaacatcatatgacatatgtagaaatattttaccaaaacttccaaatgttaaaaattatttggaagtgataattaaattatcaatgaagattatggcgcctgaaagtttcttaacaaaattatcattaatatattattcattaaaaataacaaaagaaactttgccgatagaactattatatgatttagaattttattctttttgttgttttagttcaatatatccaaatacaagaaatttgagttataatattttaattaaaattaatgagttactgaactctaaaggtttaatatcaatcattttacctaaaaagaaaatcttggaaagaattgtgaaagttcgtttgtttagtataataaatataaataattttgaacaaaaaaaatttccacaaggtgaaatacctttagaaatagcaattttaacacatttttatgatttatggttatatatattagctgagatttttaacatattaattttttccaattatacaccaatattaagtcgatttgataaatataaagatttgatattaaaagtttgtttagatgataaatcagaatcaaaaacttcattaattggaatgttaatattagtcattaattcacaattttataaagcgtttatattagactgtaaattcattgataatttcgaacaattcgaaccatttgattcgaattatattgataatcgaggatttgcttgtaatgcatttcattctttattaacatctggatatgaagttaatcaacgaattgcatttactgcattatcacatttacatttttcattattaggtgcaatgattgatgttttatctgatttaccaaatgaaaatatacctgaagctacacatatattaacgaaattaatacaaacaccagaattacaaaagcaattctttaaacataatattccacgatttgtaagttttttaaactcattacattattatataactaaaactaaattaaataatttccgtattaaatcttggactaaagatgaagaaattcatttgtttcataatttaacatttatacaagattattgtaatattatgttaatagtatttagttcttatactggtgtaataccagaagaatcatggccaattaattcgagacgtgcaatttttcgatttttattaaattggggattaactgaatctaaatcattacaagtattacgtgatgaagtagaaatagctttaataatgatatctaataaaggtactatatataaagaagcgattttagaagatgatgtttcattaatatatttttcacagatagaaatgaaagggaaaaacataatggcaaatttattacaatataatttcgaagcattatttaagttatatttaaatggagtatttactcaacaaacagtttattcattatatatcttaaatgcaataattaaaggttcgaattttaataataattctaatttaattattccgaattttggttatttattaatatgtttagaaatacattcgttacataataataatcaattctcaaaatcttttatcgaaaagttatataagtttttaataaatactgattatatgaataaagatgaattaattgatttaaatcaaactccttcgaatttatttccttttgctacagaagcagttttttctgcagcgtttaacataataaaaaatcctcataatacattagtaaaagatgttttaataatattattacattggtgtaaaaacattcgtttattaccaatgaatttacaatgtacgcaaaacatatttaaagaatttaattatttcactccatatcaattcttaagtaatttaatggaagtgactgagaaattagaacccgaattattctctgatatatttaatatctggatcgaattattacaaagtcctgatcataatgatattataccagtatttataaacaattgttggattaatcctgaaactaaagcacaattcatatcagcaaatactaaattaaatccaatcgatttagcaaaacgacttttcacacatttatcattttcttattattattatattactcaatgtcggaaacaatcatttgaacaagaagttaattatgtctataatttcatcccaatgttaaaagattatttcaaagatatcttaaaagaaatgccacaaattttacattttgttattctttatcgtgataagaaaagtaaacaacttgctgaattaatatggaatgtatataacatcgatgtaaatattcatggtcctgcaattcctaaacaacatttccgtaaaatcattgatcaaataattatgaaacttggaggtaaagattcgcaaatagttatcgattggggtaatgaagcacttaaatgggtattcggttgtcctgaattagagaaaagtttaatatcattacatgtatataatcatatctttaacccttttgatgaaaacttaccaaataatatcatgaaaatagtctcttatcatatcgaaaagaactctaaagaaacttcattgttatgtgaattcattatcgaaacattttatttgttcatgaaacatccgaaaattgattttaatttctcattaaaatatcatcgaattttcctcgactcgaaacttctcttcaagtcgattagaaaagcaacgcctttctttatcgaactatataataatataaactctgtgaaaagatttccacgtgaatttattattccaattgttcgtcctttaattccacatatcgaaacaaataaagaaactcaacaattcattgatatgttaatatctgtctttaaagttaatgaattaatgttattatctttacctataaaaattaatttccctgaatcatttccttcttgtccaagcttcgaagtagtatttgaacaatctactgaaagtgaattatgtaatgtgttatcttattattctgatatgtgcgtcaaatcttcaacacaagtaatgaattcgatatttaatatatcaacaaaaatatttataaaaatagaaaataatagtaacttattattctcattgactaaaatttatcattgcgcattaagatcaatttttaaatgtcccgaagcaaatggatttattaaaattatttgtaagaaacaaccaagtgtatcaagttgtaatatcggagactttagtaaatgggcacgatcgctggaggacgttaaccgatcgttaaaattgttaatcaaaaataacgagggaaattcaccgacgataacagattgtaaatcgtacctatcggtcacgaattttttgttcatgaaaacaccaccaaaaattataccttattctacacaatatgatatgattgagagtatgaagaaaattacggctgtaagaggcgtaaaaaagagattgagaaaaagtaataggaaatcaaaatctgttgcattttacgctaatttcgcaaactctttgtcaattgtattcactgaaacaacagcgaaaaaggaaattaaggaaatgggtccactgttacatccaaaggcactcgtgtttaagccagaaatgttggtgatggcaccggaaagaagaagaaagccatcatcgcatgagtttttgggcatgcgtcactcttcatcggtacattttgttcagaaataaatgtttaatattaataattttttatttttgtattagtataaaacaagtatccccgaagcataaaaatacataaagttgtttttaagaatttaaaaatgaagtaaaacatagacaattataattatttcatgaaattttatatgaaaaatatttttttttaatccatttgtataattctataattattatattatgatattttcatataacttgttgtgttcaaaaattttttaagatataaaatatcttattgattacatattcatacagtctgaaatgataaaaacatattaaattttgtcatttatgatgcagaaaatctcgtttattaatgtggacggaattatatgtataagaagttagtaatatatgacatatattactgatattgttcaaaaaatgacaaattgtatttttatacatatttttttgtgcataaaaacattattaatatataatacagttaaaagcatttaataaaaccaaacaaattaactgtatgtgttcactcatttattacaaatgtaaatcttcaaacatttactcatgtgtatctgttttgattggctcgactcctttcagcattatctcctccggcgacgttgatatctttgtttcctcgtactctctgcttgggtaaactttggagtttcgattgaagcatttgactcgaagcgcgtgagaaggctcaatcggatgcacgtagccacacattatccctttgtcgcatcttttgttcggtgggttacatataagggtgctaaggcgaacgctgtcccatagagatgtcttgatctttcgaccggcataatacctcccattgagcttcatgtgggcagctagagcagaatctgcatcatcaaaactgacccaaactgttcctgacagaaatgaacgaagatttcctgcaactaatatatctgtaatttcaccaaattgtcgcaattcaagatagatatcataataaaaggcatcaaaaagacgctgcttttcttcttctgtcttaggattttgctgatttaaataacaataaaaaacttcgggatttggatataaatgatggagaattaaaatgcgtggaaatgctgttttgatatgatagcaaggacaataatctccatatggacatacaccaaatttatcgtataatacacatgtcggatttgtgcgattttgatttctttcgtatgccttaagtatgccacgcattctgttctcttctaattgtccctctaattctttgattttttgtaggtgcaagtttacttttggatggttggggttcattttgaaaataaagtattcaatataatcatatcgaactgttacaattttaaatgaaaattaatttctgcagtagctcgcaacctcatgtataaaaacacatatgagagaatctcccgattttaaagaaaagatgagcttttattcaatttgaaataattgatgaaatcaatattatattttttattaatttatcataataaacttagaaactgaaggggtttggtccgttgttcgcaacacaaaaatagtcaaaaggatcatttgtatccatgtatccataaaaaatgtcattttctgtactttctgtattttctgtgttttctgtattttttatggggccaatttctggagctttgggtttgggatgattgctggatgcttgcgcaaggtgtgatggaagaacatattttttatctcgatttatatacttatgccaacggttttttatattatttccactcctgcctttaagaaaagatgatattttaacccacttcggaccaatttcaaggaatttagatatgataatgtcatcttcttcttttgtccaaggtctcttttcaacctgatttttaagcgtgttgttgtacctatcgcgacattgacgagcggtacgctcaggcaattttgatgcaatttctgcccaattaattttttcgccacaattaacaagctcaagtaatattttatcttcttcgggtgtaaaccactttctgtggggagttattttgttatatttattttgtaaaaaggcgttcggctggttcatcaaagtggagccaagcgaatacaaccattcttaactttacacaaattttaacctttgaatcccgctaattaaatacaaaccgtaactgctattaaaaagttaaaatggcaattcaaaaagtgcttttttttgcttttgtcattcaatttttctaatagtcagctttacagttcgaaaaaatacaactgaaatggaatagatgaacaactcaagacagaaagtctaaagatacaaactattcaaactcatatgaaaaattgatttttccgatgttttacctctctaatattaaaacttatcattagatttaaatttcttcattcatccatattactttatttatattttgatgtgattaaatgtggtatgctatattatagatctaccttcagaatccaattattgaatgtttgttttgattttcagttccacaatcaggttgcaaaattgccttttagaatgttggagagctcaaaaccagtgctctctacaaaaatcagctcaatgcttctcacaaatgttctcaaatgctcatgagcaacattaatatgagacacctaatcacaagctctttttatgataatgatttcacattagtagtttttcttcatgattggccactcagcaaatttcatattttcactaatttattaaacctgatttcggtcattgttccaaattcatttaacaaagagaaaacaatttgattttactcataataatttgcaaataaagtaataataataaattgttttatacaaacaaatctatccaattttaacattaatagtccaaaagaagaagtcttcattgcatcctattccaaaacagtctgtttggcaatcagatgcagttacatttgaaggaattggtatctgaattgaatcttttttggcttcaattacaacttccttttcctcaattcttatagagtagtcaagtggtggcttaggaataatatggtcttctatgagggaatcttgttcatatgttccatcttttatcgtgtaaaccattgaatttgttgtggtaaatttaacgttctcttgacgaatgtaaaaaacatcgattggagcaaacagctttgtctcgatttgatttatgcattcatatacgttcacaacctttttccatagtttaataatcggttcggaatacgtaagcaatgtatttaaatttatagaaagtaattttgtaactggagcagaatgagcaggaaactcttcttctacggaaaaagtagatgtatttaagaaacgaacaaacccatcatctgttccaaaaacaatatgataataatgaggaacagcacaatatacgcaattacgaaagctaggattggtaacaatccattcgccaatacagtagccattttctttgttgaaccctctaagaaatccatcaccgccaatgacaattgtttttgtaaaagagccacaatcaataaatgttatttcccctggcattctagctctagcaaatgactttaagacgattgatttgctatgatacagatatgaagtttgataaaaaaatggtatatgttgattgtaagttaattttggaaatgtaattaattcaagtatgggcgttgattgctgaagggcttgagcatcttcgtgaacttgtcttttgagaagagaattcattctgctttttgtatcttcaattgaattatatgatttgatttcatttatacactggtcaatctcttccatcatatgcttaaattcaattttcattctttgtgcattttctagaaaacaattcaactcatttagtagagatggatcaggttccatttaaatctgacaaaaatatttcagaaaaaataaaaatgacaaatatcgtttaagtttgataagacaacgcatcacttttaaatttgttcaatttttttcgttaaattatcagcataatttacgaaattgaaatttctgatacaaccaaatctcaaaaatgtaattattccaataaataaaattattctcagtaatgtaaacagttactaatttttgacattaataaaatgtaatgtttttgagaaaatttgtttaatttatgaacaaacattactaaaatattaagatcattttcattttttacattttgggtaccaatgtactttatcgtcctgtatgaaatgttatgtgaaatatttattaacaagattaaaatgattaacacagatcaagacgataatacaaattctaagtgtgattctatttacatgagtttacttacatcacttgaacaaattatttttaatttaaatgaggaaaatctttctacatcagttcaacagacaatggaattatatgattcaaatttcccatattcatttaatattgttataagtaatttggtttattatagattttattctaagtattatgaaatcaatacaaatttaaaatatttagaaattcttcaaatgaaagaggaagaaaaaaacaaaaataatttaaaaattattgatatttttgctaattacttaatatcaaagaaaattatcgaagaagatgaaccatattatatcatagaaagcatgataaaattaaatttaattgatgcaaatattgtgaatataatccaatcaaaatattttgcgcatcgtaaacctgaaagtgaatataaagatttttataatagtgatcgattttgtaaaacttttatgaataataattataagctttcaaagaatgattgggaacttcataagcaattaatcgaagaaggagtaaatcctaataaactttcaaaaataattcgaaatgatgatattgaaaaacttcaagaaatatcaaatcaaaattattttaatttaaatcaaattattgaaccatcactttatgaaagatgttcatacattaatcattatatttcattaattgattatgcagcattttttggatccattaaatgtttcaaatatttgttattaaatggttctcgtatcaaaaataccggcagttatgctgtggcgagtggtaatttagagatcattcatttatgtgagcaaaatcatgcttcatttagtggtgcatatgaagcagcaattaaattccatcgaaatgaaatctttgattatatatatgaaaataaaattgaaacaattaataatgagctaatacaaatatattgtgtctgtagtggaaattatgaaattcttacatatttagagaaaaaagctattagtataagtgattcttctattaataaagcagcattatatggtaacatatatcttgttaaacactttcttcagaataatttgataccaaataaaatattattaaactcaatcatatcgcaaaatttagaacttgttaaatatattcttgaacaagaaaatgttaatgtgaatgataaagatatttgatgtattatatttgatgttatttttaataattttatatttcaaaatattttttgaaaataaaaaaaaatatttgaaacagcacttatgtatgcatctaaaaacaattatgttgaaatagtaaaaatgcttcttgaaaagaaaggagttgacattaatcataaaaatttatataagtttaattaatttttatttcaaaatcatatttggaaaatattaaaatattttagaacagcactttcatgggcagcatttaatggttttactgaaatagctaaattacttttgaagcaagaaggaattgatattaatactaaggaaatttatttgttttatttagtatttattttaatgattttatatatcaaaataatatttggaaattatttaaattatttatgacagcacttatgtgggcatctagatatggttatacagaaatagttaaaatgcttcttgaacaaaaaggaattgatattaatactaaagatatgaatttgttttatttgaaatttattttaataatttgatatttcaaaataatatttggaaattgtttaaattatttgatacagcacttattttagcatctgaaaaaggttatagagaaataatgaaattacttcttgaacaaaaaggaattgatattgttgttgataacatttttttgcttgatataaattttgttgaaatatttcaatgtttgaaaacaatatttggaaattattataatattttagaactccacttatgtgggcaacattatacggttatgcagatatagtaaaacttcttattgagaaagaaggaattgataaaaatgttaaagttgttttcttgaaatcattaatgatatatataaataatatttaagaattgttttaataatttagtgaagaatttatggtagcacttaaaaaaggtcacactgatgtaattaaattgcttcttgaacatgaaagagtttatgtgaatgataaagatatttattaattaaatataaaatttatttatatattttaatgtttcaaagtaatatttgaaacatcaattcttttagcatctcaactaggttacaccgaaataataaaactcttacttgaattaaaaggaatcaatatcaatgctaaagatataaatttatttaattttatttttatttttttattttaatatttcaaaataatatttgataattatatcaataattttgcacaccacttattttagcttctaaaaaaggttatactgatacagtaaaattattacttgagaaagagggtatagatattaatgctaaagatgcatatgattaatgtttaaaatttgatacaatgattttatatttcaagataatatttggtaatacagcccttattaatgcttctgaaaaaggttttaatgaaattgttaaattgcttcttcaagaaaaaggaattgatataaatgctaaaaatatttgttaaattattttaaaacttgttaaaacaatttaatatttcaaaataatatttggtgattaaacatattatttgaaacagcactttatttcgcatccaaaaatgcatgtacagatatagtaaaattacttcttgaacaaaaaggaattgatattaatacaaaagatatttaatatttttatagaatatttaattcaataatttaatgttttaaaagaaaatttggaaattatttatattatttagaacaccaattattattgcatcatttgatggtaatacagaagttgttaaattgcttcttgaacaagaggaaattgatattaatgctaaagatatttatttttttatttccaaaatatattttaataattttatgtttaaaaagaatatttggagattatttaaataattttatacagctttactttatgcatcttctaataactatgttgaaataatcaaattactaattaagcaaaaaggaattgatcttaatgttaaggacatttatatgcttgtttcaatatttcttttaattattagacgttaataaataagatttggaaattgcttaaaatattacaaacagcacttatgattgcttcacaaaataattatcctgaaatagttcaattacttcaggaatagacattttattttaacaatatgcttatctagttgaaactttttacttgcaataaactactgatggacacaatgtttaatgttttatgtcttgaatttttttagatattataataaagcaaatttgctatgtatagttttatattttatttattgtgcgaaaagctttataatttaatgaatttaaaaattcttttggttaacttaatatcttaccagattcaatttatcatcatattttcatcacataaaaaagcattattaaaatgaaataaataattattaaagcttttctaaaaaaaacaattaaaattttttttttgtttttatcatcatctgattcattatgatttattatggagtaaaatctagtgtgatatgatatatctaatgaatattcaatgattacatatacgtaaataaataaataaataaataatgtctcaatataagaaaatgttcaatccacaatagaaatagcatttgtaatcttaggaacaattgtatttgcaaatgtacatatgatacactaaattgtcttgatcaagatttccgtaaatgaatgtgtaaatatatggagtacataaatcactatacttgtctttaattacatccaattgatctaattgactttgcatatgtgatatttcttaatggttttaacaatttctctgctgatttaaatgttcaatttcattcgaagcaaaatcacattaaaactttaataatattttattctcatttaagtgaagttcattcataaaaaaaacattttaattaaattcgaattctattcctttttgcgtgcactttaccgactgcagtacgtctgccacgaagccaaatccgttgctcctcattatctcggccgcctctttaatctttttgcatgcgaccatgatcgatgccgcctgcaggaaatggttgccggcgagcagcgttcgcacgagcgagtccagaatcgcgccaatgtcattgtcatccattttcgtctttgcaatttcgaacacttcttcaacatttcctgtcgtcgtgagaagtttcgcagcctctttgtactgttctgtgattattaggatgtcggtggcgtcggatatcttattggagtcaataagcgctgctacagatggcgctattgcatgttctgagtctttagtgttgaaatatgcaactttgatcgcatcgattacatagttcgaactgttgggtggggaggcaaggaataggttcatagccttttcgttgttgccaagaagtatttcaagccttgctttacgaattcgaaggacttgatgtgatgatgaggttaatgcaagcattccgttgatcacatccaagaatgaacggatacgatcaactgtgaagttcgcgcagaagcaattaggggcgaaacgagtcggtgataaagatcttaaaagtattgccaaaagattataacctgaatgagaagcaagctgacaaatactgaacaggtctttacttgtttccttaagctgtttcatgaattcctcctttgataaaacattaatttcttttgacctcgaaagaggcgtgaggctatcggccgacaagaccgttaacgacggttgtgacggtttcttggccaaaatttggcgaccgtttatccatttgatggattttaaacatttttcgtcatttacgaacttaacattatagcgctcattatcaaatttgatcaaaccgacagagttcgcaacgtcgacaacgaagatattattttcgtaaatttcgattgacgaaatttgcttttttaagaaaggaattgttaagtttttatctgaccaatcgattacgattatgtctccgtgatttgtgccgcatattaaatggtcgttcaatgcttttacgactgttggatattcattaattttaattatattaaaatcgacttttgttaataagtgataactttctgatgaattatcaggagatagtaaatatttctttccaacccatttagaagtgattataataatttcttcttcacatatatctgaaaatgttgctaatacttgtgtttgttcaagtattgtagcaaaattatttgtgtctttgaatacaagaacgatataaccgctgatgacgatggcaaaatatttgcggtttttcgatacaattatgtcaattgaagattcatagaaattgaatgcagaccgaagaagtgaaaatgctttcatcgaaggaatgtcatagaagaaagccttagtggcgttattcgcagcaacaacaatagctacaaacttgtcttgattcagccatacaatgcgtgcgattcttccttcatataaatgaaagaaattagaaatatgagaatctcttgtaatcgaaatataaccataaactgatccagttattaacgagttattgtatacatcaaagtctagtggttttgaaggaagcattttatggacacaacatggaacaatatcatgatcaacaaattcgaatatttgtagaaacccaccaagagacaaaacagcaattttgttcttgtagtgagattggacgatataagaacgaatactacttttaggatgtgaaatatattggatatgatgtcgcctgatgaggccattacttgtgacttcatacttccgaaagtgtgtaccatgaattagagcaaaaattgtttcattagattcgtcaaatgcaatatcgaaaatacgctcatgacccatatcagaaccaatgactttaacaagggctctatctgagagtgtataaatgttaacacctgtcgagctaacaaataaaagtgtgttattgagaaatggataatatctgacttgtttaagtggattatcatttattggaaacttgccaccaaggttgatagtgccacctgtttgtgctgaaagaattttgaaatcgcctaagcttgctgcaactaatagagaatctgaatcaaatggtgatattgcgaaaaagtctggtgaaaaatgtaactcgcttgaccacaaaactttgtagctactttcgtctgtaatttgaaaacatgtaacattgttatttgaatctccaataaaaaatttatcacttgaaattgttgaccatattgatgaaataagagaacggtcagatgttgtaaagcttgcaacagtacgttttttagaaaaatcaaaaacaatacctaaagattttgttgttattaaaagttgaattggcgtttgtccatcattatcaaaacccatgcaccaagagagcgttgtaatgtcttggtttaatgggtttgttgtgaaaagtagttctagactttttgatttatgtgaaaaaatagataaaattggtccattagccattgccaataatccacttggactccatgataatatattatttttctctttatttgatgggtaagtccaatctaaagttggaaagttctgttcactcatttgtaatgttccaacaaaatcgtgtttttgttaacgttctccggtgaacacaattcaaatttcacgcacaacaaaaatttaaatttgaagtagaagcagcaattaaaataataacgaaataagtttttttcattcatcattatataaaatcaaaaattttcttattgaaattatcatttttttattgttactaacaaaagaaatttatataaaaacaacatttatttataaacacaatgccgctatttttattatttatttctctatgtacaacgcatttgacaccaatgaaataaacccagaaatttcatacacagaattcgagcatatgcagatgttgcaacatttctcctgtgtactcttctgtacttccaaagcgaaaacagatccgaaaatagttttacagacgaaatattcacatccattattggaagccacagcgtaaatattatttttctcgaatattttctccaaatcctccaacagaacatttgctaattttttggtcactttaatgttctgtggaattttacttaaacaatttaagaaattcgatttctcaatcaaagcgcctttttcattatcatccaaaagaataaatggcaatgaaatcggcaccgaaaaataatcagttacatcatcgaaacataattttaatggaatatattcgaacaatttttgttcattataattctgattaacgttaacaataacataaaaattctttttttcgtttgctttgatttcttcttcattaatattaataacgaaagcattccattccgaagttatttgatgaataacaattgtttcatcactattattacatatagttaaatacattaatcgtttttgcgaatttttaattgttaaaattcctttgatttcaattatatctttttgttgatataaaatcggaatattttctaagttttcgtcaatttcattttcgtcttcattataaacaattgataaaatattgttttcttcagtatatacaatcggattaataacattttcatctcgtaaatgaaaagaattgtttttgtcattgagaattgtggatattgtacccatctgctcaatctttacgtcaagatttgcgctctttaatatgtttggtatgaatggaggtaacaatgacattataacttctttcgctttctttcgtgactctgttaataaacttaagtataattgcgcgcgatcttttagatctggtgaacttagttcataaatggataaatataaaacatgttttaacatttgtttgcctttggttgggtttcctaaataaaactttataatcgctgtgagtatcgataattgaacttcaactggatcatcaacaaattcttgtaacaacaaactatcaatcaactctgcgacgttttggatcgcatatgaatattctccgatcatccatattactgctgatcgtgcttttgcatcggagaaattatgtattaatttacaaacaattggtatgatgttttcatattgacttggataattccggaaaatattgactgttactactatacattcttggataatgtagtctacttttgtttggataagagttataattaagtcaacgcaatttttgacaacgctatcgtacaaaagtgctattttgccaatgcattgaatgcttttctgtacaaattgaatacagccgtccttaacgtacgactcaagctctgaaattatttcaattgaattctcttcggttgtgaggccgataacgatatcgagtttctcgatttttatgtaatcagcatcatctttatggcacaaaaataagggaaaatattcaagaagatattgacggagttgtggaagcattagtttgatgttttttaaaacagtaaattgaacttcttttttcgaacgaagtaagctaagaaattgatgaagaatggatttgatggtctctgctgaaaaaagagagtcatttataatggtacacatcttgtaacaacagaaaaaagcagatgtaattattcctggattaacacggaaaagttgtggaaatactttttcgataacagatttggcgaatcttggatcatttggagagaagtcgcgaataaaatcaagaaaatgtatcattttccattctgataaatcttcgataactttaagtaaattatctactgttttaatgttgatagtaattaactgtgttttatatgtgcgatttatttcttgcattgtgaaaatagcatttagaactacatttggatttggatcattaagaagattatgaagtattggaataagattatattttgaaattaaagtatgatcattgttatgtaattttaatattgaaagagctgaagtttcacgaatataaggatctgaagattgagatcctgaaacaataattggaattaattgaactgaattttctttgttacacattattcctgctttacgtactgcatttgctttcaaaagtaaatttggattttcaaagtcagatataattgaattaatcaagtaaatatttaatgataaatttgttgtggcgctcgaagcgccaataattctaataaatctatgtattgatatattatcatcagtttgaaagttagtaatggatggaataatttgtgaattgtcttgctgttttgcaaatcttgttactaactgtctcattccgtcaactttcattttttgatcttttgaatttaaattttttattatttcttggatgtcagcggaatttgtcattaaattttggaattcaggtgaccgtttactgaatatcttaacgttcgtctttcgtaacgtacttatttaatgaaatttgtttcttccttccttcttagacaaggaatgttttatatttcgcttagaatatcatatacatgtgagattgatgttttaaattagggaaatataacatttcatgccgtatgacagtttttcttattgatttttgaacgaaaataaaagtatatttttaatgaaaggctctttgattctcctaaagttcattcattccaatgactttatagtccaaagtataaacattgatcatttttctggaaattagttttttcaattcataaattgaattttaatgtaaagcatataatttaaaaaattccaacaaaaaaatgttattaaaagaaaaaaatatccaaatccatgtttattattatgaatagtcatggcaaaaatggtaaattttactgggtatttttgttactcatgcacaccctggtcaaattgaataaattttcatgtttattttatttgtgtgtatactcatgaaaagatcgttaaaaacaagaaattacccaataaaatgaagaggagatgacatcggataaataaaatgtcaaaaattgcacgttaatttcataaaatgaatgttttctcaattaatatcaaagcaaacgccacttttaattcaattccacacttggaaattaaatgttaaaatagacaaaaattcatattgtttcatgacctatttttactgggtcttttccgcatcttttagaagattttccattttttcttccaaatattgcattttccatctacacaagtgcaccctagattccaattgtaatctcttcatcaaatgttctcttgcagtatttaagtttattcccttcgctggtgtagaagcctgtgaagcgacctttgacttttccatcgtttcattcaatttaacaaaaccgccgttgataatattcaattgttctttcatttgtgagacttcagaattcttttcgtcgaattcaatactttcaataccgcgttcaaaaagttccttcactttcttcgaatattcaattaattggttaacgttcggtaattttgtgccattgatattttcattcaaatccttcatgaattcaatgatattttcacctttttctaaagttttatctatgtcattaatttctttaatatggtctttcatatataacaacaaattctcataagtagttgagccagaaacgcataaattcaacaaagttaaagtaaattctctagaagcagaaggtaccatttgttgaattaagttaattttatcattaatcaatccaatattttcttgtaacggtttggagacgttaaatattttatctctcaattcatttaacgatacgtcttcgttttcaatcagtgtcaaagtttcacctgtcaattggagaacgttatttaatatattcataatttcattaaaactgtttttgaattgttcgttccaatttggattcgcttggaatttggattttaatgccttatttaacaaatccatataattacataacgaatttgcttcttttgttaagttcaatttattttgtaagttaacagaacataatgaagtctttagtatatttgttaatgtattattaacattttcatataaaactttactattttcgacaatcgaattgttgtctaatgtttggatgttattaaagaattcatttataatgtttttagtgttttgaataacgtctaaagttacattacaagtttccttagagtcaatagttgtttcttctgtagttaatcttggaatttgtatctttgttggaagctgatttactaattctggttcataaggcaaatattcgatatctgttgtcttcgttataaccttcaaaagtttctttattgttttatatattggatattgttttactattaaaacattaatatcataatctttaatagtttccaaatattcggaaatttcgatctttaattcatttattaaattgtttatattttcatttaagtttttcattgtattatgttgcaaaagttcatttacttctgttgaaagttttgatgtttcttcatcaagatgtggaacattttgagataatgttaataaaaatgattccttaagtttcgagttacaaaatcctgcgttaataattgatacgtataatattatattaattaatttctctaaaacatttttctgtaatttgatcatattcgaattatcttcattttcttcattaatgaatgataagtcatctacaatatcaccaatgttatctacatatcttctaaataatcgtaagttaccatttgattgatcttttagataattatttaatatttttattgtattttttgataaatgaataaactctttataatattcaatatgtggattcttattaaggaatatcgcatgttgtgtcattatttgaacattcgaagatattaataataattgacgtggatctttttcttctgttaagttttgagcatagaaattattatctgtacgaatgtctaataatgaatttgtatcattaacagttgtgatagaattcgttaatgaattcgatacttctgttacataagatattaatttcgatttagattcttcattattaatgttctcttttgtattaatatcttcaataattggtaaaatatcatttagtaattgatcattaactttcttttcttttgttgtagcttctaatgatttaagttcaatgattttgtcatgaatttcattgttattatcagtcgataataaattaattaattcaattgtcttttcattagttttctctttaatttcttcattgtttaatgatcgtgtttcaataaatgaagaaatctttttaagttcatcatgaactttatcgattgattctttagtcgaatcttctttagtagcatcttctactaattttaatacttttactaatgaaatatctaaaagttctttagattcttcttcaatagttggtaaaacaccagctaacgaagccaaaatagttggagattgattaattaattgttctttaacatcttcttctttattattattattattatcttcatttattatattattaatacttgaaaccattttattttcgatttcattaattggcattgtagtataagttggtaacatttcgacaaaactattaaatgatttagaacattcattattaattttagtatcatcatcctttaaataatcaattacttctttagtttggtcataatatttagtgttttccattgtagataaaactaattcaagttgtttattattagtttcagtaaattctaatttttgtgtataatcaggttcttcataattttcaagttcttgaattaattcatttaatattgatactaattgaggtatccatacttgtaatttaatatctgctttatacgcaatttcaactttacataaaacagaaaattgttgatcaatattataaataatttgatatatttgattaaacttatccataaattgttgtatattttcttcaactgaattcgataatgctataacaaatgataaatgtgacattggactccgtaataacattggtactttcattgtatcattttgtaatgtttctaaaacaatttccatttctgttttagattgtaataataatgataatgccatcattcgataatttgcttccgaaaattcacttaatggacataaccaatcttgtataattaattggaattctttcatttgatctgttgtatctacttcttgtaaatatcgtgctataaaacataagttaatgaaattcgatgatattaatattgatgggttttctaagaatgttaaagattgtttaatattttcatcatttggattttgatttaaatattctttaattatagtttcagcatttgaaaagaaatataatgataatgataaatcaatttcatcaatataatcattaaactttttaataatatttataatattttcatcttgaatttcttttaataataataatgaataacaacgaatttgtttcatttgattataatttaatgatactgatgggaaacttttagattcaattaatacttgtggattaaatgaatttaatgcgttatttaaatattgtaaatagaataactctttttgattattatttggtttataattcgataataaatcctttaattgtattgttgcttcacctgctgcgactgcaaatccaattgtcattattttgaattgttcatttttaacttctttattaaattgtgattgaactaatgtacgtaattcatcaatataaaattttttcttttcatgtgcattaattaatgttatagcagcaattaaaattgttggcattaattcggtatttttagagaatatatcaaatttatcttgaattatatcttttacatcttctgatatatcagcaaatgatttaatcttatcgaaaattatttgtaaatctaatgtttgtgagtttaattgtgatttatttcgttgtcgattatgattttcagatacatcagtaaattctcctaaattattttggaaatcagataatacatttaataaaggtttcattgatgaatcttctctaacttgtggtataatattttgtaccatttgatataaattatctgcattttgttgttgtgattcaactttattaatcgatgtagtagatgtagtatttaccatagtcttttgtaataatttgattttagatgctaaatctggattcttaattgatgtttgtgatacaatagaattaacttgtgttatcactggatttatagtttcaacaaatatttggatatcactttctccaacatgaggtttaatgattttatcaataatcatttcacaattattgaaaaatgtttcaagttgttttgtaaatgttgttgtttcaattaaatatggactaactattttagagaatattgtaatttgatatttctttcttgcaatttctttaatttttgataatatttgtgattcattatctttaatctcttgaagtgatgtagataattgattaaaatatgcttgccaaaacttcataatagttaaaatattcttttgattagagaataattgtattgatgagaaattatcaaagaaacgtgaaacttcttcaatttgtggtataatatcttcaaccatagttttgacttctttaccagcaaagaatggtattatagatattgttggtggttgtacagtatcatgttcaggtaattggttaatacataatataattaaatcagttaaatcataagcttctttaattttaacaaacttttcttcattcaattcattctttgctatgttttgtgcttcgattaatatatttttcatttcttgaaatatttctacttgtcgatcagggaatggagatcttaatataaatatcatatcttttaataatgtttctttatctttatcactagggattaataatgctatatttttaattgttgtagataattcttctaataagttatggaattgatcaaatgaagctatatgatttgataataagtcatcaataattcgaatgatatttgagaaataatgtattaatgaagcatcatgtaatattgttgataattctcgaatatgtttcattacttctattaatattttatgcgttttgttaatcgctataaagattgatcgtgtcggattatttaatgctcgtttaaatattgtaattaatgtctttaattgcatactttgacctttaacttgttcataaagttcttgtgatttagaatctgtccatttaacatcatgatttaagaacttaactatagtttcgacaagtgaatcatgaagtgcttttaattgttgtgaagaagggatatcacggaatggttctattcgaacatcatttaataatgtaataaattgatcaagtttcttcttagaaaagattaacgcttgttgaaatgttttatctgatgtaattgacgtaattaattcagtgattcctttacaatctaaaacagccctttgtaaaactatagtttgttccttaagtttatcaaaaaatggtattgaaaatggtcgaattgttaacttttgacgtaaatcatttgcatttgaatatgcattacctaatgatattaatgcggtattaattttctcaactaattcttgattattaactattttcggatcatttttaacagtatttcctactgttaataatatcgcaattgaaaataatgtttgatgaaatccaaatatatgttttaatcgatcaactggctcatgtggtattaaaggtcgtaatgtatctttaataagagtagtaaaatgttcaatcgctggtaaaaatgatgaacctggtgataatggaataacactttcagcaaatgctgttaaagatttcatttcatctaaaagatgtattaaatgaaattgtgtattatataaaattgtaccatttgttggacattgtttaagttctttaagactatcttgaaatgtttcacgatatttctttaagaaattaacccaattctcaataacagttttacgtttcgaatcaactttaaccataatttcagatcgaataagtttttgacatgttattaaaatatttaaacttgataatattaattcaatacttccaacagtaatatttgaagtagagatcatatataatgcggaattaattgtgtctctttctgcatttgttatatttgtagatcgtgtaataatttcattagtattaaagattaaatgtaataatgaatcttgttcaaacatatctttgtcacaattcgctttaatatttgcaacttcattcggtaattcttgttcaaacttaggtaaaagtggtaaaactttagttttatatggatttaatgttcctggataatataaatatttccctaatgttgttagtgtataataatatgtaaaattagtgatgtctacttcttctgttgttaatgtttcttctttcagaaatccatcagtgattaattcggcaccaaattcttttacaagtgatgcatatgtagatatcattgcatatatagtttgtgcattcttaaaatgtatttttaatttatgttcgtggccatcaggtaataaaaatttaattgtgattgtgcctttcgatttatgtacagaaacatatcgataatatggtatcgaataaacaatttctttggattcattatataaatcaattttaattgggccaatatataattcacatgggatataattcttatcttctccttctgcatatttacatttaaagatttcacagccgaaattcggaattgaatgggcgaccgttaggtactgcccgatagcttcttctttggtcggcgcttttcgtgaagacagatattccacaactaaagctttgacattttctggaacatctggcggtattgaattctcactaatttcgtcactatcattagctactatatacaatgaataataacataactcggcttttttctcatcggaaatgggaaagttgttcttcttaatatgctcagaaacatcgttataggctaataatgcagaggcacgatcagatatttgggatttggtgaatacaaaataacgccttttgaaaaatactttatcatagttggtgcattgctgtggtaatgataaatcaagattaagtggaatatgttcaccttcgggtgaaattgtaaataaagaatatccaattggatttccaattcgaagtttctcagcaatatatgaaactaattctttgacagttttggaaatatcaacaattaacttcttggaagaaccatcagaagttagaacagtgattgcattgtttgtttttaatacaaacaaagccattccatcatgaagatgataatgtgatatgtctttatctgggtttatccatttataagatttgtctttctttcgaatcagtaattttgtatttttgttctcaggtatttttaaattttgtagagcaagtgaaaggagctgagaacctttgattttgtctgggtactcaaattcctgggcgttgttgccatgaatattgtcgcatgtgatcagggaaatcgagctagacatttaaagttgtctcactttttcggaattttgtaccaaaagtgacaaaaacaatttttctgtcaagttaagttcgatgatttaattcccagaaaataacggtttggtgtaatctattaaaaaaaaaccacagttttaacaaacatgtcatttttgacttcaaaaagtttttttgtgcaatgtcaacaaaagctcaaaactgaaaatgcataattggtaaattagtatttacgtatgacacattgtggaaagtttttgtgatataatcaatgtgataacttgtttaaatgtgaaaattttggatgaaaagttattgaaatgtattttttttatatgagcatcgcaaattagttcatttgaaaaatataaaaagagtttgttgttattataaaataattgttttttatttagtaaaaaaagtaaagttcagctcaattgtaacaagctgtttgtacatgtaatccattagaacacttgtatcaggtgaacataaatgaaatgctcttcgtattaataattataaccatttcgatcttttctcagatgattgttttaattcttttggtactctttttaggaattcaatgttagtataaatttgttgaaatccatcatgtgatactactaatgtagctaagattgcatttaataatgaggtcaaaatataatcgcgaattttaaatgaaaaatgtgtattacaaaagttacacataaacaaatgaatttttgaaattgacatgcttgaaagcacattatataaaaatacaattagaatttatcaaagtatatatgaatttttttgataatgatttaatatatttaaaatattttttgaatagctacttttgtgagattatattctcctagaaattatattattaaatcacggaaaaaataaaaccaagtaataaattttaaaatatatttttttgagaaatcaaaaaaccatatgaaatgtttttaaaatgtttgaagataatgaacaaaatatatctttaatttgtacatcataaaaaatttttttggggtatgatgaatggtgctcccggatttgaaaggaattgatcgttggaagttgtttgcatattccttctgtggattcgctaacaacatctaagtgtccaaattgtttgtctatatatgttaaatatgtgataacacttgttgtaacattaaaaaatgcactaaaaccaatttctggttctttatctccataataatagatgcattgaagactataacaacccgaaaatgctgaacttctaatttctcttattccatatccaagtgttcatatcgttaaattagaacatcatcaaatgcatagtttccatttgttacaactgcatttggaatcataatgtttttgaatgttgaacagtatgaaaatgctccaccaccattcgttgtaactttttctccaaaattaatcgtttctaaattatctcgtaacgaatacacagaactcccattatttgatgctgagttcgaaccaaatttgcattgctggattcgaatccatatcgatataatgcataatgatataaacctaggaacaagtgtaatattaatgaggaattaagttatacacattttttatttaaaattcgttttacagcaacaaaacttcataatcactaatagttaaacggtctgtattaattaacgtacacataagaaatgagaactcaaagaacaaaagaaagaactaaacaatcaacagttcccatatgtaaactaagaggttcaaagccaacaaacttaagattatcaacacgtgggattaaaatgactactactcagaaacaagataaaacagattcacaaaatcctcctcaagctcaacttttagctgaagaatatgtgcataacctccaacagcagatatattttctcgatgcagaacttcgttttcttcgtgatcgtgccggagtggattcaaatgatacttcagttgatgcagcaattcgacgtttaagacgtgcatgcgcaatgcatgaagaagaaaccaacaaaaaaatcaaagaacttgagcaattaacacaagaaaagcaaaaagaaattgatgatatcgacgaaaataaagcagaagaagtgtatgacaaagctgttgcttctgaggcaaacaatatcgaagtgcttaagaatgcttttgcagaagttgctaatcccatacacatgcatcaattacaatatgaacatcaacaaaaagcagatttgtttcacagcactcaaagagaaaacataaataatgacatcaaagaaaagaaatcacaacgtgaagctaaacaaaatgaactctctaaaataacactcaaacttgaagacattcgaaatgaaagaaaatctctcattgacaaactaaaagacagtatacgaagtaagcgtttacttgaagaagaatctgatgtcttaaacttttattcccaacaagatcttacgcctacaaaccaatcattaaatgtcatcaaagcacaaaactcaagaatcgaagcggaacttgaatctgcgcgtcgaaatcgaactgatctcgaacaacaaatcgagcgacttcttggcaagaatgtacatcttaaagccgagttaaatgatttggaatcgaaagttaaatatgcgaaaaacataaaagaacaaatgacgaaattatattcagacaaatataatcaaacaaaagatgcgtacgaaaagattaaagctgaacttataacagtaaaagaagaaaagaaacaactaaaagaaaatttccgaaaaagtaatgcagatttcgatcaatatctttcgcaaattaataagtgtcaagctgagcaacaacttatcgaagaagaaatcgaatttaaaaaagaagaaaaattgaaaatcgataaagaaagcgaaaaagttcaagcggaaattaagttgctaaatgaagaaattaatgaactaaataaggaaatggacaatttggtacacagtattgcagaggcatcagaaaaacagaaaagagtcgaagtactcgtggaaataaataagaacgacccaagatgcgttttggagaacttgcctccgggactggaggcgctattggagtccctaaatgtggttacagataaattagaataatattttgtataaaaatcttttaccatgaaatcattattacaatcaaaattacgccgtaagaattttatgttttggctttaagatttcaatttttagcttaaaaatgttttgaagttgttgatcaagaatttaaagattttatttataagaaaaatgatcactgggaaatgtaaggagatctaccagagatctgataattagatttcttaagtaaactttttttctgttttgaatttcataaataaaatatatattttccttaatgtataaattcaaaaaatgatgcagaaaggtttctcaatgatagaaatgaaagaaaaatcatcggattcatattttaaaactcaaaacctttctccattcactttattttaatttcttttcaaaacatgaacaagattaacttttatctataacatttgaaagtttcacagcataaagttttccatcccgttttaatttctgaatacacgcgaataaattcagcctttttgatgatcttattatttatattaatgggatgtctaaaataacataaatatatttaaaattttctcaataatccgatgccgccttttaatattattcaaattttatgaaaaatttttattcatcacgaatgcttcataatacaattgctgtgttacgatagcatccgactgatacttcagtttttcgacgatgttgtccatgaatccttttctatccaatgcgggcaccaaatacagcaaatgcttgatcaatgtgtcgaagtgctttggcctgttcaacatgttctggtaacttgtctcgatgcattcgcttaagatttcttttctcttttggaacgtgccgaagtccgccaacgacaacacaagtaaatactgcggacttttgaagatgaagaactccaaattcgaaaatatttggtaataaatcgtttcgtaatcatccgtgttaaccttagatatgatcgaacataacccgtgaacaaattcgtcagtcttcgcaagtgatataaagtttggaacaatcgatgaaaagatatctgtaagtaaatgaattggtataatgtcaatgatcaatttaagatataaacatgataatgaggaactgcttctccaatcaaactttaataaaggcgaaagaatttgttcgttttctttgtattctttgatggtgtttttaagtaataatggatactcacgtgaattattgtttcgaaaagcagatataataacagtgggtaacgaagcggcatagtcaagatgcttaaatgtgataactaacgtcgaaagaagattgcagccggaattaaattgcatgagcttttcaacgttttggagtaatgcatgattccatacaacacattcatatgaaattttcatatggatattgtatataaatgaaataccagcttcatgagcaagtaatatatgataacactttataagagacatcaaaaaccattcatcagaatgcctgccagaatatagctggacaagctgcttacgtgcttttgagtaatatattaaggtttctattttattacgagccgccgtaagtgttgatatttcagcaatactattagttggtgtattggcttggggtgtgggtgatctgtattgatatcttcgtgactgttgctgttgtctatttgtgttcatttgcgcccattcccaataacggctatgccgacccaaaagtgtcttataaccgctattttttcactacatgtaaaatattcaaatatgatgtaaaacatacaaatcatcctcactaaacctttaatcagaccattggtcttacagaaaatttcttaattaattaataaagcactacatgcacattttataacataaccattgaagctataaatatcaaagaatgatagaataatttgttattattaaatgattcattttgtgctttgtgatgaaagaataaatttacagaattatgcaaacttatcttgttttttaaaggaaaatatttgatttaattatatttatgaataccagtatatattaatttttttttgaaaaattgaagcttatttagaagtgttttcttgataaccaactgtctatttcagattatttgctgggtaattaccacaattaccgccaattgaatctttgcttctttcaccttcatgaagttctgaaactgggggtatgacacttttctatagtcagaactagaaataaactgaagaatcaatgctgactgaactaaacaaacacatcttagaacaagcaagcaaatttgatacgttttatctatataacgaaaaacaaatcctagaaagcattgatagaattaaacaaaattttccagatatagattttctttattcaattaagtgtaattcaaatcctcatgtgctaagcactgttttttctcatgggcttgaggcagatgcagcaagcaaaggagaagtactaatttcatgtgaggtgggtcttcctaaagaaaagatatattattctgcaccaggtaaaacaatttccgatatagagcagaccatcacaaaatcaattcttattgctgatagtattgacgaaatccttcgtatagaatcgatcgccaaacgcatgaatattcaagtttctataggaattcgtcttaatcccaatttcacattttacagtgaccgtggtaatctatctaagtttggaattgatgaagatcaagctattgcatttattaagaacaccacactacaaaatacaaaaataaatggcatacatgttcacctcaaaagccaagaattaaacccacatgttctttctaagtattacactcgaatgcttttacttgcagaagagtgggaaagccttacgggcggactttcatttctaaacttaggatctggttttggggtaccccaacgatcgaatgatacttcacttgacttgtcaattctttcatcagaaatcaaccctcaatttaagaaatttaaagaaaaacatccaaacactcgaataatcattgaaactggtcgttatgttgtatgtaaaagtggttattatattatgaaagttttggatcgaaaagtttcgatgggtaaaatcttcatcataataaaaaatactttaaatggctttattaggccctccattgcagagctaataaagaagtatgcttcggaggatgatcccgctggaacagaacctttgtttactgcaagcaatgcattccagttctttacgttgaaggatgataaaccttctgaaacagtttctttagtaggaaacttatgcacagctgcagatgttgtggcggaggacatattgatgcctcatcttgaatatggagatgttattgggataacaaatgctggagcatacgcagcagtgctatcgccaatgcagttttcttcacaggaaaagccagtggaattgttcctaacttcggacggatgtataaaacagtaaattatgttataaataaagagcataatatttagtgaaagagaatattcataaaatgataaatttgtttggataatttttccatttagtaaaaataaatgaatatctttcacaaagtgatgttgtttcctaaagttttttgatattatcatttggaatttttggagtttcatatttttaattttactggaataagaagaataattaaggataatttattttatgacaaatttatggaaaaaatttaaacaatcaaagattaaaaacattttaaattgtttaaatatgtgtattgtttaacagatttattgaataatatcatatgtcgagaacccatttgttcaatgtacaaattattcctattatgaaaatgatggaattctttataacgaagatatcatagatattatttgttatccaataggaaaagaagataaaacatttgaatttgggatctcatcatgatgagtttaaaattttaaccaattgatttatcttcgtttggtaatagaaataaatctaatttgttagagcatcgctctagcttcaatataacagattattacaagaattttcttttgtttctaaactgattagatttttatgattgtcactttttatcaataaacgtattttcccaaaatcaatgcgaccaaaacttcatcaactccaaagtgtcattgcccacgaaggtgaaatcaatgcaatggcacttggacatcgaactggttcagtttttgctacaggcggtgatgatcgatttcttcatttatggtcaattggaagtaataatcctcgtgcttcatttgggccatttcaaagccccatcacagtttgtaaatttgacagtacagaagaatcaataatttgtggcaataatggtggaactgttatgcattttgatctgaatggatctaggtgtatttcaaattgggctgcccacagatcagcagttcttggccttgcttttcatcctcaaaatcccaaattagttttatcttgtggttatgatggaaaattacatattcttagttctgggcaacgacgaccaattcaaagttataatgctcataatggaccagccaatcatgtttcaatttccagtgatggtcgttatgcagcaacttgtggtgatgataaaacagttcgagttttcgatctttcagcacagaaacaactttttaaattcgacagccacacagactctgttacgtgcgttgaattccatccaaccgatccaattcttatatcttctagtgttgatcggtcgatcagattctatgatcttattgcacaaaaagagattccagtatcatttccacttgattctgcgcccgttgacattgtttccttctccccaacgcataacgttgcgttttccatatctgctgattatcttaagatcgttggatggaatccaccagagttttttgaccactttactgttggccttgagaagccacacgacgtctccattgacgaacaactcataactattgcctcctctcgacatgattgcgcattaatacatcgaatgcgtctcagcaacttaaaaccattttcgcacatgagcacacagagtttaagtcctctctcagagcccaaaaagcattcacgtccgaccactcctcgattaattgatcaatcagcgatttcacaatttcgtgctcaatcgccaaaaactcgaaagcaaactccgaacaacaaagaatcgcgtgtgcagtctgtccgtaagaagcaaagcggtccttctacaaacaacaacaataataataattcttcgaatcctgttttgatttcgaccgaatttcgaaagtcgaaatcgacatttatgtcacaaatcaatgataaatatgctcgtttaatgcggataaatgagatgttacaacaatttgggttaactagtcttatgcaaaatgttttaaataacgtcgatttaggctgtgaagttttgagcatcttgaggttgaaacctgaggtagtaaaacttgagcactccgttctgatgttgcagatagcgtcgaaaatattcgatgccgaccaagatttggccgtgcagactatagaggcaatgctgcaaggattcggcaaattggtgtacgcaacacaaagaacaacgctacgaagaattggtgtcgacgtggcattggaagaaagaaaagaaaaatgcgaatcgttcgtggaggcatttagagaggtggcgccgaagctcaaagctgtggcttcgggaaagtcaaataacgcgcaaacagcagcagaaatcttggacgaatggaaaatgtttttgaaatgaaatgttcggtttgatattttgtgttttaatgcgaattcatttaataaactgttgtctacgaaaacaaaatgaaattaaaaattataaaaacagaaataattttacaaaaaatttcacataacttagtgggtttaataatatttaaatattttttttttattataagcagtgagttaaatgttataacattttaagggtggattgtgtcactttttaactataaacagtttttatatatttgtgtgtaatgtaaatagttcacctccgatggacgaatattgcagcccaatatttcgtatcgcattaatgagtgattcaggcgttggaaaaacgcaaatttgctattggattactgaaggcaaaaattcagatgagcaacttaaacctacaattggaatgatatattatcatatgcaaaatacacccattggcgaaggagtggttgttcaagatacttcaggaaatccaaaatttagacctttatataagtacaagattttagctcatgtcgttctcattgtttatgatgtttcaaaccgagaagcttttgatcaagttgagtcatttgcttcaatttttgacgtaaaacctcaagttttacttttagtcggaaatacagttgcaaaaaaagaacggcaaatatcacttgaagaaggttcaaaaaaagctgaggaaataggaatgtattttatagaagtgaataccattacaggcgagggccttgaaatgaaaaaaaagcaaaaatgttttatccaataagtcaattacagatcttttataaaaaaaaaaattaaataaattcgtttttccatatgaaaaaacaaagcttttttcttgctttaaactattttgtagctggttccaaaacctcaaaatttgtgatttgcattggaaaccgtttaaattgcgttcaaaagacttttgaaaagtttacattatatggaagaagaagaaaaaaaatttagttcaaatgattttgaagtaaaaagcttaataggagaaggctcatatggaaagattcaactctgtgaagaaaaagcaacagatcaattgattgttataaaagaaatttcattacttaatagaacagcaaaggaaattgaagaaactcaaaaagaaacaaagatactttcgctccttcaccatccaaatatagttgcatataaaggatcatttattgaggataacaaattatacataatgatggaatatgttgatggaggagatttaggacaaaagatcaaaaatgcaacagcaccgtttgaagagtcccagatattaaattggtttgtacaaatttgtcttgccatcaagcatattcatgatcgtaaaatcatacatcgagatttgaaagcagagaatgtatttcttatgaaaaatggaatggttaaacttggtgattttggtgtttccaaaattctcgataacacatcacaatttgcaaaaacagcaattggtacaccctactatatttctccagaactttgtcaaggtatggagtataatgcaaaaagtgatatttgggccctaggatgcatcctgtacgaactctgcacgcttaagcatccatttgactcaaattgcctaaacggtctcatcatcaagattgttagaaacaaaccagcgccaatttctaatcaatattctccaaaacttcgtaatctagttgaccaacttttacaaaagcaaagtcgaaaacgacctaatatcaatcaaattctaagtattgattttgttaatgaaaaagtcaaaaatttattaagtgttacaatgcaaaagatcgagtttagccattctgtttttcatggttataaaggtggtgaaacaccacgagaatatgatatcccaaataaatcaaaagctcaattaaacccaaccaaaaagccaaagaccaacataactaagccaaaggacactattcaaagttcacgtaatgccaaacgtttccactcccaacaatcatcatcaacagatcaaaattatccacgtaagccattaacagttgaagaaaagcggcgaatcgaaatggagaaagaccaagtcaacaaagccaagcaaaaagccgttctcgagaaacaaaagcaaaaagaagccgaacgaaagaagcacttcgaagacctcaaacgcgaagaaaaagagcgcaagaagaagtacgaacaacttgagtcaccattccgcaaagccatgaacacaaaaagagcgcaaaacgttgtcgatggacaaccacaacaacaaacgaagccgaaaacaccgaaaagtaaatcgataacgcaacaacgcgacaaagaagttgaagacttacgtaagctaattcgccggaaacgtaacgaagcaaagaagcaaacagttgataacaatcacattcaaattggaagtgttatctttccaattgataatgatgacgaatttgtatcattagctgcgtatgcgcaaaacattgtcgagcatccaccagagaatgttgaaacagaagacgaaaatgaaaacgtggaaagagtgaagtttatgtttaaaggaaaggaattacaaattccttcgaataacgacgtgaattatgagaacgaattcgtgagaatgttcattgagaagggtatagggtttgagaaattgtccgatgtttataaaattgtggccgagaaatcatgcgaaatgaatgaggagcaaatgaaagaggaaattgagaaaattcttgtgaacgaacatgaaagagattattatcctttgatacaacaattggtgttgtcggataatataagtgaaaattaaactgttggtatgaatttgttaatatgtgttttgttttactaaaaaattgatactgttattttggttcgataaatctttcagaattttttgtaaaaaataaaaattaaattaataattttaaagctatataactattcaacgaatcaatgagtttgaatgaaacgatcaaaattcacttaaattcaatcacaatttttgtgataactgtttctatcgtactcccaaaaagttacttttgaaagcctatatcaaaaaatcaatacaatgaggccacaccataagccacaatcatatcccatgctaaacataccttatatggaaaatttaatcacgtaccttgataacctattacagagaagccaagggacgttggatattgtagttaaatttaaaaaaaaaggcatgccgattggcatctaatattcgattacaatattatgttttttttttttattttttatcacaccttattgttcgctaacccagtccttggattacctcgcttgatcagttgatttgactgtacagcgatgttccaagtaatatggcataatcttcctattttgttggttaggatcaagtttgtacccaccgctgtgattctgtgaagtttttttttcttcagtccctgtcatttcgttttcgaactgtgtagaaaattttggtggtcacccaaattgtgtaagcttgttgaattgatttgaatccatcgccgatcattttcaattcaaacgtttttcaattttttttgaatttaacattcacttttttaaacgtcaccttacaccaaaaacgaatattatggatgctttttagttctttttgcttgtgtcttctttttgtggttgctggctttggtttggcatcggattcacttgttggaagcgtggaatccaaggaaactgaggcgtcctgttacttggggttggaagtgcagttgaaaatggattggattttgcaacagctgttccgaacccaaattcacttgttgcctttgtatttgttggtgaggagtgagaaaaggatgaagatggtggaccccacatgctgttagtaactattaaatggcgctgtcattcttcatgttgagtcaccccaagttatttattgatctgcaaatatacaaaagatcaattttgggcaaatatttttgaaccaacatgtgttggttcaatcgaccgttaaaatgcttccaaacaaataggtatatggggcaccccaatattattaacattgcaaacatgatgaaaaaggtgttttttgcacctgaaccaagcaagaataaaacaaagtttgcaaatccatcccaggttgctttgttacaaagttcctctttgtatgttaaagtttcttcacttgatagaatctctgaaaatccagtttttgcaatcgaatacaaaaacatttcatcgcctccctgtacttcctcacccacggaaaatcatgttccgaaaaatctcgaaattatcaagaataataaatcattctcaaaaaataattcttcagacttatttatcaaaatccctgaaaatgactgggattcatgttccttccgtttccacaccattgttgctttaaattgtatcgggattattccctcacttaccaaatccatattttcatcacaagaaatctataatttatattgcaacaaattttttgaaacgtataacatccaatcccaacccattgacattgcattatcacaattattttcaaatttatttttttatttatcgttgtttaatttcaccaacaccaacagtcctcaagagaaacaatcctacgagcactgtttaaagctatgccaagagttcagtaacaagtcagttcatcaactttccgagtcatcagaaaatcgatatttttcattttctgaactgaagtatgccatttccaactatcataaaactttttttcctgaccgtccgatcccttcagacatcattgattctaccacatatcatatattgtcatccaccgtaatcacattgcgatacattttagttagtttaaactttttgtctaattcatctggatcatttcccgatctcgttgagtccattcattcgtatcaaatctttcacaagttgcccattggcgatttcgacttttatactttgcgacacatgtggaaccaatcaatgtcgaacaagtgcagcatatatgggacatttaacatgtgcggcgttaatattccgattccacatgaaatagactttcatgagaaacttggaaagataaaaatcgatcaaaacaaaaacgaagagctaaaagatataaacaatttcgttaatgatatatttaatagtgtttatactcacgtcgaagttccgaattcgatgataaataaaattaaagaatcaacaaaaaaacaaatgaattatgttgcaaaattgatcgaaaaacaaatggagttcttgcatattattaaaaaagtggaaggaggaatagaagcaaagaaaattaaaaacgaaaacacgaaaagagaaatagctgaagcaaacgacgtgatagaaaacgtgattaaaaaatggaaaaatatgaaaaaggaatcggaaaaaattaaaatgatcgtggagttgcaaagaaaaggaaacgcaataatggcaatgatcattttggtgttgatggttttggttgtttggaaatattttagaaaataattaaaaatgtaagaaaatgcgaattttgttttttgttgcgaatataacttatggaattatatttgtctaaaagtactcaagaaatgaaattttattttgcttatatattaaaatgatatgatataaattggacgcatgttcgttgacattaaatattatgtaattttcaattaagatatttataaagttcttaccaaaaaagtgaaaataattagttattcaaaattaaaatgcattataaattttaaggtattcaatgtatttctttaaattttttctatcattttaaatgtttttacagtgagtttaatctttttatgaattaagttaaaaattattggtttttattcatgttcatcataagaagaaataacatttgttgatgctaaacataacaaatattggcgcgacagcatttcatctctaaattaagatgcgtctcaagttaaaatcctattgcaataatgggagagaatgatcaggggatgtaccaatcttaaatctgtagttcttgaaggtactgtctcttaaatatcgtataatccatttcttcgttactaaagcttgcaaatggacatccaaagaaagcatttatttcacttattataaaaatgttcgagttttatatgatgttcaattacgaaacttttagaaaaattattttataacttcaaaagggataaattgtttaattaattttgcctaaaaatgtatagttaaaaattgtaatatattacaagttatattttcactgattgagatccgaactccatatattacatatatataaagaaaattatctaatatcaactcactttttaacgaataccaaaatatttccctaaatctaatctaatataagaagctttggacaaaaaaggaattgcacgattttttcaagaccaaataaacatagaaaccactgtgatcgcacacaaatattttgactgctttatgttgctctcagaaatatttttgtggtaataacgttattctcagaaaaaaaaagaagttgttgacaattttctgtgatagtttggtcaaggtcttctttttctatacgttgtttcttaacaccgagtttgacttttctgatggttagataggtcctgaaaacaaaattcaaatccattatggcatttggatgcttttggatagttatccaaatgcttaatttagtatcatgtaactcacatgttaatggagaagaaatggtaaattataactcaagagaaattatttcaaaaaacataaatattcaaattctttcaaacaaaataaagccagttctccaacgttatgaaaacgatatttttgcattattcacttatcttccaaaaagaaatcattttcttataaggaatgtttcaaaaattaacgagaattatttactatcaaattattcttctttggtttcatcaaacgatagaaaggatttccaattttttaatgttgcatactattttttactttttgattcatatttttctttcattttaaatctttttataatgagcttaattattttatgtttaattaagttaaatattattgatcttaaaaatcacaaaaagaaagaaattttaaaagttaattttgttttgataatatttgttttgttttttggctcatcaatgcaagcatttgatcctttttctaatacattaaatattcttacttcgaatgattttacacagacatatcaaaacaaaacagaacatgttatcatttcgagtggtattgaattaattccagaatatgcatttgattcatggatatttttagtcacagcatcaattggagatacagttaaagaaattggtacgtctgcgttttcgtcatgttcctcattagaagaaattacatttaatgaagtcataacaaccattggattttttgcgtttcaatattgtgaaaaaatagaaagtttaactctcaaaaaatcacttactttagtaaaacaaaatgctttcttaagatgtaccggactgaaatctgtagtactagaagaaggattaacatcacttggaacatttatattccaaaattgttataatcttgttgatattacaattccaagtacagtttcatcaatatcattaaatccattccttcgatgttatagtattaaatttatcaaaatctctcaacaaaatcgatacttctccaataatgaaaatgatggtgttttatatgataacttaattacaaagctcatcagttatccagcaggaaatgatgcgaaaacatttcaaattccaaattcagtaacttcaattgaatctcatgcattcgataactgtcttaatttgacttcaatttcattgggaaataatgtacaaacaataaaagattctgcattcgctaagtgtctatttacgaaattcattattccagattctgttacaactatgtatgataatgtcttcaaatattgtgaaaacttagagacaattataatcggagaaaatgtgaatatgattggattggaagcattttatcaatgtacatcactgaaatgtatttatttttatggagaaactcctccttatattttgaataatgcttttacaaatgtttcagcaacttcagttatgacttctaattcatatgatggtgatacatttggtacattaaaagtttcaaaaggaacaacaattgatgaatgtcttccaccaacactcacatttacacaatcaaatacattttcaaattcaaacacattttcgaattcatttacacaatcaaattcattttcacaaagtaatacattttcgtgttcatttacaaaatctaattcattttcacaaagtaatacattttcgtgttcaaattcatttacagaatcaaacacattcaccaaatcaaacacatttactgaatcgaatacattatcaaatacatttactaaaacgaattcattcacacaaagtaatacatatagtaaatcaaatacattttcgaaatcaattacatatacgcaaagtaattcatttactaattcaaacacatacacaaaatcatacatgaaaaacataaatttaacacattcatttgtcttatcatatattttgtcaattactaaaacattgactttatataattcatattttacacaatcatattcattcacaattatcaattcaatgttaaaatatgttgaaacgtcaattattcattacgaatattcaattatattttattcgaaatattatagtatttattctcattattattttatcattaatgaagaagatacaaataataatgaaaaagatgatgataaaacaaatatttatattattgttggaattgttattgttgttgtaattatcattttgatcatcattattatatttttgattcgtcatcgaaccgataaagaacttaatgaagaagaaacaaatattattaatgatactgaaaacaataataattattcgattgtcttcttaccaaataatatgaaagaagatccatttgcagatgatttcaaagaagataatttagatgttcatatataataaaaatagaaatatattaataaatagctcaaatagttaatattttatttattttatattgagttaaacttaaaatatatatatatatatatatatatatatattaatcaaatttatgagaatataaatcacatacttaaatcattaataatgatttaaatatttatatttaatgtattttcctcgaaatcttttgcaaaaggatcttcttcgatatgagaaaggctcgcgaagttatccattatgatttcattattattattattattataattcactttttcttcaagttctttttcacttgaactttgttttcttttacgaaaacgaacaaataagataacacatatcaaaacaacaatgattattccaatactaacacaaacgccaattataattttattgattttattattattcaaatctgttctattttcattttggagaatagtataaaaacccgaataatacgaaaaatacattgaatattcaacaactttatattcgtaataaataaatttagtttcaacatatgaatatattgaatcaataagagaaatagtaatagtttgaagaattgttgattctggaataattgtaagtgaaattgattgtgaatataaaattgtttgaacaaatgtttcaccaaattgtctggatgcagaaaatgtatttgattgtgtgaaagtaattgattttgtgaatgaatttgaattcgtaaatgtatttgtaaacgagtttgacttagaaaatgtattagatttagtaaatgaacatgattttgtaaatgtgtctgatttggtaaaagtattcgattgagtaaaagtatttgattgtgtaaatgatttcgagccagtgaatgaattcgacttagtaaatgtttttgtaaatgaattcgatgctgtgaatggatgtgttggccaaggatattgactgcatccttcaactgctatatcttttaatacattaagttcaccaaacattgttccttgatataaataagatgtcataatgtatttagtttgcgtatttgtaaacacatttgtaccaattgatgatggcgttttttgacctgtataataaaaacattttaaattagtacaatcttgaaatgaagaacttccaattgaagtaatagtttcacttataataacttcttttagattattacatgctgagaatgcaaaattttggattgttgtaattgtttttggaattgtgatcgatgtaaatttacatgagctacatgcatatgttccaataattttgactgaatttaatatttcaaatttttcactagtaattcctgctggataacaaacaattgttgtacaatctttgttataaagaattccatttccactggaataatatatgttttcgctcgaaacttggattgtttgaagatctgtacatcctttaaaacaacctgatccaatagaagaaacttcttttggaattaaaatatttgttaaagaagaacatgattgaaatgcaaaatctccaatagtttcaatactttcactaaatgtaatactttttaattttggacattctgcaaaaacataattttgaattgtacttattgatggaatattaacatttgttaatgatgcgcaagaacgaaacgcattattggcaattatataagctgaattaattgtaacagaaattaatgaattccattgataaaaagcatcatacccaatttgttctacatctccttgaattataagatataatgtttgactcttgaacaaatccctatcatcatattcataaagagtagctatggtataggtttttgttgtttgctcaaatgtttcgaatgaatgttcagaataaatcacaaatagaaaacatagaaatatgcgttgaagtgtttcttcgttttgagaacctctaaaatctgatgtttcatattttgattgatgaaattttgctttaataaaaaataaaacagaaattaacataataaatattaggattgattgaactagttttaatgtggaataagttaggatatcgttaaaaaataagaaaattattttcgcttgattaacatatttgatgtcaaaataaatctgtttctgtaaaataactactgacaaatcagaatccgaatcagcatttattcttctaatatatataaaggtatataatgatatcaaatgcaaattagggtgactttctttatacagagaataaaaatgactggaaatgatattacaatcatttatagcatgaggaatttgaagaaacaggtttgtaatttcgtaagaaacagatgttatatttgaatcattccccatttttttccaaaacatcaacttacatgaatcacttgatattagacataatgctggtgtagacattgcagccagtacgaaacaagcgtatttgagccgaccaaacatgttgtagaacgtgaaatgataaattttcaattgagcgttgctatcaaaccactcaaaattcaaagaactataggtcgatattttaaaagtcataaaattcgacaactcaaaaagttattaaagtgatatgaatatgttatcatcgaattcaacttcaaataagcatatgaactttcaagttacacttattctaaaatataaataagactttacttccatcattcaatatatttaagaaaagtgtatcaatcatcctaaaattaaatttaaaattataccaaacaaaatagctacagtcggcagaacgtagattctctggtaaatcattacaatattgtaaagaacatcttttagcatataaatttcgatcatgttaaggggcgaacgttaaaatatttcccaatcgtttaacgttcacggagcaccccattgtcatatcacattccctatcgaccgttaatattaacgaatataatttagtgatttaatcaactcaacaaaacgcattttcgtcgtgtgtatcgtctaatgtatcaccttctgattctacgaactcgaaagagcatgaaagctttgcatctatttttagcattgcccccttatttccatattcgccacaataatttgatgctgagaagacggtcaccactgtctgctgtgggtagaatgggaactcgtaaccatctgggacaacctgatgtgctctacatatcaaatcgaagtcatatttgtcgaggaaatcatttgcaacatcagcgccaaatgtatatgatgtaccacgctcagactcctggaagccattgtagtcagcagaaggatccgcccataccaaatcagagataaatccgttttcaggaatatcaagtggccgtgggagctcctcaatcatttcaagactttgcatttgcccagagattcctccatgaacgcaaaagatacggctactaatgactgcggctaatgggagatatcggaatacttcattaaatgtcttccagattccgcggttgtgctttagtttgcactctccgaggaagccgtaaagttctgagattgtttcggtctcatggttacctcgaagtaagtaaacattttgtggataaagaagtttcatgcagaagagtaaggtcacagtctcaatagaatggtctccacggtcaacgtagtcgccgaggaataagtacttcgttgtttccgggtttcctcctttttccaaatattgtaataaatcgttgaattgaccatgaagatcaccaacgacgcatatcggtgcttgtatttgtagaagcattggatccttaagaagtgcttgtgtcgttaaggtacatatgagtctcaagtcctgcgctgtgagtggaacagattcggattgcttcagtccgcggctgctgatgagcttcttatagatgagttgcaccgtcgccttatcatcggacgaaagggtaaaaccgtcttgctggttcatcgactggcgtttcgctaaccgtcaaacacccttcaattatttgaatgtgatcagcggtttgcccgcgaatgtattatattgctttttcatcctgaaaagtgacatataccgatcatattgcactcaatataacgataaagaaaacgatcaaagtcttcacaatggtgtcacctttttcttactttttgctctgtgattttggaaccagtaagaaaccgattttaacggagcgttcagcttctctgctatttccattttctcgagtttacttggctttgagttcaattcgaacattttctttaattcatcgatttgttgaattgtccatataaatctgacgtcggggttcatgtttctcttcttaggaatagccattgaaggcgttcctttaccagccgaatttacagcatatataacaaattttttaaatttgtcaataattttcgccttagctccaatggtagtgtcgccagggatattaaacaggtgtaaaacatcgccgtcaaaattgattccttcgattataaatgaatcaatatcagatcccccattctcggcaggcaaactccaagaaaactcatattcgcaatcgcctaatttgtccactttgaagtttgtacattctgatggaactgttacaggctgagtttcgaaatacaaaggctctgagtcagtggtaccacatccgttgtcgattcttatgaacattttatactttgttgaaccgctaattcttatttcgagtaacgacggaattttgacacaatttaatttatataatttcaatgaatcctgcgtctgatttattacgatgaatttaactgactgaaggaatggcgaataaggaattggaggaatttttacgatcaaactacttgatgagaatgtcataatttccggcgaattaatctgtttaattgggtaaaagaaaacagtgctcaagctgaagttatcattgtcttcattaatgtaatacacatttgttaagtcagtgaatatgttatatatcggcaatacattgtacaacgaacatttgatgatgtaaatcgttttgtccattacactgagcgcaaatggctgaaacaatggaagcgccgaatacgggttaaatgggaagtcatggaatagtataaacgtaggaacttctgattgatcaatgccaaagaacaacgcctctttcatgcggcttatttcgttttggaatttgtcttgattttcaaattcgtcatagacttcccaatgttttatgtcaacatatagtagaaatggtttctctttcgtgtatattattaatgtttcgtcgtattgaaacgtggcgaaaatcgtcgagatgtgatacgtggtttgaaggttatggaatgtggaaattttggtgttgatgcagattgattggattccaagcgcatccgctttggttacgagtaaaagttcttcgttgatttcattaatatgcgcaccgatgatggttccattggttttgatcgagtatatttcgattttccatgtttcttgatcaagaatgcctaaaaatggagttggagaaaatgaaagaattaatatgttttcaccataatgatatagttttaaatgttctgctttgatatttatgtttaactctggacctgctaattgtaatgttgataaattcattcgtaagattttaacattaatctcattaaattttgcaatgattaaaaattctccattaagtgtaacaatggaacttgaattttctaaatcacttgtgacaatatgaccaataattacgtcctggcacacggggattgcaggcagcagcttttgagatgttaaatccatgtgatttgatgcgacggttgtacatcaagcaaaattgtcttaattgaaaattgaacttttgaataaatttaaattaaaatgtaaatattgaggcaaatatatatattttttaaaaaatacataaaaacaatcatcacaataatatatagttatgatatataaaacatggactagaaaaataaaaaattttatattttgatgatattcaattacatgtaaaaatttaaaaatctcatggacatatcttactcactattagttgaattacttcacatcagtataaatgttgattttactaatagctttgattttgagactttctgctttcacgaatctatgcataacgaaataccgaaaagtgctgaagcatactaatatgacgcaaaagcaagtgttattatctaaacctgaatatgttgtgttataaatagctttttgataagtgtaaacttagttataaagttccgtcttcttagaagaaaattcaatgtgaatagtgccacataatgaatttatgcgtattcacaagaaaaggtcaaaggcgttccaatgagactcgtattttttcttatttaaatgaataccataataaaattaggaaaaaaataaaattattacaacggttttttcaaatattggtcgatcatttctatcacaattcatgaattatcgttgtaaaatggtgataatattcgatttctcactttttctgaagaatttttcggtgcttttgaattgcctcaaaattgtacgatagatttattaatttttcaggaaaattaattcagttttgtatcatcaataaaccattcaaaatcttataatcatgcagaaagttataaattttggagaaaacaaatttgttgtaatttatatattccttagtgttttaattaatgcagtgattaccaatatgcatatagtaaacacaagcataatattttggccaaaattcaaaaactatcaaaaggatgataaaaaaagacataatttaataaaattggtcatatacgtaatgaattgatcataatatattatcttcaagtatattagcattccaagtataataatcagttctaaggagaaaaattgtttgatttcatctgaaatttggaataaatacacgcaataaattcaatgcgatcatttcaatacaatatttgagtagaataattttcatcgatataggtttactaacaagcaaaaaagtgactcataatatttcaaaaatcagactttttgtgttcatgattaatacaatattgtttatatcattcaatttcattattatattaaaattaatttaacttataattttcagtacagatgaagtaaattttatgaaattttcattattatcatctttagtatttgtatttaaaattaaagtattttatcttgttcctaaaaggagttttcgtctctttatttatttcaaaaaatatttgaacgatacgaagcggtttgctgacaaatttgaagtgccaataatgaccgaaggctttaacttcctcctcccaactatctgcaacgaaaatttagtagatcctgacacatcgcaatactcattagttgtatatgatagaaagataatatctgaggctacaagggtcataatgaaaagttttgaatcaatgcaagatgaagcatatatttccactgaaaaaaggctcgacacaattatggaattctatgccgttgccttgacattggaagaaacagattatgtagatattggtcatgcaagttcagtatatcgtaaatggcttgaagattcctcattatttggttcagctgaaagacaaaaccaatatatgattcgtattatcaaacaactgtcgtcaccatttaatttaacaacgacaccaaacattaagaatgaaggaccagttcatcaaatcctttctgacatcattgatagctatcgtaagttatttactgaacgtggtacaatgcttgaaacgaatacatggcgaacactagtttttgttcttattggaatctgtcatcacttaattactgttagttcctctttttccaagaagggtcttgaagaacttaaatcccaagccatcaaatgttgttttttgtcaatccaagtatccccatttactcaaaactacgacaaattcaaagatgtctttgaagtctttctcacccatagtaagatatggtctgatgacctaatctttattcaatgttggagtcaagagataagtacattattccgatataccagtgaacgcctatacaagcttccatttacagacaacctattccaaacggggatctattccactggtggcgagactatatctgatcgatcagtatcgatattattttataacacattacgatcacttgaattccgccgctcatttgcagatccagagtccgcagaagagttatacaaagccattgacaaagttacagacatagccattgaagtctctaagatcaaatcgaactcatttttactcaagttctctggcaaagcatttatggagttatttgggaagatattaacatttgcgcccatgcaagacaagcgctttgacaaagcagcgtcaattcgagcgatcacgatcatcaaattgttgacaaactttgacaagtcaggcacagaagagactttcaagaagttaatttcaagtttatcattattctttgatgacaccacacaacataccgaagtcgttgagtcatttctatctaatggtatctcattatatggctccgatcgacgatttttacaattgatctcacgaatggttatccaaagtttaccattaatcgaaattaataacaatcgatcacaagaaaagaattattcgattgtctcaatgtttgtttcatccatagaaactcaaatatcattaagtaatgtcactaattatacctttaatgacacgaatttatttgataagttatacaaaaacttacaaaacataaacatacagccattattatatatattaatgtgtcgaggaattaattatcaattaccaatcatatcgaagatgtctgaatactttagcttacaaacattccaatcattagttgaacaagaaatatcatcagcattcattacaggatgtattgatttcattggtacttcaatacgatttataccagagatatcatatgaaattaaaaagacgaaaatcttcaaacaaatcttaaattgtatcttaaattgtcgtatccttgatgtctatgatccattaaaacttatctattcatgtttacaaatgatcttaaatatattggataatgattcgacattatttaatgagcctggaactataccaatgatatttaagtttatctcatttgttaataaaaatgtaagtgaaaagaaacgtcaacgaaatccttcaagttctaaaacaagacaacattcatcgatccaattatcatctccattatttacttcgaaatctccttcatcaaatgacttctcaaagttacaatcatgtgaatcttcaccacgttcaagtcgtaagaattctgcatcttcatcaaaacttaattcacaaatacattcattaatatcattattgttagcaagattaaatttacatttaccatttaatgatcgttatacacataaatttaattcatcgaatgaaattaatgaacaatttataattaaacaatttaatattaataaccctgaaatacattactttactgtagggagatcattattaatatcattcattgaacaaaaagataaagatgaaacatatatattatcaagaggacaattcggtaaatctgcttggatattaactgaagatactatgggtactttagaagaaccaaaattatctgatgaaattaaaccaacagatttggatatgccaagtaaacttgagaaagtggacttagtttgctttggtgaaaataaagaaaatattaatgaaatgacaaatgaagaattagaaaacgcagataataaatgtaaagaattatatgcaaaagaatattcgaaatggatcaattggaatgataacaaaaacttcttcatacctttcaattataagcctgaacgtaatcgatcacgtgttgtagacttcatttcaagaattgggttatttgaatcaaacaataaattcgatattcgacctcagaataatttggaaaatatcgaaatatcaatacgtgaattcgaaaagtatgaaaagccttacttgttccctatcgaagtcattcacgtgttaccaatcgataaaagttatcattatactgaagcacatcaaaaaagaatgacacctttgatgttgcggtttttgaaggaaatcggggagccgtttagcatcaagaaagaagattccgaactaatgaattggccgaaattaagaagtagtataccatcattcccaatattaggaggattcggagtgttcatctcaccagctttatgtgacgattctgaaacattcgagaaaattaagaatttacacgctccaattaaggttttgtttaatgaaacagaattcattttgaataaggagttgattgaaaaggagtttttgaatggctccgattctgatcatttaaatttgattttgatcgtaaagccaactttgaatggtttataccacgtgacacaagtaaagggtattaattacccagtgtcacctttctgggaacaacaaacaatgaccccgaagacacttctgttctctttagctttgaccatggaattgatcgactataagcaaatgctgtcttcaaagttgaaggaaagaagaaatgcgctatcgttgttgtgccaagaaaattctcagcctgagctgggaatgatttcacctaataaattctaaaagtaaaattaagagtttaaaattgttttaatttgtattaaattaacactttgctttgatgcattaaagtaaattacttcactgttgttttgaggggatttaattgtaattgttttgaagggataaaaaaattgtttttaagggatttaattataattgttttgaagggataaaaaaattgttttaaagggaaaaataataattgtttttaagtttaatagtaattgcttgttggtgattgtgtttcaatatgtcagaaaaagttccggttacataaatctttaaaaaaagaaataagtaatggaattttcgaagttcatattcataatatatattatgaatagaatcgacactattaatgaattatgatcaaatattttttcattgtcatataaatgaaaaaaataatgactctgttcatattcaaaaagtcttgagaaaagcattgatttcaaatatcaacctaaacaataataaagcaatcaatgatatgctgtctgtcgcttttttatatgttttaaaaaatttgttctatgatcagacatatgatgatctgcaattgcagatgattttatgataataattggatttagaaaacactcaaaaaatagaacaaagatgaaaataagatgcaagtttgtgatttaaaacagtatttattaaaactttccaatactaagaaaaaaaactttcaatcactatctcagacacctttcaatacacaattcgtaagtatcaagaaactctgatggattaaaagatgcaatactaattgtcttttcaaaattagaaaaacagtcatcagcgcaaccatatatatcattacttgctttaacagtgacttttgacatgttcaaaggcctagaattttttagagcgaacaagaacatcgcaaaaaacatcatcctggatatgcactttttgtataaacaacgattattttgaattcaaaaatttccggttaaattttgtcacttttctgctacgaattttggtttgaagaactgtacaaatgattagcagagaagagcatgcaattctccaaaaacaatatgttcaaatgcatgaagaaaaacaagaaatgcaggctcaaatacaaggatatgaacaatcaaatctccaaattgacattttaaaacaacagattaccgaaatgcaagcattaaaggctcgagaagataaacaattccaggaagaaattattcttctcaaaacaaaaatattaaaatatgaaaggagaataaaacaagaaaacgactcttcacagccaaaaacttgggatgaaaaaagattaataaaaatggaaaagaatcttaaagaacttacagatctttccacacaatataataattcaatacataaacttgacgaaatattagtcaaagttcgaaatgaatctaaacaaattgatgaatcaataaaaggaaagcaagcgcttctttccaaagcttcacaaatttataagaaaattggatcttttggatctatcacaatgaaaacaaatgaactcgagaatcaaaaatcaatgattgaaaaacaaactcaaaaaatagcgcaaaggattactaatcgtaagaagtccatattagaaatcactaattccatagaaacaaaagaaaaacaattcgaagatttagaacatcaaattaacgttctccattcaaaaagtgacaagctatcgtccgaaaaacaaaacctcgaaaaagatgttgaatctcttttagatagttataaatcaattagctctaagctttctgaatctgagcaaagacttcaggaagaaaataagacaactgacattcaacttcattctaaagaagaagatctgacgaaaattaaatcacaagtttcgtcagtatcaaagcaaacagaagaaattcttcaaggcgttagccaaatgaagatagaaatcgatgttatagcaaataagaagaatgcattaattgatcaattaaaaaaatcaatacaggaaaaaattgcagacatctcaaggtcaagaagtacatcaccgtatgtgcagcgcttgattagctcacaagaacagcattggatcgaaagacaaaaacttattgaagaatatgagtcagtttataaacagcataaaaagatagccgaagaagtcgaaaggaagtcagaggtcatcgaacaggcgaaatttcttgctaaaatggtgaaaagaagtgaatctaatgatcagatggaaaacatgaaaaaacttttttctcttgcgcaaaatgaaaataatgggctggcgaggtcgatatttgtattagaggatgagctaaatatgttaaaacaaggaaattaaatttgatttgtaaaaaatgtttaatcaattttttgttattaaaacttaagtacagttttaacttatgaacttcgtaaacaatttttttaattcattttttttgatgcaacaaaattaatttcttaaaattgtttgaacatggaaacgattacctaaaaaattacagcaaatacaaagaaaaagcgaatgtaatgtatgaaaacattctttatgagggaaatgttctgaatttttcaaagttttttcttttaatgtatttattgttttttcatataattacattgtgaagaaatgcttttaaaaaaaattgataaataaaatatagtacaaataaatttaaaaaaatgtttgttatactttggatgttatctttgaagctcaataaaaagaaaaataaaaaagatattactattaaaccaggatggaaacttgagaagattcacataataataattggatgtattgcagctggcgtcatattcttaatcaccataggattcgtatattatttttgctgtcgagataatgtaaatcatatgcctaattaccaaaactcattgccacataatccatataacaatcaatatggagtttaataaagattaaatcatttcttatttgttttattaaaatgttttacttatattaaaaagcaaaatatttcgacacatttactaaaacaattattgtctgagcacgtccaacaatgcttcactatacaaatagtccatttttgattgatgtctcttataaatgaaaacaataaaaacgaccaaacccgcaacaattatcacgccaaaaacagcaacaagcgcataaatcgcaatgttctttttcttgcgatcaaagtccaaacattcatcgacagatttacctttcattactggaaaatcaccaaacacattcccttgatattcacccaaaacatatactttcggtatggaacaattaataaatgcgttcactgaaattttaggctcttctgtaccattaaaatatatacattttaatgagtaacagttttcgaaggacttatcgtttatcgtcagactatttgagtagaaaatgatcgtactcattgaattgcaattacaaaacgaatacttgccgatagacttaattgactgaggtatggtcagatcgctcaatgtcaagcagcccgaaaaagcgtattccataatgttgacaatattttcaggtatttcaatatgctttaagttagaacacgatatgaaaacggcggtttctatttcgctaatagaatttggaatattaaaattcgacaaatttcgacaagaacaaaaacaatagcctttaattcgttcgatgttattataatggttaaacactattaagttattacaagaaccgaatgcgaattcaccaatcattttaattgatttcggaatagttatattatacaaattagaacaaaaaaagaaagcaaatccattaatggtagttacgttctcaccgaactttatatcatttaaggctatgcaatatgaaaatccgtattcgccgatcacgcaaatcccatttggcaaagttattctcagtaaagactgacaataataaaacaaacagtagctaattgtcgttatgttatcacttagttgaatatttgttaagtttgaacaatgatcaaatgcttcttgtccaatataatgaactgagtttggtattgttaattcctttaatgaaacgcattgtaaaaatgtttgatttgatataacttgtaaaccttcttccaacaaaacatttgttaaattaacgcaattcataaatacatttgatccaatttctttaatcgatttcggtattttaatttgtttaattccactgtaactaaatgcatcttcgtcaatgaatttaatgttttcgccaatgttaatgtattcaagattaatgcaatacgaaacaaaaccatttggaatcgcatcgattttattcggaatgttaattctggttaagttttgacatacactaaaaactcgtgtaccaattgacgaaatgttattaccgaatttaacatcatttaagtttaaacatccataaaatacttcgtctccaagtgattgtaatgagtttggtagtgacaaatgtaacaataaaatacaatttgaaaatgctctttttccaatttgttgaatgttatcattaaatttaatacttcttaatgataaacaataataaaacgccatatcatttatacttattaatgtctttggtaattctaaagtttcaagtgatacgcaattaccaaacgcataatcatatattactttaatgttatcacttatttcaagatgttttaattcataacaatatgcaaatgaatattcttgtacattctcaagtaatttgggtaatgtgacaatagttaatgacgcacaattaaaaaacgcactccgagaaatggttttaacattcgcaggaaatgtaatcctttgaagtttgttacaatccgaaaaagaatcaatgccaaactcttcaatcgtgtcgggcaattcgatctcgcgtaatgaacgacaataacaaaatgttcgatcgaaaatggacttgatttcactttcgattatgatcgtctcgatcgagatgcaataataaaatgaattcttcccaatggttttgatcgatttcggtatcgttaagttttgtaatgctttacaccacccaaatgaatagtattcaatggtggtgtcattcgtacagagaaatgtaatgtttattatgttgtcacacatataaaatgcaaatgtgccaatgttgtgaacatgtttgggtatcgtgaaattggttaatgagcgacatgattggaaacatgatgtacataatgtttcaacagtatctggtaaaagtatgctatttagcttactgcaggttgaaaaacattctttttcaattgatttggtatgcttgcctaaggtgaccgtttccaaataaatacaatatgaaaatccatattctggtataatggtaagtgtgtctggtaatgtaacgcttttaaggcgtgtgcgataaaatgcatgattgcctaatttgtttagggattttccaatattaactgacgaaaaattactacaaaaaccaaaacaattgtcaccaatctctttaagtgtgcctggaaattgaacactggaaaggtgactacaatatttgaatgtggaatttccaactatctggagttgattgttttgaaatgtaatagaacgtaaggatgtgcacatataaaatgcataatcagaaatggttgttaaacctttgccaataataaccttttgtaattcaaaacatccaaaaaaccccgagaatccaagaactttaactgaatcaccaatagaagcttctactaaatacccccaaccagaaaaggcatttttcccgatttcttcaacgccttctgtaatctgtagatatttaacaaaagttccattaaattccctttgtcctatgattgtgtgattataaattacaagtgtgtcgctttgatcacatgcaatgtgatttaaaaataatgaagtaatggaataaatcagaagaaaatttccaacccccattatgtttagccgttatgttcaggtaaataaagtattcaaatgttgtagcgataaattctctaattccacaagaaaaaatcttcattttagttgtaattttatattaaatttaactctcaaaactatcaagatttaaccaatgtcattgtatattttatgcactatattcgatttttttttaaatatataaaataatcatgatttatgatgcatattaagttcaacatttaagcaaaaactttcatgtttgtttgcaattgaaatcctattatagtgattgtttgcacatattgattccataaaaaatatgttttggttccaaatgtaattgattaattggaagaatttaaattgggaattaatacaaaaaacatgacattttcgtagtacatattaaagcaatcttttgattataaatgttttcaaagaaaaaaatagaggcaataaaaatgtgaagagaagcacttttcaaactcttgtttgtatactttacaaaatccaggtttcatgagccaaaaacaaaaacatgaaatcgaatgccaattttgtttcagtaaatctgtctcaaggcaagaagatggaacttacatatgtatgaattgtcatgcaatccaagatatacaagatacatttgatgaatatgataatttagcagggaacgaaaaaacatccatgtcttttcgtatttctcagtcttcgcaaattgaagatagatcaaattatgttgtgttgtatgaatcaatgcaattaatccttgcttgtcaaactgtatctgctgagaaaattttacatgtttcattgtcagatacagtttttcattacctacaacaattttattatttaattaaaccaccaattaaggaaatttcattcaagttcacactactaattcttcttagtgctataaaccatattggtcttcctgttacatgtcttgaccttatcaggtggattcgtgatggtcttcttccatataattatccattagaatttctcccgtcttcttttacagatcgtctttctccagctgaatcaaagcttctccatgcccccattattaataccaacaatcttatcatagatgaaggctatccaatttcagtatccatgcatcctctaccgaattgcagacttacattatggcgtattgcttctatccttggtgtacccgcacgttcttttgtcgagttttgtattagtttagcgcaagatcccaatctcattacatcatcacttaaaaaaacgcttgatcctaatcgaattttatatacatccactaaacttaatagctatgggttttccatcccaatatctctctctatttttgcgatgacaataatctatcgacttgatggaacagattggattcatccaacgtttcaaaaacttggatttccaatgtttaaagatgtattaaaacgactttcggagactattgatgtccatcccgcatttcctaatctgaatgtacgtttaccacatatgaacaatgatatctcaacactactcagtgataatgagccactaaacattgaagttaaatgcattataaatgatgtatcacgcggatttggtaaagaagtgaaattaccaacaaatgaaaaattaatggcgaatgtaaataatgacgtacgagcgttaatatgcgcattagggagagctttcgggataacagagcaagcaataatgaggcaatattggcatttgttaaaaaggagattcggaatgaaatataaatcttatagtggtggaggtgaagaagaagtgactgaaagtgaagaaaatgagtattttagaatagcagactttaaaaaattgtttgatttgtaaatatatatatatatatatatatatatatatatatatataaatatgtttcttatgtaaaatacttagattttgaggcatttcatgtgtttgagtatacgtactaaaatttgtttaaacactttcgttttacacttgttatttgattcgattttggccattggtaatattatcacacctttattacgatatgataatctttatttttatgcaatcactgatcaaattgacaatttcattgaagctatttctaaatgctataccaagtgctacttcaaattattaaatcatatataaaaacagttacaactaatgtataaaaatcataatgataacattcgtcaggtgttgttcccttagtaatattcaaatttacaaatgttttttgataagtttctaatatcataactgttgttgtatttatatcaataaaagcatcattttgtatttctggtgaaatttctccaataaaatgaatacattttagtgatgtacaagaattaatataatgaatattttcaccaataaaaattctttctaaattaatacaacttacatatgcatcatccataatagaagttactaggaattgcaaataccttaattttcccattttataattcgaatattcaaaaatttcatctaaaacattgataaattgggaatttgcacattctaaaaatggatttccaattgaataaacagaacttggtatataaatattcacaaatttaatatatacattataaatttaaagaactattatatttaagaaaggattgcacaattctttagaatttaatgatttaattgtttcattttttatcaaaaattagatttttataaaaacatatgagatgtgacgaccgtttataaaagaccgttaagttttctggctgggtcgatgagtctcgttttccaattaagccccgatgaatcagaatcattaaagatttggggagaaaacgaaatagttaaaaaattaggaaataagtttgcatatgaaatattttgcaaacaattgcaaaatcaagttattgatattccaacattaggaaaatctttggcattaaaacttggcagcaaaacagggcaatttacttctatacttattaagcatattaaacacttacaaacaaaaaaaacagaagaaactccacatgaagaagcttcttcactcgatgatgcaaagacaaatgaaaatcaaaacaaaactaaagaaagtcttgaagacatagctgaaacgaatgaaatgggctcattctctcgaacaataatttctggagataataatcagaaaactgttattgtttcagctacatttccagtcgaagaagaagctgaagaaaaggaagaagaagatgaagaagaagtagtaattccaaaaattaatgaagagatccaagaaaagaatgaagttgatgagcgtttacttcaaattgaaattgcacgtgcacagagagaatctaaaatcgacttaaacgctccgaagataacatttcagccgcgtccatatcatgaattgtttgtacttgaggttgaagaagagaaaatccaagaaaagaagcagaaaattgtacgagaaacagaaagtagaattttggtcgattcggacgattattattcgtctgagtcagatgaattcattcctcatcatcactcctttagaagtcgtcactgaggaaattgttataataaatgttggataagagaatttgatcggccatcattgaaatgcgctcaaaaagttggcgattatttgatttttttaaaaccattcttataaaagactacatcgtaatacttattatcattaccttgtttagcattatttattataatatctttttcttctttagttaagtttttaataggtttctttggcgcagcggagcagcttgtctgctactcgataactgtgttatcattattagtagtttcattaattacagaatcaacttctatctcaatcatttaactataataaaaaatagcaattagtttgtaataatcttgttttattagcagcatctttatattgaggagaattaaatatattttgaattccttctttatttggttttggattttctttatttgtcatgagttttgctggtgttggatttactttgctatatatttgttgaccagctcttatataaggttgtaatttgtaaacagccaaattattaaattcttgggttgttaaggaattaaaatattgatatttcatcatagattcgtgatttgttatttattccaaataattatatgaattcttgaatttatgaatttaataatataaaaatgaatgatatgataattttcgtaataccttaatgatgtactgatttaacctgattaataatttataatcaataaaatagtttctgtgtagatacatattccctaaataccttgggacaaacgatacatttttttccgagaaaaacgatttatgatcattgaatttatttgatgcatttatttaaaatttatttatttctgcaaaatgatcaattttattgaatgaatatctatacaaatgtaatttgcgaattatctttgaaatactgacttgagatacatttatcgattccttttatctcatattactcatgtgctttcaaatctcaaatatattacatttatcgatttatttgacattctatgtaatgatgttgatttctctatttctccgaatatgagtcaataccacagtttctatagcaagaaatttcttcttttttttgattcatgtctttaattcagatttcaaatattttataatcggcaacagaaattatttgtagttcataatatataatgatcaattttacatattctcctagaatagatcaatatcctctcattgacgatttcgttatcgaatacgatataagataattgtgtgatttttattcgtcctactatttaaatttgactataaaccctatggttcttgaactatatgaattaattgaagattaacttttttttttaacctgggatttagtttttgctttaacaaagcttattcgcgcttgaactttttctattcttcgattgcataaaaattttgctctcaaatccaattatcctctttcatagaacggggggccccaaaacgttacaatatgtggtttgtttcattttttttatagctatgatttcgctaaagcacatgcttattgatgataatactataaacacaggagataaaaatttgaataattttccaacctgcttgaaattcctaattgagattgaaaaaactatattcggtttaactgaagaaaacttccagccgtccattaaaaaaatattggaattatctgattcaaattatccctacacatttaaaactattataagcaacatcgtttataatgcgttttcatcacaaaagtatgcatttgatatttacttaagtttttcaaagacacttcaaactaaagaagaagaaattaatcaaaacacagttaaattaataccaatttttatcaaacgtatatctgcagcaaacacacaagaatcatattatttaatcgaacaaatgattgaacaaaatttaattgataaaaatataactaaaaacattaaatcaaaatattttgctcattatcaaccaaaagaagaaaaccaaaaccattttttatttgggtctaatggaaatgatccaatagaaaaatactttttggaaaattatgaagaactttcgaagaatgattgggagcttcataagaaatatattaaagaaggagttaatccaaatgaaattgcaaaaataattcgaaatgatgaaatagaaaaacttcaagaaatatcatcacaaacaaattttgatatcaatcaaataattgaaccgtcgatttatgaaagatgttcatttattaaccaagaaaatgttacattaattgattatgcagcatttttttcatcagttaaatgttttaaatatttacttatgaataatgcaaatgtaaataacacaggtaaatacgcagttgcaggtggaaatgaagaaatcattcatttatgtgagcaaaatcattcatcatttgaaggtgcatatggagcagcaattgaatttcatcaaaatgatatctttaaatatctttatgaaaataaattagaaaaaacacaagcaataccgaaaatgtctgaagataaaacaaatgatttagtaagtttttgtattaaaaaggataattatgaaattttagcatttttggcagaaaaaggaattaatattaatgctgataatataaacgaatcagcaagaaatggaaatttatatctcgttaaatgcttccttcataataatcaagttccaaaagatattttgccatttgcttcagaatcagtaaatattgaacttgtgaaacatattttagaacaaaaaggaattgatgttaatgcaaaaattatccattttaataatttggaatatgttttaataatttgtaatatgttttaataatttgacacagcacttcatatagcagttagaaataataatatagaaatagtaaaattacttttagataaaggaattgatgttaatgcaaaatatattcatttcaataatttggaatatgtcttaataattttggatatgttttaataatttggaatatgttttaataatttggaatatgttttaataatttgtaatatgttttaataatttgaaatatgttttaataatttggaatatgttttaataatttgaaatatgttttaataatttgaaatatgttttaataattttatatgtgtttaaataatttgaaatatgttttaataatttgaaacagcacttcatatagcagttagaaataataatatcgaaatagtaaaattacttttagataaaggaatttatgtgaatgcaaaaaatattcatttgaataacatggaatatgttttaataatttggaatatgttttaataatttataatatgttttaatgatttggaatattttttaataatttgacacagcacttcatatagcagttagaaataataatatcgaaatagtaaaattacttttagataaaggaattgatgttaatgcaaaatatattcatttgaataacttggaatatgttttaataattttatatatgttttaataattttatatatgttttaataatttggaatattttttaataatttgaaacagcacttcatatagcagttagaaataataatatcgaaatagtaaaattacttttagataaaggaatttatgtgaatgcaaaaactattcatttgaataatttaaaatatgttttaataatttggaatatgttttaataatttttaatatgttttaataatttataatatgttttaataatttgaaatatgttttaatattttgaaacagcacttcatatagcagttaaaaataataatatcgaaatagtaaaattacttttagataaaggaattgatgttaatgcaaaatatattcatttgaataatttagaatatgttttaataatttggaatatgttttaataatttttaatatgttttaataatttataatatgttttaataatttgaaatatgttttaatattttgaaacagcacttcatatagcagttagaaataataatatcgaaatagtaaaattacttttagataaaggaatttatgtgaatgcaaaaactattcatttgaataatttaaaatatgttttaataatttggaatatgttttaataattttttaatatgttttaataatttataatatgttttaataatttgaaatatgttttaatattttgaaacagcacttcatatagcagttagaaataataatatcgaaatagtaaaattacttttagataaaggaatttatgtgaatgcaaaaactattcatttgaataatttaaaatatgttttaataatttggaatatgttttaataatttttaatatgttttaataatttataatatgttttaataatttgaaatatgttttaatattttgaaacagcacttcatatagcagttagaaataataatatcgaaatagtaaaattacttttagataaaggaattgatgttaatgcaaaaactattcatttgaataatttagaatatgttttaataatttgaaatatgttttaataatttgaaacagcacttcaaattgcacaaactttaggttacacagaaatcgtaaatttactccttgaaaaaagtacaaacgaaaattctaattcagattcctcttctacaaatatcaaatcttcatattcaatcagaaatagaaatgaagcgcatattgctaatcatcaaaatcaactcaaagatcgaatgtatgcagaaaacaatcgaaataattgtatcaaaacaaaagttgatataaacacacaaacatatgaaaataatcgaaattgcaatatacaacataacaaacatccccacaaagcaaaatgtaaatacataaacacaataatattataaagtgcattataagaaaaacttcaacaaaaaattttggaaacaacattacaaagataatgcataaatattttatgataatcgctttgggttcaactgaatcgaaattttgatatctgcaattgttcttaaggtatttcttccgtatttaataataatttcattggttgcatcatcgtttagaaaatgaaacagtttaatttccgtattacaaaagttacacacataaacaaatgaatttttgaaattgacatgcttgaaagcacattatataaaaatacaattagaatttatcaaagtatatatgaatttttttgataatgatttaatatatttaaaatattttttgaatagctacttttgtgagatttaatctcttagaaattattttattagatcacagaaaaaataaaccaagtaatgaattttaaaatatatttttttgagaaatcattaaaccatatgaaatgttttgaaaatgtttgaagataatgaacaaaatattaagatgtccgccttcgtcatcgagaatactttcggtacataagtcacgatatatgaatcctaatttgtggagatagcctaaaccaagtaaaatttcggccgcatataatgcggtacgtaccgctctgctcactgaacaagttgtacttttccatatttgcctcttcaaactcgaacaagcaatattccatctgcttgaaatctctgttctttctttcctttttgggattatttgcacgcttttacccaggattggcatattttacccaaccaaaaggttataccaaagaattatgcaagatgttggggtataaattaacgacatattataaaatttttgagtttttcgaaaatgtttttgggctttgttttttgctacagacaaaccttgtcatttagtagcaaaaataattttgatgtcattttgctgtaattaaatttgttagataaaaaatagatggagcaaaatcatataaattattgatttttagaatttcctcacattttttgagtttcatattctggtgaatgcccttaagaaaaaattttataaataacatatgctgaaaaagaaagagaatcaaagatttataatgaatcattaataaaacattataatatatttaaatccacatatctgttgaaagaataattataaaataatgttggaggggaaaaaagggtgtacattttagtataaggatatttttaataaactcaatgcagatttccaacaatagaatcaaatgaatgaaaaatcatcggatttatattcaaaaactgaagtaataaactggggaagttcaaccacaaattcaaacatataacaaaagatttaaaaacacaaaaactattttaaaatacatactaaaaaattaaacaaaatagacaaaaatgcaaaaaatgattaagtgaatcacagatgtttgaaagagagagataaatgagatagtaatgattaaatgagatacgaaactatatgtgtatattgaaagcctaaatgtgatggataaattgattaaatttctatattaataggtgtactaaatcacaaatgagagagaccaaatgatttaatgagctgcactggaagttgaaattaaagacgaaaatggctaaaaagcctataaaaggggtaaagagaacaggtgttgtttcttcaatattttttacacatgtcgtctttccaaaaaccccggggaattccccgccttttttacacaatttttttctactaaaattggtaaggtttgtctgtagcaaaaaacgattccccaatgtatcatatattaaccactgtattatttttgcgaccgttttgatttttttcgtaacggtctcgaaaatgctgtatttaaacttatgagtaaactttcaccgaatgaagctgcaattattattcaaagaaattatagaaaatatgcagacaaaatgctttataaaaaaatgaaagaaattattcagtttagaaataaaggagatcctgcatcattattaagggttattaatcctattgaagcaaagcttttagattcgtcaataggtgctcatgtacgctttcgactaggaggaacaggatggccgcctcaaatatattacaagatttttctacatagtccagtttgcgatgtcaactcatatgcacctcgaaattatgcagataaaaaaagcaaagaaattactttgcttagtcaagatcaacttgatgaatatgccgaaaaatttggatggtatcatcgagtagagaacaatggatggagaccaatttcatctttgtcgccaacagcaattgatagtatcactcatcttaccaacaaatccaaatctcataaaaattttaagaaaagattcaaaaagaccaaaaacatcaaagacgaaattgtaaaaatgaaacttaaacgcgtcatggaagaacaaggcaaacccacgccaactaaaacagacgaatttgatgacaatggaatattggaatgggcagaaaacatcgacatacagaactacataaatgactgggaaacgcttggaacgacggggccatcaagcgatctgtggtggaacaataacaacatggacataagtgacgatgaatcatccgactcctcagatagtgagctcgatgaagacgaactactgaagttgataagctagccaatagatgatagaaagcttaaagaaatttttgtttttgtgacttgtgtttaaacattaaattatctattttatttataattacgaggataactcaagagcaataaccaatgcattttacgccacgaatgcgtcctcattcttttgtaataatttgtttttaatcttaatccaatagtgtgcgaaatttcaacaattcaaaaattgaatgaagaacaatcgttcactattcaatcgttagtcaatttccctatcgcacatgaataagttaaaaaatatttgcgtttaataagaaccattcgaatgagttaaacacagcaacaaatataaggccttaaataaggggaaaaaataatttaataagatatttattacaatttagaatccctctatttgacaattttcaacaacagcctgtattggcacgtctataaattcgcacagtgatatataaacagcaatgatttttttgacatcaattattctttggaatccgtttgatgcattttcatcattaatatccaagaaaatgttacgcgtttctttgatccattcatcagagttctcaaagtcttcgggtaccaaaacaattttcccattgtttttacccaaaattatttgattgttataatcaaatacaaatgcggaatcgactttgtcattttcgacaaagttcatcgctctgttgatgtgtgaagtgcaaagaatcacatgttttgaaccttgtttagatgctacacattgtaaattaatatttttttggtcgcatctaaaatatgttattaacaaagcaatgtccttaaaaaatcttattgatacccatatacctttaatcttaattaaagagaaattagtaccgaaaattttgtcaattaattttgatatgtttgaatactttacatcacctataaagacaacgttaatgactttcatcgtcggattattttgaatgaaattttcaatgtgatgtaaagaaatgtgcaataaacttctcaaataaaatgattgaatttgtgaagtcaaaaaatagtttttatgaattggataaaacgttgaataagttgaatcaataaagtaataattatcattaaataaataacatattaataatgggaagaattcaatcgctgagttattaatgaattctatatttcttttaattaattttttggaagaatttaagttttcattttgctttttgatgttattttcgttgttgttattaatatttgttttgtttctaacgattgttacattattattatcattatgattgggcacaaacaaaggattaatgcctaagtctttggaataataaaacaaacatcgatcttcaacaaatatttttggttcattaaatgatttgaaacttgcgaccaaatttttatcataaatatttttcgtaatgtaaatatcatcattctttatagtgatgtaagggtcattattataaaacgtaacatcataaccatcatttacttcgattaattgtttaatttcataatttgttttataattactaattcttaatgacaacaaagaataagtcttctttttgtttaacagtataacgaattcatttgttaaataattaaaatcccatgaaacaatgttacgacactttggaaatatctttaacggatttatcgatgtcaaattaactttgccaatgtttatcaaatacaaaacaggacgaatataaccgcttttgtaagctgacaaatgtgacaaaatcaaaattttcgacaatttataaaaccatgctgaatatatagggaatatcgtcgtaattttcgatatagggtaatcatttaaatgatttaaacatatattatacatataattcgcacttgataatttcaatgaattattaataattttgactttgaaatatttttcattttgtaattctaagtctattaatggattgttcctttggaattgtttgtttaacttgttttggaaatcatcttcaaagattgacaataatcgattaatataattcacatcgaaatgatatttgttatcaacttgaaatgataagttatggtatgtattaaaccatttgtttaataagtttaaacttaccgcaattttacattggttaatttcattccgaatgttttgtacattcccattaataattgtctgaaagatttcgatcattaattgtttgtcaagttccgatgatatttcttcatttcgtaataacttttgttcaagtatataaaagatgacatcaatgatttttaatgagaatcgtaaaacgcctttcgaattctttcgtaatgtttcgatgttatattcgatactttgtaataacgatttgattttttgtggatttaaatatccatctaaatacattggatataacttacagatttgatgatattgtaaccgaaattcctttttgcgtttaagcttagaaaaacaatcagaacaataccaatggatatatccacttttttcttcatatggaattaataaattacaatcatctttaaatcgtaataagccacaattctcgcattctttatcttcttttttggtaaagtctaaaagtgaattgcttaaaactgaccttaaacatattaaatttggatatggattattcttcaaatctccaactttgatgttatctacttgttctaaatcctctaattgactttgatcttgttctttaagtggatcaacttggagtttttctaatggataaatagaaagtaaaattcttttcagttcattgctttccggtgtaaacctctcaaaattaatggtttgtaaaatgttgtacaagaacgttaacgaattgatttgttcgttagttttgagtttgtatgaaatttgatcgactcttaatttgatgttattttgagtaaatatttctttatgcgttgtcttatgttgtttttccatattagtaacatcagaaatcgactttaaaaatgattcaattaagttataattattataatcatcgttatttaaatttacttcaatgtttaatatttttttatttctttctttaactttcttaaatagcattgatgtttgtaaatgcgtaaatattaacgttgaattgatttcatcgaattcatctaaatcatttttcaaaaaagaattattgtaatacaataaaatacttttatcaattgtttgtgtggtaacaaataaattgtttccagaattaggtggaattaatggttctatttctttaagcttttgttggggatgcgcaagataaaactctttgttggatttaaggacaacataaatataatgtttcggattagatgatccaagtggaagagaatgtgtaaaatgaatctcattattattacgtggtaatatgataaagatttgtgtggacatagaacaacataaaacatgtaatgaatataaatttatcttggtttctaaaattagattttcttctggaaaatcaaagatttgaggaaactcaagattatgtaatgtccaccatgattcttcaatggcttttggatgaatatttgtcttaaaattatgaaataattcatttggagttaatttataaattcctgaaattaatgatataaggcttgacggctttgcatcttcttcaacatataaaaagaaacctttgaggctattcctaatttcttcttctgtaaatactaaattttggattacaccaataaaaagataaggattactaaatttagatatcttaaggttttcgatgatgaagcgctctggaattggtaaattaatttttctttttatggtatcttgagaattcattttgagttgttcaaaacgttttggcttatcgatgatttgtaaacttattaaaaaatgaaatattggggcaccctgaaattgaaagcaaaacgtcattaaaagggctatttaaatgaattttatgtaaacaagtcacttaagttaaaattaaccgcatttttaaaaaattgttttatgcatgaaaatggtgcatttacgcctgaaaaaatagaattagcttctacacttctttatcaaggtacggttgaaaggcaacaagaatcaacattttatttgaatgaatggcaaaaatccgcaaattcttttaacatggcttatcaaattttgttatcatcaaagaacatttacgcaattcatacttcattaatagttattcatgattttgttaaacacaatttttttaaaatgaatcaagaagagcgtttgaaatttagggaattcatgataacgcaacttcacaagaacgtccgtgttgatattttagccaccaagttaaatgaaattcttgtaacgattgcattatttgaatggcctgaaaattggaatacttttccatttgatatttatccccaaggtattgtaacagaaagtgtagcaaatctacatcttattcagtttcttatttctgaagttttaaattcaacattagtaaatacaaatcgaagacaaattcttctcaagtctattcacactattcttccagcaatatttgaagttgccatttcaggcctcaacgagtccaacaaagttcaaacatctatttcacttattcatgatctctccaaaatttcaccacttgaatattttttcaacagatcaattcttcacacaatcttcactggatttcaagcgttcgacttagtgcattatgacagtgttcgtcttgcttcaagactttttataaaacgaacagattcagaaaatttttttcatattttcgctccaccgcttcttatgatgacatgttccgtcaaagttcatagtataaagctttcggcctttatgataaagctttttatgaaatatggtgaactttttgaatcaatagtatcatgggatccatcatcagaaaatatccgaaaactcatcctaaaagaaacaaacattgatgacttcactcagcaattcttcatccaatacatacgtacacttaattctccacttgctgagagcgaaaacaacggaattgtatggcggttatggtgttcaattttgaatagggcggtttcggccgttagtgataaacggttccagtcgaccgttaacgttgtcacttttctcttaccacaaattattccattgttatttaattgtattgattattcagttgatgaagggattatcaaagataagaacattttcgaatgcttttcattattataccaatttaatcaagatgcattaatccaatttcttacaaaacaatcattatcagttccattaaattatttatttggaattttatgttcttcattctctgaaacaatcgaattagaaatatatgagaaagtgtttcctgccatttttaaagaaatggaaacatttgaaatcgaatcacgatttattcaatctggaatatttgctattacaagatgcttaaaatatcttaaaagaaatcattgcgttctaggtaaattatcaaggtttttacttaaatgtttagaatgtaatgatgagtcagttcaagatgcttcttctcgtgctttaaattatctttctttacatatgggtataattttccaaattaatgacggtaaattattcgtttctctgatgcataacgttgaaaatatattaagacttcaatgcggtacaagactttataaagttttatgtcgagaaatcggattccataagaaaaaggagttcctttatgaagtgatctcgagaccgttaaatcagcggtttttaacgttcctcgaaacttatccaaattgtgattgggaacaagtacaagtagcttttgattgtatgatatataaccctttacactcaagaagtactggagaagtgttcaaaaatttgagtagaagattatttgaattaacaacaatattcttcgacaaaaactttccttatgaattaatggtagaaaaattgtttttggtgttttctgtgggcatttgtgagtctgatattgtagaaatacatcctttgattttggcattattgaaaatgattcatcaaaatccacatctttatgtttattctttcttcttagttgcttccattagaaacacacattcaaattttgatgaattgtttccaattattatggaagaaataattgatccttatcttaatagtggtatggaattagaacccgattatttcgtaatgatctcaaagttcgatcccaaggttgtcatcatacccaagatattaacctcaatttcatcaggaattcttgatctcaaatctgacataaatacatctgcaatttcttgtttaataagtctgatatcaaagatgtcacccgaagaacttgttgaattcaacaaagaatgtcggaagaactttgttttcgcagttgtttcatctttatgtgacatgttgcatgtatcgtctttttcacatcacatttcactacttcaaatttttgttagaacttcatcaaatcatgaagaacttggaatagaattatatgaatcattgaattcagccacaccagaaccgcaagcgaatttctttcaaatgtttattgatacattgtttaatgcatctgatgatatatcaaaactttcattaactgttcgagatttcttatacgcaatacaaagaataacgccaattggttgggatgagatagagttacagacacaaacaaatgaagaaagtaatcattttcgaaatgtgttctttaatgagcaacaattaattgcatctgaaggattccaatagacaaaatgtttgacatgttttttgtttttgttgttattaaattaataaatttatattttaaaatttaattttttttttttttttttatgaaataattatttcaaaaaattacaatgagaaatatgaaacaatataatataataaaagaaaaaatgatatgtaaacaactatagagatgtactccatgataattatcgataacaatgaagtgtgtcataggttatttttatattttggtttctgactaattttctgaagtttccggtcaactctttcaaaatttgactgtttccattcgatcaaattgaaaatttcacctttttatttaacaaatttgcgtaatgcaagaagaaagaaatcataaagaacagaatgaatgggaattggttttatcgatcaaggatataatttttagtttgaatgaaggaaataatacgcaatcggtaaatattataatagacaaatttgataaagttcatccattttcttttaacttaattattatccaaatgatatatgatacatttgctttaagaatggataatcctcttatatatctgaaatttatgaaagaaattcaagaaaaaagcaaaataaatatcattgatgaatttacaagttatcttcttaataaacgcacacatgaatcaaactatctcattgatactatgattgaacaaaaaattcttgaaccaaaaatagttagcaatatatcagatccatattttacacattataaagaagaaacaaaacaaagtgaactatcagtgaatgatcaggaacttcataaggaattacttaaagaaggacataatccaaatgaaattacaaaaataattcgaaatgatgatatagaaaaacttcaagaaatatcatcacaaactaatttcaattttaatcaaacaattgagccatcattatatgaaagatgttcatttattaacaaaccaaatatttcattaattgattatgcagcattttttggctcaattaaatgctttaagtttttattaataaatggaacagatgtaagtaacgcaagtaaatatgcagttgcaggtggaaatgaagaaattattcatatatgtgaacaaaatcatttatctttttataaaggacaagaaactgcaattaaattccatcaaaatgatatctttttatatctttacgaaaataaaattaaacaaataaataactttgaagaactcggaaagaaatgtatctctcataataattatgaaattttctcatttttacaagaaaaaggaatgacaattaatgatgaaattattaataaaacagcattaattgggaatttttatcttgttagatattttcttaatgaaaaacaaccaccaaaagacattttgagtttttctgttcgatcaaataacttagaattaattaaatatatattggaacaaaaagacattaatattaacgaaagaagtatttatatgttttatttaaaatttatttacataatttggaaattatttaaaatatttcaaacagcacttatgcttgcatcttcaaataataaaatagaaatagttaaattacttcttgaacaaaaagaaatcgatattaatgctaagaatagaatttattttaataattcaatatttgaaaattatttttggaaattatttaaaatatttcacacagcacttatggatgcatcttatgatggtcatgctgaaatagtcaaattacttcttgaacaagaaggaattgatattaatgttaaaggtgtttatttgctttatttggattttattttaatattttgatatttgaaaataaaagttggaaattatttataaaatttaaaacagcacttatacttgcatcttcacataataaaaaagaaattgttgaattacttcttgaacaaaatggaattgatgttaatgctaaagatgtgtatttgttctatataaaattaattttaattattttggatttcaagatattttttggtaattatttactttatttaatactgcacttatgtgggcatctttacagaattatttagaaattgttcaattacttctttcacatgaaggaattgatattaatgctgaaaatattttattgactaaattgatatttgtgtaaataattctggattccaaaatattatttggaaattatttaaatcatttaatacggcacttttaaatgcttctaaaagacatacagaaatagttaaattacttcttgagcaaaaagaaattaatgttaatgcaaaaaatatttatttgctttatttaagatatatttcaataatttgatatttcaaaataatatttggaaattatttataacatttaagacaggacttatcgaagcatctgaaaatggtcatacagaaatagttaaattacttcttgaacaaaaaggaattgatattaatgctaaagatatttatttgtttcatttaagatatatttcaataatttgatatttcaaaataatatttggaaattatttataacatttaagacaggacttatcgaagcatctgaaaatggtcatacagaaatagttaaattacttcttgaacaaaaaggaattgatattaatgctaaagatatttatttgttttatataatatttattttaataattttggatttcaaaataatatttggaaatgatttaaattatttaatacagcacttatgtttgcatcttcaaataattatgtatatatagttaaattgcttcttgaacaaaaaggaattgatattaatgctcaaaatgtttatatgttttaaataatttttattctaatatattgaaatttcataataatatttggagattatttaaagtattgagtacagcatttatgcttgcatcttcaaaaggttacacaaatattgctgaattacttactacccaaaatggacttgatattgatactaaagatgtttgtttatattatttaaatattgcttagttagttagaaaggagctgaattgtttcacatataaatataatcacttatagttaatttaatcagattacaataaaatgaaatttaaaaatatttttttcctttattattatacttattgctgtaaaattttcaatattacaatctagttgatcaattatttaataattgatttaatagtcaagaaaaattcctttcaatgtatagagctacccaaggatccacttaaagcattatgtataagcacgaagaagttgtatataaattaatgctagattaactcactacataattcatttaatagagatgtaaatcttatcacaactgatttatatggatgttgttgagtttgtttttttttagtgttattattattttaagtagtttataacgttaaagtcaattcctttttgttcaagaagaaatttaacaatatctatgtggcctttttcatatgcacaaattaatgctgttctattttacaagttgatataattgagtatttttatctatttttctaataaacttatagctacattcagatggataaatttcataaaatattttcattcatgattttcatactcgctttggttcatgctgaaaatatgacaaaagaaaccatggaggccttgatatgaaattgaatacagatctgagccgaatttaaattaataaattcatatcttatatatcatgacacatgatacacataatgtttatcacattaaaaaaatcaagaaatatcacgtgatgaattatttagacattatttcgttgttgcgtttgacggttacgacggttttatcggttttggcttggcctttttgcaaaatgggtatcacccgtatgggagatcttaagcgcgcaaagtcaggtgctcgttcagttgcctggcgtaacaaacgtaatcacgcagtcggtcgtccagctgctaacacacgtattggtgaaaagagaatccaccttgttcgtacacgcggtggtaactacaagcgtagagctcttcgtcttgaccatggtacattctcatgggcatcggaaaatgtttcacgtaagacacgtatcctttctacagtttatcatccatctgataacgaattcgttcgtacaaacacacttacaaagggatctattgtttcaattgattctgccccattcaaacaatggtacgaacgccattatggaaaaggacttggtcgttcccaatacgaaaagccagcaaatgtcagcgaaagagtcaagcaaagatgggaaaaactcgctaacgaagctccacttgccaataacttagtatcacaattcgatcaaggacgtgttcttgctgccattgcatcacgcccaggtcaatgcggtcgtgctgatggttatatcctcgaaggtgaagagctcgatttctacatggcacgcgtttctaagaaaggcaagaaataaatgagtaaacattattcaaatcactatatatccattttattatccgacatctacgtcaggtatgtgctaaagtatgtaacgaaaataattactgatttgaatctgaattttacaaaattttaacttcactaaaaaaaacttcaccataaaagacgaatgaacagagtttaatatctaattataatatgaaaatatcattttttttgatatgtgcatatttcacataaactacaaaatcgttcttcatttatattaatgattaacaccattaatgcttttctcatagtttgatttaattaattaaatcaaagattagagttgaatttagagaaacaaaatttataggcgaccgttaaaaataagacataaaaaaataaaaaattaaaaactatttggattttaacagttgcaaggcttcttttctttttgcgtctcttttgtgacagtgattgaaataggcgggatatcaaggtgtgtagttacattaagaaatgttttgaaatatttttcaaaagcttcagtgattccatcacctgtcttagcagaaacctttgctgtttggttgatgttgtgcttctgtgcccattgttgaatggtttcatcagaaacttgtgattccatatcagatttattacctaagaccaaaacaggtaaaggttgttgctgatcgaactcagcggtatcaagaaacatattcaagtagatttcaatttcaccaaagctttgaagatttgttacatcataaacaagaataaggccgtttgctcctcttaaaagagatggtgcaacacttctaaatctttcttcacctgcagtgtcccacaacatgatattgatttctgtttcatcaatatgcattgtatgaggaacaaatccagcgccaatagttgcttgtgtattttgtaggaaagtaccgttacagaacctatgaattacacaggttttacctacgctaacaggaccaagaacaacaatttttagatcgatgctgctgggaggtttactcatttggcaaatgaaaacgataaacttaacgtaacttttgaggcaaaaattgtaagaaacgttgcattcaatttgggggttacgatcataaaacactaacagataattagcaactaacacattcttataagcatatagttattgcaaaaagacaaatatttatttcgtataggaatcatctaattatgggttatcataaaaagtgcatatttttttatatttgaaattattatcatccaaacaaacaaacaaaaatgatttcaataacctcactaaaataaagataaccttaaaaaaacaaaaaattgctcatgttttccagaataaaattatcatataattaacaaatactttaaaccccaaaaaactataaaaacaaagctatgcagttatgctcaaatcacattaatgtaatgttggaaaacaatggagaacaaatttgttaaaatgaaattcaaaaacacaaagtatgagccataacttattatggtcactataaaatgtaaatagttagtaaaaagacatggaaactccaaatataaaaatgtatttaaagaggtaaatcaaatatttggttggaaaaatctgttaaacttaaggagatttcatcattatctgcattcatatctatcatactagagtaaggaatatcactttcgttatcaaattgatgctctatatcaaaatcactgattttaaaatcattaataaaaacaggttgtgttatgttttgttgtaccggtttttcttctgtagtggcagcggttcttattgaccattgccttagttcacttgtattctctttaaataagattagaaaatttaccaattctgagttaatgtcgccgcgcgaaacggacgttttatatcccattaacctaagtgcgccatttatagatgatttacacttatttatcaaatatttcagttgacgggaattgattgcaattccgcagttgagttgacaaagaccacacacacagcaacggatgtgatccagattgtctcctcgttgggagtaccttatgatcttctcaaggcaatccttgagaattgttaagcgttgtcccctatgtctctttttagttgcttccaaaagtttttcttggagcgagagataagatttttgatctgtttctgtaagtaaggaaaaatactttggtctttcttgattcatgaaagaatttttatgcttttttaaaagtgccataattgacaggtttattggcagttttaattgtttgcaggttaatggcttcgatagatgagtactagttagtaaatttatgttaataggtattttatatgctctagaactttgcatgtatgataaacatttgcaaaagtataaaaattatccgggataaattatacttgagtatcccattttccataaagttatgtctatacttgatttaattttatgtgaaaatcatacaaggctttataaaattgttgtttgtggtttcaggttggaacaaaatattgcactaagtctaaagaagtaagcacacagctttttggtattccaacagtgtaattacactgtttaatatagaaaaaatttgttatatttttcataactgatttaagttttattgttcttttactttcaaataattttgaaattatttctcactgatagattctatggttgttgaaattaaaatacgacattatgctttgttttattctatataaatcctgttgttgttcctctcggttgcgcgtgtaatttgatcgatcatacgtggttctaaatcaaatacggattccatgccagagggccaagtgatttggataacacatgcgctaatgcagttttacctgttcctggtggtccaactagaagaattacacgtccttgcaatttttccgcttataaatagatgtaattccattttgaattataaattaataatttgatttttaaataggctaatttttaaatcaatttccctatttattataagtgtacttactgaataatcaaaaaaatgaaatgcatgaataaaaaaaacagaaaaaaattttaaacgttccccagataaaacattgtacccttttgcagttgagccaattgcagatataattgatgcatttttggttctacatagcccaagctcaaaatatttttctgctgtatgtccttattatattacaatttttgataatttgctaccaacacatccacagatatttttttcacatagatattttaacactccaaacgaacttgaatgtattcagtggtttcaatggataacagatgattcatatggttttggttcaaatacaggaaatttttttataattagcaattttctatctaaaccaaatgaaatagctataagcttagattcacatatatcttctgtgttcacagcacatgaacatctttgtataattaattcagaatcaacaatcttttttttcgatatgaatgggaaaattacaaaacgaacgcaccttgaaattaccaaccctattagagtatgcacatatttatcaaattccaaattactcttttttattaaaaatcgtttagcatcaattcaaattcctcagtcttttactaactggacgcctactcttaagctacataatattattcatgcctcattatttgcgattaattacaagttctccaaacttgcttacagcacatttgagaactttatttatttgacagatttagagaccgttaattccgaaaacaaagaattattccaaattgaatttgggataaagaaaatgttttgggttaataatgaaactcagttatgtattatcacatctaatgacattctttgtctatgggatattttcgataataccagaattttttttcatgtatcaaatttattaactattatttccatatcatatgatgaaattaccaaaacgttattatatattaatgattattcattaataaagttaacatttttaacgatatcgaataatttatttattacttccaaaaacatttattcgctcacaaacaaaaagaaaattcatttaaattccgaaatattttacccaatacaaattgcgactaaatcattaaagaattatattgcgatttataatgggattttagttataaccaaaatcaaagaagaaatacattttaaaaacgtcgaaaatgttaaacatttaatttggcttcataacaaattaataattttcaccaacaataatatgtttatatacaccaaaacattaaaattcattggaaacatttatatttcgaatccgatttcaactatttcacacacattaaatcgaatcgttacaagttatcgaaataatttcattgtttatgacttcgattcgaataataacttcgataaaacattaaatttgaaatattcgatttccaatttcgattatgatgatttatcattaaatataataacatttaaaacaattggaacattaaaaaatgtaatttgtggatttgaagatgaaatttttttacattttgaagacaaaaaattatatttactaaaaaatatggaaataattgaagaaaacgtcgaaaaaatttggaacaatttcattccaaatttagttttcatacaaacgaatttatatattaaaatttatgatggaaatatattccataaaatcgatttatataataacataataacttcgaatgaaatttttttggttacaaaaaatatacgaaatgaaattttcgaaattggaaattttccttttgtttggaataatttcgttaattctcttcttaaggaattaattcgatttccaaacaattgttatttctttgctaagaagttatttccgatttcaaacttttttaaagtgtttaacgatttgttatttttttcgattcgtaataattatataaataatttcattaaattcataaattgttttgaagaaaatgaaaaaaatgaaataattcaaaacattgataaaaatttgttgataaatctcatcgaatatgaatttgatttctcgaatttgtttgataagttccaacaaaaagaacaaattcgaattttaatattttcgagtccaaattcttttgttaacattttatataaatttaaatcgaatattttggaaatcgatttaacttcaatagtaaaaaaaatgctgaaaagtaatgaatggattcgtttggcgtttttttcacagtttttcgatattaaaatttcgaatttgttacaaaatattcgttttattaattttaataattttttgaatttgcttttaacagatataaaaaaatggaaaaacatcgaaaaaaatcaatccttaaaaatgttatgtttctcatttattaacgaagagattaatgaatgtgctgctgctattttatgtgttttaaaggataaaataaaattgaaattcttgatctcaaacgatttatcattaattccaatattaaaaaattatatagaaaataacccaaattcaaacatttcggattttctgcgtggaatgttataacttagaatgtaataaaaatgtatatatattttcaaatttaaattttttgattaaaatattttgtgataagggtaaaaataaccgtcaaacaagggtaaagtggatttgaaatatttgaaatttgtgagagttggcggttaatcagagtcaaaaagctttgaagcgttgagcccatttctggtgtgaaaggagtatcaattttggttaacgctccaaaaacccatccaagctcgtttttagatagaaatgatttccttttttcaaaataatgtattatgctccatacatctttttgattacggatatcgtcgacggttggcggttgtcctctttcaattgcttgaacgatagagtcaaaattattttctccttccggatattgattaacatgttgtctgacataaacaaaccaatgagaaagcttactggaccactctttgtttggtagaagttgtgccgaaattttgggtgaatttaaaatttcttcgacaaatttgatttcacgagctacacttgtcggagctgtgacattgttagaacatttttggcaattagctgtttgagttcgacttagtttaagatattgttcagcagtaagttcgtttggattcatttggcctacttctagttgtaaagtattgaattaatgtcacttttctcacacataaattaaccgcttagcggctatatagccaaacggcatgaacacaaaattcaattgggaaaacgataaatttctggcggttataaaatagttgcttggaaggaaatatgagcactggaaccgcatttgatactatatttaagttttttatccaagcttgtgttatctttgtcgcttctattgttatgataatagttggcgcagtgttttgggcaaaaaatggagatgtttatcaatcaattcagtctatagtatcacttcctttaagaccttcactagaaaaacctcgtgatatgtacatggtttcaaatttaacagaaccatcacttttaacagctaacaatttttcgatgacatttcaagttgatagtagtggtgactattctttttatcttattcataacatgtttggttatagtgttaatattataacagaaaacaacaaagaagtgcaacttttttcttcgtttaatatgaattccacgaatctcacagatgttcaatattcctatatttcagatgttggcattgatttgagtaattttttagttgcagatgattattttaatattcgttgtccaacgtcaacatttattactgattattattccatcacttcacaatgtttagttcgcgaatatccacttaaactttcaaggcgatatacagtttcgtacattggggatagctctatttctaccactaaaaacgtgattgagttcattaattcgacatttgttccgaacaattacatcgacattcccgaagtatatttgggcgttaccttctcattgacatcgagctcagtggcagggaaagttattactattgtcggaattgtactttgcgctttaatgattgctgagtatattttcttgtgctgtctttgttcttgtctgtaaatctttagatctgtttaataaaacgtgtttcagtttcttttttaaatttggactcgatgacgccacttttttcatcggacccgatgacacttttttattatagatgatgaaaaaagtgcctcatcgatggatttgtaaagttcacaatcaggatttcagagattaacaacatttttttggcaaaattcttttaaaggtgccatcatcgacggtttgaattcaaaaatcattcacttttgtgtaacaaagattcgagtgaacgtaaacagaaattaacatccataataagtagccttgtacctgatgatgaaaaatggcaaacgatacgtcatcgatgatcaactcataaacctttattcttacatccgataaaattttgtcaaatttttctctatacaagtatctaatgaaatttgttttgttattggctctgacggagaacacatatctatcggttattgataattgattttattagagaggattttcgaaaaaaaaattatttcgaaaaaaatggtgatttttcaaaaaaactaactttttgagtgattcacttgtaaaacaaaaaccacaaatttcgagtggaatttcacataaactatacaaaaaatgcacacaaaaatatttttttatgattaattttggttcattaaaacttgattttgttgatgtgccaccctaagaggatgctctgaaatataaaaattattaagagctatacatattgccatgattgatggaaacgatttagatcgatcactactatactgttgtctcaagaaaccaaaatccgattttagtctaccaaaatagttttccactattacacgatctctttcgatccgtgtattggtagctatttcttcttgtgtaaggtctcttcctattggctttttgatagtgacgatagcctccgggtatccctgtgagtttaaaccagtatacccttttttgaaaagtactcgaaaatgacgtacaatttgtgttccgttttgcattgtcatgtgcacagacaagaacctctcaagccacatgctaccattgaatgctttcaaatcatgatctgaacctgggatccctacagaaaaaagtgtacagagaccgttaggactaacgagagcttgtattttcactccacacataccatgttcgaataaaaaaattggtctgcaattaattgaactgctgccttaaacatttaattctgataaaaataacattccaactccacatgaatttagatatatgtttattgactttgttttctgggattccttcatatcttttattaattttttttaagttgcctccaaagtctttctatcatttgagtgtgcgctttcgtttcatgatcaacaaaattacatgaatgattcacagtttcatgctcgtaatcattgtcatcatcaagaaaatcatatgctttccagcaatcagaaatacattattttttcgaaaatcctctattctattttttgcaaaaagccaaacagcggttttgaccaaatttgttattgagtaatctcatagaaaatattgaatttatatccttgaggttagcttctcataggaaattcctcatgcctcctaattcccgtgcaaggttaaggaaaaggcgaattcaattttttctagtgtttcaaggggttgttgttcttattattgctgttattattcttataattggtataatattatgggtagtatacaattcaggttttaaaaaacaaacgaaatttatggcaccacttcctttaagaccttcactagaaaaacctcgtgatatgtacatggtttcaaatttaacagaaccatcacttttaacagctaacaatttttcgatgacatttcaagttgatagtagtggtgactattctttttatcttattcataacatgtttggttatagtgttaatattataacagaaaacaacaaagaagtgcaacttttttcttcgtttaatatgaattccacgaatctcacagatgttcaatattcctatatttcagatgttggcattgatttgagtaattttttagttgcagatgattattttaatattcgttgtccaacgtcaacatttattactgattattattccatcacttcacaatgtttagttcgcgaatatccacttaaactttcagggcgatatacagtttcgtacattggggatagctctatttctaccactaaaaacgtgattgagttcattaattcgacatttgttccgaacaattacatcgacattcccgaagtatatttaggaattgtgatatctctcacaaacagatcaatagctgggatggtaataacaattaccggaattgtgctttcggtcttaatgattattgaaattttcgtgacagtgaatgtgtaatttttagaaattatgtgttaaggttgtactataaacggtcgccaccggaaaaatattgttttgttaataaatcaatacgaatttataaatttaatctgtaaatcaaaaaaatatttataattgttaatgctctttgttagatactaaattattttaattttaatttttttatgatagataatcaatttcactttaaattataaagttgaaaaatctttttattacatttttttaaattatatgatatatttaaattttttattgattttgatttatattcagttaatattgagttcctttaattttaaaatcaaaaaatcatgaaaattgattttgaaatataataaacaacataataatcccaattgacgttaccatattattttagtaaattattatttgatttggagataaaaacgtttacaacaagaccatacgattaaaaaacatagaaaaaatatgaaaagctggaacgtaaaaaacctgttttcatatatattttcattattattatttatatttaaatatcattctcttacatcaaataaatgacatttgtatacatattttaaatttaaaaaataatatgataatattatcatgtaatttgcaattggaaatttttttcaaaatttctccaatatctcttcattactttattttaaatattatttacaatatcttgatgttgtttatttcattttatctcttatatccattctcgattcattttaagtttcatttttttatgattaaatcatcaatcaaatttcgaatgtttcgtcatttttatttttattcaaaaaaatcaggcattaaaaattggaaacttttgatctaacgttttttctaaatgaaccctttggaaaaatcacaaaaattcataggaaacaaaaatgaccttgatgatatggatttagcattaaccacaaaactaattcccccacatggagtttcagttgatgggtcacgaattccagaaaaatatcacattgtaagaaaatttccaatttttccaaaggattatgctgaccaaggttatcgagtatataataaagatggtgagtggtatgttgttttatggccatctgcaaatccagattcaaaacaagacatcactaatttatcagatgcagttcgcataatgcttgatgaattacaaactgcaacaagcatcaaacctgatacatccaaagttcaagacatacaaaaagcgaaatcaattgcatcccaaattattcattcatttgataaacggtgtacattacttaaggtagcacttgatgaaattgcgcgacaagtatcagcacattgtaatgaacggggaacattattatcttttctcataaatgacttgatggaaacattcaaagaaattccgaagcagtacaattctgctctgaaaatttcaaagaaagaagttgatcaactcaaagtttcacttgaagcaaaagatttagaacttcaatctcaatcgaagaattacaaagagcaaatatcgcttttaatgttagaacgaaagatcgaaaaagaatggcgcgaacaaataaatgaacaaatcaagaaatggaaaaatgatttcgagtcatataaagaaagagcgcaaaaccaaatcaaaatcgaaaaagaaatcttagaacatcaaatggaaggactaaatgatataataactgaacttcgactcgaaaacgattctttaaaagaacaaattcaatttcaacgaaatgaattattgaagtcagagaaaaaatatattttatttgagaagcaaatccaaatattaagtcaaaagaacgaaagacttaaattaaagctatctaaatccgagaatttcaaatcacaagaaattactattcaagacaatcaaattaatgacatttgtaatgaacttgtgaatgaatcgatgctgaaaagtttaataacaaattatacgccagaaaaagaaattcacattttaagtaataatgagatttcgaaaataactttcgatttaatgaatgaaatgtataacacattagcatttgatccatttgatgatttttatacaaaacatttaatagtaactgaagataacttaatacacgcgtcagaaatcgctcggaattatattgtctcgattaaaaatactgaaaacacatttcttttttcgaaattaattttttcttttttgaaacgtgaaattccaattggcgtcttaatgaatttaattcgtttttatggattttatcaatcaaaaccattccaaatcaaaaatatcattgaacaagaaaatggaattcctttaataccaattacgataatctttaatttaataaaattaatgtttgtgaaattaggggatgtatttattaattcattaattgaagaaatgaaaacatttcaaattgaagaaagacatgaaaaatatatttcgtttgattctgttttaaaagttatttctgagaaattaattgttttttatagccaaaaatatactgacgcgataagttcattcaatagaacatttattcgatataaaagaaatattctttcgaacgtcggtaatgagaattcacatgtcgcaagactcgattggaagaattttaatgaattaatgaaaaagtttcgaactgatttaaaagataatgatattataaaaatgtattttaattgtttaatatattctgattcgatcggaagtatcacgttggatgcttttgatactttatgtttatcaaaacaaattcacgtcgacttaattgatgttcctgggtataagttccggaatacaataaaaaatgatataccgcaaaatatggtcgcgaaaatagaaaatgaatggaatgataacttaaaaataaaaataaataactcgatgactgagttaaataagaatgatataatgcaaaataaagttttattgttatcgaatattattaatataatagaaagctatttaaataataaagacgcaggtcctcttttattaatgatgctaaaagaggcagcatatattatagaaaaggaaacaattccatttgcgtctgatttatcatttgataattgtctttcgattcttggaaatcaattttcagttttaaatttaaggaattgaacaaaagaaaattagcattcaagaaattcatatattcttgagcttagcaatttcgtcggtgagacatatggaaagattggatagattggcggtgaaggcgtatgctattgatgatgtgattaatacaatttctaatgaataaataaataaaaatttggtcaataaatattataaatatatcaaaataaagtgttaagtagtatacaattacaatatatttaattttccatttgatgtaattgttcggaacaaacgtcgaatcaatgaactcaatcgcatgaccatttttagtgatttttatatacctttttcgcctaattttgttttcaatattggatttcaatatgaccaattcatgatataacaacataattgaagagatatctcaattaattgttaagtattaaacaattaccataaatttaattttctataattaaacagatttagggaaacacttctatcaataaatcaagcaatttttagtttgaatgaagaaaatttctctagatctttgggcttaataatcaacaaatttgatgaaatctatcctttatcttatgatttaatcattattcaaatgatatattattcctttgtaattaaaaacaataaagtaaatttatttttgaatattatacaagaaataagaaaatttgaagagtgtaataaaatcaattcgaatatatttgatgtttttggtcgatttcttaatggtaaacatcatttgaatataaaaatatattattaggtatttgactaatatttacaattccattttattggtacttaaattaataacacaattctaattaactatatagttctatgtaatctgatcggtatatgaattgttttcattttgcttcattttgcttcatttttaaatccttaaaaacaactttaagtactgttgtacttggggatactatctgtaaatattctttgataataaatcaaaagaatttaataaattagaagaattaggaaagctttgtattttgtatcataatgatgaaatattttcatttttacttaaagaaggaatgaaaatcaatgatgatattaataatgaagcagcaaatattggaatattttctgaattatcattcaaatccgcatgatattttggtgctttcagcaggatcaagaaatatttggaaataatacaaattgtttaatactgcacttatctatgcatctgaaaaaggttatacagaaatagttaaattacttcttgagcaagaattcaaaataatggatcaattccaataatattcaaattacatgtaattccaaacattcgtacacaaatcaccaaatttctgtatttttgttgacgtgggttttgattcaggctgttattatcaaaatatataaataaaaaattacataaaaatcaaatattctaaaatacatcagaagccatatttgaatgatttggtaatctttctttatttacaaattattttatatttcgataattcttctgagataaatatgtaattgttgaatgcaatttcataaaattggaaaaaaagatagtacaagatataatgaaagacttaaaatttgttgatctcaacaatgtttcatattttatgagaagcaccgagaagctaaagttgagtatagtagagaatgatatgtgtggcatatatgttcgcaatgaactttctggatgggcgttagacaaatgttgctagaagagatttaacaatttcgaaagaagcattatatacaaatcaatttattttctaagaaaataaacatcatttatcgaaacttcttctcatcttacaacatatttattttattttgttcgaaattggtataaataaaaaaattgtttcgaagattttgtggttttctttatccaatttgcttcaaacatttttgtcagaattttcaaagtgtgaaaagtcaaaaccgatttttgaactgaaaccgaaatactaaatttttttgtgaaaattgtaactaaattataatgtttccaatcaatttattccacgtttttgattgtaccacatattgtaatatttattctttattatgctatctaatgttctaattttattaatgtctcaatttctggaaactgttccgatgcggaagtccgcttgactctctcacgatgtttccaccgaatctcattaactcgtttgttattggtgatggagtcttagcaccgaatgagaacgatcccttcaatacagtacttcctggtctagccctcatccttgttcccatttgctttaataatgtccttggacttgcaattggtgtattactctgttgttctgaagaatgatttaaaatcctcataaacgttctctcggttatcgacggttttataaccgctatcccttcagaaccccattgcacttttaccccctcgagccaggggtggtccattgcttccttcgccgatagccttgatgcggaatccggattgaggagcttcgtgataaggtcgctacaaaacatggaaacatgctccggtatgtcgaaaacaccgctcttgatctgtttgaatatgataacttggttggatccacgccatggcaattcacctgttaccatgatatataaaataacaccacaactccacatatctgccgcacgaccatcataagattggccatcaatgatctctggtgcggcatatgctggtgagccacatggtgtagcacacatttgccctggatttgcaaatcgtgagaaaccaaaatcaatgattttgatgttcccatttggatccataagtatgttttcgggtttgagatctctgtgtgcaattccttgatcatggatatacttgactgtttcaagaatctgtttgaaaatacacttggatgattcttcactaattaaacttgattcagatattttgttcattaatgtgtcacctttacataattccattattaaataaaaaaatgatgaatcaacaaggaaatcatatatctttatgattccaggatgatccatattgagtactacgcgaacttcacgttcaaatcgttcgatatctgcttgagtattcatgtttgctttgggaattattttgactgcatacttattatgggtttctatatcttgtccttcttttacgaggctaaatgaacccttccctaaagtatgaccaagattatacttgccaatgaatggtggaaggcatgcccacgatgacattaaattaatcggttttttcagtttaaactttcataacgtccgtttcaaaacgcatacaaaaagttgttataatgccaaaaatcaggacactatacaaatgaaaatttcttgtaataaaagatattaaaatttatattttatgaattttaaggaggccaataattcattcaattttattttattttcatttatatgtatatcaagttatttagctgaaatttaacaaaatttcgtctgttgtttggcaaagccggtaaattttggttgaaaattgaatcgaaaacaacgttgccgttacatataaaaactgcatacaaaaaatctaacaactaacatcccgttcacgaccaaattattcaaaatactgatttagcatacctatctcatgcctttctagagtaaaatcagaaaatgagcaattgccacatgacatatgtctcttaatattttttccaaatcacttctcaagatttaagttataacatttttattaattcgaatttataacacgagaaatagaaatgtacctcaaagggaacacgaaacttcatcattaaaaggaaagaaaacctgatattcatatatatttttaacataatataactaacatttacatcgcttgtcctccataggttttggtatatcttttttatatggatcaattttcccttcttcaatcttcttttggatttgcataatgcatgaatcaatggcttgagaaacgttttcgcctgtttttgcagaagcttcgaagtaagtcatgttttttgttcttgcgtagttctctgcctcttcttttgagactttgcgttcaagatctgatttatttccgattaaaacaagtgtaacgtcagaaccttctacttctttgatttcatttatccatttttctgtgttgtttaatgaatctactgatgttaaatcgaacaatatcaatgcacctaatgaatttctgaaataagatcgcgttaaagcaagaaaaacctcttgccctgaagtgtcccatatttgaagatttgctctttgattttttattgttaattcttttgaaaagaattcaacaccttcagttggtcttaaagaatctctatattcatcctgaaaaaacctcaccagaaaagatgtttttcctaccccactgtctccaagaacaataatcttgattataaattcggaattcccaagcattaatgtgaacggttaattatgcattgaaattattcgatcgaataaatgccactttttagtagatggcagaatatttgttacggcgattttatgtaaacctatgtaaaagttgagtcaaaatggacttcggagcgaaacccgatgcttagatatactaggtatctaaaataatgatgagaatggtttctgttgaagctttaaagaacttgctcaaaaatatatgtttataatcaagagatatatcaatttttttatttttgttatcgatagaaaaagtgtcattttgcacgatagttttattgaagaactgttttttaattttaacatgatttttaaagacacactgtgtcaaaattaatttcaattcttttgattttaaaacattccaaatacaaaatcaacaaatttttatttgaattataactgcgtttccaattttttgtttttttaaaggtttaattggtttttttatttcatttttttccaatttttgctcttccgcaaatcaattcttttcttttttccatttcctcaaaattaattacttgtaattgtcctatttcattctcatttttatttaactttttattttccataatttttgcattacaaatattacacacaccatcaattacacaattcacatgaaacacattcccacaaccaaaagcaattatatcactttgtccaagtaatttattacaattcatacattttattattatattccaaacccatacataactcattaatttttaaaagttgtttatttgcagcctcattttttttaatttccaacaaacccatttcaaactcatttttctcacgaattgatctaaagaaatgaattacaattgatcccacaacatcaacggtttaccattattggctttagctttcattagcaacactgctttggttggagctggtctcgactgagcaccacgtctttacgtcttaaatggcgatgattgggaagaccttggtttaattgatatcgccgaaattcgtgaaaaggtagctggtggttcctcatcctcatttacttcaagagccgctgcttttggtggtaaggatgttaccaagagtgaaggaatccataacaacattatccttggaattcgcgttaccaagaatgctttcaccacatgcgcaaatgatggcaaacttggtatttggccatttgatgcccttaagaatcacttcaaaggtaaaaatctcttctgagtaaaataggcatcctatagatggttttatgagggaattccttgttgaaaaaaattcgaagaatatagatgagtttgtgatgaagtttaaaatgttattttccgttgagttccttgatggtcacatagttccccattttttgtgagaataattagtcaaaaatcctcttcttctggatgaatttgtctttttattcacttttttctttttaggctaaaccttacttcccaacttcagtcaaggaattgactttcatatctgtttcaccgtctgtgctgaaagacatttccttgttacgttctgcttccgaacgcaaattctcggctttttcaattacacatttgtaagcatctgttcctgttgcaagtctgactggaggatcctccatttcggacagtttcacaatcaaacttcctagcttagccgggtcacctgcttgtttgtggttcatgctttcatgccatttccggaatgtttcaaactgaggagcatagtcagggatattcctttccgaatatttcactgaactgccatccaaaaagtcggtcttgaaaaatccaggttcgatgatggtagaacgaatgcccaaaggttttacttcttgagccaaaccttccatcaaaccttccacagcgaactttgatgaagcataaatcgctccacctgccaccgaaaacactcctgatactgacgtgatggtaaaaatacgtcctgaatgttttgctcgcatatatggaagaacagcacgtgtcatgttcattacaccaaatacattagtttcaaactggctacgaatttgctcatcggtggtgttctcaaaccatcccaactgtccgtatccagcattattcaccagtatgtcaatctggccaaattgtttgattgtagcttcaacggccgctgatacgctcgctttgtctgttacgtccaatgaaagtgtaagcacttttggatttgttccaaattctttttcaactttctccttattgcgagaagttgccacaacacggccacctgcccaaggcagctttggcaatggctaagccaagcccgcgtcctgctcctgttatagcaatatcaaccaaaccctttccatattttttgaaacacttcacatttggcccaaaaagttggttatcaaatgggatattaatagtatagaaaaagtgaaattttgaaagcatttccatcggtgtaatgttttaaggttctatcgtcagattttttctgtgttttttgatctgtcgaatttttttgtttgtttaacaatataaatcctgtctccgattttatcttcgcaggaggagcctccttgatatggagtcttttagggggtaacggcaaaaggccttctgccgttaccccctaaaaaaccatataaaggtaccccttcgaacaaaaatcgcgtctatcaaataatggagaaatctcttcagatttatgttttagcaaaaattataatttccattttgaatatttttctaatagagataaatcaattttttcatttaactatctatcgatagaaaaagtgtcattttggggttattatttgatgtacaagtgtaaagaaatatgaataaaacccataatatgatgaataaactattatagtataatcataataaacaacaacagtatcagtgaaaacatatttcgaatgtttaaatatgttttcgtttcatgcactaaataagatatagtttctgttaatgaaattgacaatgtataagtaaatgaaattgttaatgataaatttgtatcatatgatagtgatgatggaaatgtatttgattgtgaatatgtattcgactgtgtgaatgttaatgttgctggaagacatttatcaattgttgtatatttagcaacatcaaaattataaaatttttcatctttatatgtgttttgtaccattactgtagtcgaaatattataataaaatacatttgagccaaaatttggtcttgattaccataaaaatatatacatttaatgtttggacattgatcgaatgcacattcattaatacttgttgtcaaatcagtacaataacaaaatgcataataactaattaacgtagttgagtcaggaattattacgttgttcaaacgagaacataccataaatgatgattcaccaattgtattaacattattcattatcagatataccaattgttaaatcatttccttcaattattactgtgtttaattgtggacataattgaaatgaatattcaccaatggatgtaactgatttaggaattgtaatatttttcaaattattgcaaatagaaaatgaatattgttcaatttcaataacattttcactaaaaattactgtttctaaattagatgaattataaaatgaataacttccaattgttgtaatagtatttggaacataaaaaattttaattgttttttttgatgaataacaaataatagtatttaatgatttatcataaagatttccataattatcataatttttataattcgaattatttgatgatacttgaatagactgaagatttccacaatatgaaaatgctgtattagaaattgatgtaactgaagttggaattattatatttgttaacttataacatgattgaaatgcaaagtttccaatatattgaacattatcaccaatcattacttcttctaaattattacaataacgaaatgcataattaccaatggatgttatagcattatggattgttatcttttgtaagtttttacatgattgaaatgctgaattatcaattattttaacttgttcagggatatcataagtttccatagtatttgctggtggataacaaatgattttagtaatatatttatcataaagaacaccatcattatcataattagaatatgccgaattatcatttgatacttgaataaattgaagattttcacattcttgaaagacattattaccaattgaagttattgatggttgaacataaaaattggttaaattggtacatgaacggaatgcattatcacacatttggattccataagtgcgtggaatactaaaaaagatttttcattcgcaatcttatgaatatttgatatttttaggttttatagtttattaaagacacatacaaataaatttatataaattagcaattacacttttttttctctaccgcaggtgaataatcaagtttgtttctttcgtaatgtggaataaaagttctattttcaattcgatgttcgattagagaaatacattcgttaactgctttttcaacattttcccctgtctttgctgatgtttcaaagtatttaatccccatagataatgcaaattcctctgctgcttcttttggaacagttcgtttagctttgtcatcagatttatttcctatcaaaacaattgaaacatcacttcccgcctcttccttagcagtttgaatcagatcaccaacagatttaaacgaatccgagaaagttaaatcaaagataactaatatacctgctgaatttttatagtaagcccgcgttaaagaatcgaaaacctcatgtcctgcagtatcccacaattgaacctgaattttgtgttgttttgttattatctctttttttataaattccactccatgtgtgggcattgttttgttcagccatatattttttgtgtacctttccaagaagcatgttttccctacaccagcttttccaataacaataatcttcacagagaaatcatattgacacaacattcataatgtcaatttggtcaaacttatgtcgacataaatcaaaaagtcgttttctggaataaacgtttaaaatcaaaacaatttttgaaagaataacgacaaaaatatctgaactttattttcaagtgtgcaacttatttttaattgtaaatatttagagcaattatttattttttcgaattaaaagctcatggagcttcaaaatagttctttggagatgttcaatatctgcaggaagaacccaatttcctctatcttcttgtgttgctatatcctctgttgataaaattggatattttgcaatcactgatgcaattctatgatacatcgatgcaattcttgaaaatctatttaacaaaattcgtaattctttattttctatttgaaaacattttaattttgcgaaaattgtttgaattaagtttgcttctgtttcacaaatatcattaaaatcaaattcgaaatcaattgattcttcaattggaacagaattcattaattcgacaaattcattttcgattgttattgcttcaatttttaagtcatttaataaattaattaatggttctgtatcttgaccttttaactcattatatttttcttttgcaagaataacttctttcttaagtgattccatgttttcttttagattaaataattcattttcagcatcaattttcttttcaatttctttgcgaagttgtattttcatttctttatactttaattctttatcattttctttttgtttgttttggatttgtgttcgaactattcgcgtctttttattcgcttgttctttaagtttattatttaattcttgaatttgtagtttgaatcgtttaattttttcttttttcgactttaatttattattcgcgtttttctcgttttcaatcgatttggatattcgtgttaatagttcatgattttttgcttgttgtgtctttaatagattttgtaatgttaaattttgctcaactgctccattaatactttctttaagattattaatttcatcatttttctctgtgatttcatgtcgttgttgaataataatatttttgaaattcgttttctgtttttccactttacgaatagtttgtgttttcttatcaagatcaagttgaagttcatcaattttaagttgttcttgtcgattagtttttgcataaaaaagatttcgttttaagttttcgatttcataaacattttcttcattttcttttcgaagaagatcaatttcaatatttttattattaatatctttattcattgtttcatattgattagacaatgagtttaaattttcttgtaattcttttatttgtgcatctcttttttctagtagatcattcatattttgaaatgcttcatctgttggattttcagtttgatgtagattattaagcatttcgataaattctatccgttccttgtcaatatcatttttaacttgttctgatacatttatgtaatcttttatttgttgatttttttctttccttaactcatcaattactgcttgtaattctttaatgatttcatttcgctcataaacaaatgatgcttgtttatttgctgattcttgtgcttgataaaattgattttgtaaatttgagtacatatttgaccattcctttatttgttgatttcttttttcaagagcttctgcaagttgttttatcttttgctcatttgttgtgattctttgacgaagaacagcattttcttcgtaaatttcatgatattccatttagatttcaaacgtacaaaagcggggcgccccgtaccagaagtaaaaaaaacctaaatcatacatcaaaaacattatttaatgaaacaaacttcatgacaatgataagggatctcaaaaatactgagcaaatttaaattttagttatttttcaaatatgcaaaaaagttataattttttgtgtttcagatatcaatgtataaagcgagagctattcatccacccattttactgataagcaaattttattatttgaaaaaaaatattaatatggaaaccaatttttcttttttctttgaaattataatatccaatgaaaaaataaaaaataaactcacattcacttcaattccaatcgaattttattttgtttgtttgttataaatgagtttattatttttgtggttcatagaaaaaatgaatcattttgttccataaccgtttttctcattgaaatttcgtacaaaaccgttatatttttattagatggatgattatcacaagaaccagtaccttcaagacgtaatcaaattcttagaaaatgaaaaaagcacgcgcattcatgacgttattaaaagcatcgaaaaatcatctatttcagaaaagatttcaatgtatcaatttttatttcaatatttttctaaaggatgtcctcaactagaatgtcttactaagtcaaaaaaaagcacattaatgtctttatttagttatgtaatttccaaaattccaccatattacttttatccacaaacatttggtttagagattggttcctgtcagcaaaactattccctatatagatgttttaaacccaccatccaacgcattaaaagaatcgaaaaaatgatacaatcaatttttattgattcagatttatcaccattttcacctgattttaaattttcctttactgatcctcaaatcctctttgccaaatcatcagctgatcttagtaataatctaatttatcaaacaccaataatccaagccttcaagaaacatttattaaatttatcaaccaccacttcatttcatcatctattaaaaacccaaaatggaaaaatgaatctcactttagcgataattgaaattctatcagatcttaataaggaacaaaatgccacacaatgtcaacttttattttgtttttccatagtttttttatatgtcaactcctttgcaaccacaaatgatattgatggccagacgctttgttcgtacatcacatctcaaccatttatctcaccattttgtttattttcaatgattaatcatatctctatctttatccatttgtttaacttgcttatcccgaccgaaatctcccaaaacttggagcaacaagcggaagttcacccgtcgcaatatgaacttgtcgatctatcggtcgattcacattttgatccgtttcttaaacgtatcccgacgatagcgtcaaattttttcctgtcaaaaaatgccaccaacaacgatgaagaatttgattgtgcagatgataatgggttattttgtttcttgaatttatcatctacgcaattattaggtaaaatgaaagcagtgttaagtttagcaagagaaattaaacttggcccaattcatgtatcaggaatgaacatagcattattacgaattatacgattttctttacaaagagctatcatagattgtgaagaatccaaaattgtcacaccgaaattttgttattttttgcaaaatatattttcaatattatcagtaagtttttccgaacaaatatcacggaaattcttttcgttacaagaaatcaaatggaattcctgtgttttaattattcgcttaacattatcaaatttaatattatgtgtattacatcaaattccagaccataactttgtcttattttgcttaaaatgttccaacatggttgaaactcaagggtatgccaacttattaattttaaagatatttccatataccaaattttatttaatcccaaatgtcattgaaactttaccggatagtttagactcatttacagagcttttatttctcgaagaattccgtaacattaagcaagtatattcatttgaagaatatcaaaaactcaagaacatttacaccgaaattctcaaaagaggaaattacaaaacagacaacaaagagaaagtattatttcttagtaaaatgaagcaaaacaaaccacttcaaccaaacgaagagttaaacaacacgatcaacttagcgttagaagctcaaaccattcaagaagcatttgatttaattcgaacgtgtaaagtttttcatcaagcaatgcatttaatatatgggttatcattaacaccattttttaaagattataactttgccacgtttttaaactctgcgatcttaaactttgttaaatatactcagccgactgatcgcgaagtcaaattctttgaaatcagtgaaagtcaatactcattaccatttgcgcaatttcttcttaagcgattattattacaagggtatattgatttagcggacaaattatttaatgagttaattgagtccattaaaaatgataaatgtgtattacattggatcacattatttctaattgatcatttccatttaattacagataacataacgattggattaaagaatatattaaagtcattaccattatcagataagttttatttccaagatgataatttcatatataatatatcacaattattaatcgaaaaagaattgccattaattcgtgggccttctttattagaacgtgaatatatctctgaatatgaacatgtatattcatttggtatatgttcaataacgttatactcaaaagatcccgaaagaattgcaaatttattaataagtccaattaataatattcgtttttcatggaataatagagataaatcattatatacttttgcaaaaattgctgctgatttacatccaactattggtataatattctttagaaagttattaatgaaaaatatggaagtgacgataacaagcgggaaaatatttttgatgttttgtggatttaaaactttcgctggtatttgtgagaaaattgagatgttgaccgagaaaaataacacaaaaattattatgttcttgaaaatgatttgtccgtgctataaaagattggtcggagataaacaattcgcaacaaagtttttgtgtaacgtaattaacttgtcgaaattcgtggatgataaaatcgagttggaaactgtggtagacgtcgtctgtttgctgtgcgcaaagctgaaattggccgaatttaaaaacgaattactaaaagctgcaatgatcttgccgaataaggaaaaagaactcttcgaggcggcaatggaaatagaagctgaatcatattaataaaatgttttgatttgttttctgttgtttttaacttgcagaaattcgttgatgataaaaatgagttagaaattgttgttagcaatgtttgatgaaatgttcaaagttaaaactaatgactttaaagacgaaatactaagtgcggcaataactttatcttaaaaaaagaaaaaaaattgtttgaaacagctctaaaaatagaagctgaatcatattaataaaatgttttgaattgttttctgttgtttttaacttgcagaaattcgttggtgataaaaatgagtttgaaagtgttattgacgttgtttgtttattatgtttcaagttgaaatagctaagtttaaaaacgaattagaaaatgaaacaaaaaatatacctaaaaattgaaaaagagttgttcgaaacagctctggaaatagaatctgaaatatataacaaaatgttttttattacacttaaaagtttattgttgaaatgaacgaatttgaggtgaaatatcagctcggtgatatggcaaaaaacaattctgaattttttgatcagccctcaaaaattcactaaaaccgtcatctaatccgacctctcaaaaataatttttcatggaagacatacaaaattattcaaaggcattccacgatctcccaatagaaatcaagacaacacttcgacgtaaaagcagtcgtgatccttcatctcgatttccaacaaaattacacttattattaacttatgtaacagaaaacccttctttggaagaaaaaattggacttggatggataagcgatactgaatttcgtatgaataagaaaactcttggttctattatgggtataaaacttaatacaataaacgttaaccttaaagatctaggttttgaacaaactcaacgtgacagaaatggttggactcattggaaacgtgaaggttttaccaaaagtaacgcaggacttattacaactaatccaaagccacagagtgcaataccagataatagtgaagttttaattcgttttccaacacccgatgtttctgagatttccgttaccatagacttcaaccgtatagcacaaaatgcatggcaatcgattgttggcggaaattataattcatttcaatcttcacgtttcattgaaatggcagctcaataccttaaacataatgaacaaccacaagacaatgcagaaaatgtgcttcgtgcacttattgctccatgtagaattggattaccaacagtcacaaaaactgatttctttcgatttcttgcaatgtttggcccaccctcgagctcaatggtaaagattgcaggcttattagagcattctaataacactggtaattggttatcttttacacctgaagctcaagagccaaacacattttatgcagcattcgacaacattgttccaaattgtttagtgtttcataaggcaaatgttacaaatgaaacttttagagtgtataatattccgacagttgaagttagccaaggaagttatttggtcgaccagaacggaaggttttatgactcatgggctaacttctttagcgcaaaccctggaattatcgaaacaatgtccataaacttatgaggaattatctttaattcaaatttaaaattgaatgatctcatagaaaatattgaacatatttataacgaatggaaataatgaagttcattcgttatagtatacattttttttttataaaaagacctttgttatatattaaatggaaactctataagaattccaatatataaattcaatttaacaatttcagaaataataaaaaattttagtaagtatttgtttttaatgaacaaataaaattttactcacgttgtgtctatatttaacttagtgattaattgttgacaagaaatttatgaaaatgattttcatctgaaaataacaaatgtgaattcatggatggtaatgtcatgaatcaaattaaaagttataaaatttgtcttcttttgagaataattctacttgaaaaaaaattaacaattttaattttggacaaatggaaaagtatattatatttctgcaaaaagaataaacaaaaaacggtgttaatatttatatagaggattatctgtttgaaggggatattgattattgatatcaattttatgtaaatgatatttttcatgaatttgttcaagcaaaagcttgtctctttgttctggtgggagttgtggctttagtatttgataattctttttaacacgattttgaattaattgagaacgcttttggaatgagatccaatctggatctgggattggcgcttcatctacttgcggagctacaatgtcaaccgaccatggtttttgtggtcgtgagctatggtattggtcaacttctgaatattgaaagcgaaatggtaaaatagtaacatttccatatctgtcattctctgtttgaggtgggttggcttctgctaataatggtggagtccaattgtcatttggatcgattctttcagcagttggttttaatgggtctggatgtggtggaaaatgaagaaaattcggaaggtgtgcataaaaatgatccattgaagtcaatgtttcgtctgcaacactaaaacattcacttaatttttcttcttccatttgttcgatgtcatgtgatatgaaattaaatatgtttttatttgcaaactacagacattagctgtgcttctatatatgttgtgtgtactattgataaaattgccagcaccttgttttattgcttttggtgtaatgagtcgatttttcatttaaaagaaaaattgtaagtacttctaaaattttaggtttgttgttattctcttcatattgttcaattttttttatgatttcataacaatttattcgcatactaaaaagtatatatatcatttgactaataacaaggttaaatgagtaaaaatggtttccatcaaattatgattaacgaattaaaagattgaagaatatttttttcattcaaattgaaaattatttgtttggtgaaaacaaggaattcccatttgttgtgaattatttgtttcgactttttttcttccctttcatagttcgtttcgttttcaatcatttcaattttcagaataaaccattaaaactcaaatgaatttttgtggaaattctatactttatgaaaagcgatatattggcgaacgttatgaaaagattcaaaccaaaatagattcttatattcttatattaattgtgattaatttttgttactcgagttgaattgtataaaatgagaacaatcaaaattttcacgttaacaatctctcttctagaaattattctcatttttattctatacatatctgttttagacgaatggaatgtctaaaaattctaataaagggctttgtgccaaaaaaatttcaataattttatttcgaccaaaaaatgggcttttttctggtttttgtttcaaccttgttggcagtctttggccactttgcaattattgcaatatttcatttttcaacaaaatttagtgctgatattattccaggaaaaaccctttttgtaatagcacatccagatgatgaagtaatgtttttcggtccatcaattttgcgctcagagtcgccatatatattatgcatatcaaaaggagtttcagttggaaatatttcaagatcacaagaattacaaaattcatgcaaagctcttggaatcgaaggtaaatgttttattgatgaggagcaaaacctaccagacgggtttgagtatatgtgggaacgtagcgaagttcgctcaattatcaacaaatatgtaaatatgttaaaacctgatcgaatcgtcacatttgatcaatttggtgtaagtggccatccaaatcatgttgcggtttcattagctctaactcgtcaaaaagtttttgatacagatgcttccaaaaattacaaccatagtatttctgaagatcctattgaccaaataccaatttacaaattaaattcgaaaccatcgcttgtgaaatatatggggccttatagtattattatttatttgatgttctacaaatcatcgaatgggtatttcatagttacgccaccgaaagaccactttggaatgaagatagaaaatgcgtttttgcaacatagttcacaaattgtttggtatcgatttttgtggttagcatttagtaggtttttgatatttaaccaattggttcctgatgtagcttcagaataaatgttttttattttgttatttttttttttgatcaaagaaatttgttaatttgttaatgatatctttttaatggccaaaatattttaagcatatacatatcgagtatgtcaaaataatgttaaaatgctcccaaaaattcaaattgatgacaaatttctcgacatatccaaaagtatgttgatttcaattttcatcttaagtcatatgctatatttttgtagccataataattgtcatttataataatgtttaaacatatataatatattgaattgatctatttttaaattacatctttaaaaacacaataaatgaaacgccgtagctgttgtttttaatttttggctatctattcaaaaattgatatttttcgatgcaatcagaaaacattgcagaacttgaaaaaattcttatgaaccaaagccacttcgaagagcttgtttttcatcttaacgcaagtagctttgatgaagcaaagtcacttcttaatcaatatgataaaatgtgggtacaacaacttattgtcaaagcacaaaatcctcttaattacaaagtccttggtgacttattcgaacttacaggcaaggcacaaatcaaattttcttcagatacttctttccatcaatatctttatgttcgaggtttaattacccccgatgactttcgcgacaaagaacttctacttagcaaaagtcaattgccacctgtttcaacatttgaaaatcctattatgaatggtgaaatcgaggactacattcaaaaggatgaccttcaaggctttgttgactatgttattgccaataatgttgatcttcatgaagaaggttttctacttaatgatagtttgttgggcctaattgatttttgttgttattgcaattcaattaatattcttaaatttttactggaaaacgatgttgaaatttatcctgaaaccattaatagtgcagttgatggtggttctgaagaagttatttcatatcttgaatcaattggaatttcgtttgatcagactattattcatgcaattgcattccatcataataatattgctaaaactctttttaagaaatatgaaaataaaggatttaagttgtcgagatgtgttcaatggtttaacactgaaatgttaatttactttattaatgaatgtgatcttgatgtgaatcaagaagataatggaaaaagaacatgtttgcattatgctgtttataataatgatctgaatgtggttaattatttgctgataaaaggagctgataaaaatctggtggatgacaatgggaattcagcgatggattttgcaagaactgaaaaaatgaagaatttaattaagtaaaaaattaattaagcttcaaactgtattttctttctaaatattggattttaaatatattaataataactttacataaaatgataaataaaaaaagatattaaaaagagaaaacatgcaaaagaaaaaattctttatataataatttcaaagaaacaattataatataatgaaaatatttaattctttatttaagatttactgttttataatgtttttagaaagctttattttaatatctaaatatcatcatctggatattatctttcaccatttgatcaactttttcttcttctgacatcgaactgctttctctcttttttcgaatctgaatagcaataactattatcactacaatcaaaataattacaattggaacacacgcacctatagcaattcctattatgtttgattgtgtaaatgtatttgattgagcaaatgaatttgattgtgtaaatgtatttgattgtgtaaatgtatttgattgtgtaaatgtatttgatttcggtattgtgcttgatttagtaaatatatcagacttcgaaaatgtatttgaactggaaaaagattttgattgtaaaaatgttcttgtatttgaaatcgtatttgattgagtaaaagtaagtgatgttatgaatgaccttgttgaccaaggatcacaatcttcaattgttgttccaatagatacattaagcataccgaatgatgttgaattatatgaatataatgtcataacatattgtgcaaaaatgccaacaaatgctgagtaatgaattattggctcagtctgtccataaaaataaatacatttaagagaaacacattcataaaatgcatttattccaattctttctaaattttcttcaaatataacttctgatagatttaaacattgcatgaaagcagaatcataaattgatgttaacgcataaggaaatttaatattaaaaagtgatttacattgaaaaaaacaatgtcctccaactgtcgtaatatttgtaccaaaaataacatctgataatttataacacccttgaaatgttctttcataaagagaagttattaaatttggaattcttattttttcgagagaaatacaaaaaataaatgcgtaactaccaattgaaattacattttctcctagaataatctcaaataatttagaacatcttccaaacgctacttcattaatagagattactgaatttggaattttaattttttcaataagcacacaaacagaaaatgcatattcaccaatagttttaacattctcaccaaaaattatttcagttaatttgttgcatcttccaaatgctaaatcatcaattaaagttactgaatctggaataacaattttttcaagagatatgcaattaaaaaatgaataacttccaataactctaagattttttccaaaaattacttctgttaagttgaaacatttcataaatgctgatttattaatggaaatcactgaattaccaatttcagcagaaaataattttggccattgatagaaagctcgaagtggaataacagttatcccattttcaatgataacatataatgtatcatttgcatattctctcgtaaattctttaggatctcttattgttaacctttttgtttcatcattgaattcttcatgtgtatgtgttaaaaatatcaacaacaaacaaacattcatttttatgacaaaaaaatgatgtgaaggatgatgaaagtattcaaattttgaaagtcataacaaaatttgagagcatttgttcgaacaaataggataagaaaaagtgaatgagtaaatcattaaatttcggggcgtcccattaaatgataaagttttcaatattgaatgacaatataataaaccatcaaaaaattctaggaatgcattcagtgttgtcatgattgccattaattggtttgaaatcaattttaccatgattaaaaattatttaaacttttcacttcaactttggatacatactagtccacataaaataaaaataattattcaaatgatgaaaaatgaattctttcgaatgaattcatttggacttcatgcataaaaaagttgatcaacaggatattaaactcaatggtttccattacttctacgtaaaaacttttcgtataaaaatttggagtaaacatctctttttgacagaaattcaaagcaagggcaccctaattctactttttcttgtaaaataaagttatcaataaatttgtaaatcaaacaaatttcacttatcctgatcgtttagaaattgatgttttggttttggaaatttttctgtgttgttaaaatcaattgtttctatcttaatttatctccaaaaatttttttctgaaatatttatcataaaaataagtaaaatatatatttgaaaaatacatttttttattattcaaaaattcttttcgcgggctttattaaacggtttcatttgacaatgagtgaagggcaaatttctctttctgattacgagacagtcgaagacgttccacatgttccagggagccatggtcaatgtagaattgttaaaaatgccgacggtgaattatttgttgccaaacaatttacaatatttgatcccctcattgacgaaaatgattatgagcctttaatgagaaaaataatgagcattgaccatccttcacttgttaagaccattggatattctttagaaaatcctgatccttccgatttttctcctcaacttactgttataaccaaatattatcccaacggatccctcgaagcgattttaaatcgtgctgctaatggtgaaaatgttgaaaaatggaataatacaacaaaagataaaataatcgttggcctttccaaagcattaaagttcttacatagccgtgacataatacatggctgtcttaagccaaccaatgttctttttaacgaaaacttcgaacccgtaatatcagattatggttattcgagctatttcccaaacaatttctctacagctgatctagagtccattggtaacagtataaactatcttccaagagacatttttagtggagaattctttgataatcaaaaagctgtggatatatatgcacttggtctaattatacatgaaattgtcacaggaaatcgtctctttgaaggtagtagccttacacttaagcttccaaagatcaaagaaggatttgatcttgatttaaattcatgtcccgaaacactcaagccattaatttccacttgtatcaaatccgaaaatgagcggccagctattgaacaaatagacaagaaacttactgaatcatccaatgcacttttacctgatattgatcaatcaataatttccgaatatgttaattcaattacaacgtatgaaaataatcttattcaagcgcaaattttatcgccgaagaaactatcgccagagcgcacgcagccattcaagaacatcaaagccggaatttctgacacatcaaatattgaacgaagtaaacattacaattctctatcggaggaagcacgtcaacttttagatgcaagttcaagcggcgacaccaaactatataaccttatctcactcttattttataaaggtaatgaaggttttccacaagattatgaagaagcccttcgttacgccaaattatccgcatataataatgactcaacaggaatgcatatttatgcatgttatttaagtaatggtataggaggaccacgaaacatgaaagttgcaagcgatatgtttaagaaatctgcagattcatcaacatctaatataaattcaatattagcatatgcttatatgcgagaaaaaggttatggaagcgaatttccaaattattcacaagcacaagaatattataaacgcgctgcagatatgggtaatgttgaagctaaattccattactttaggattcaacgtagaagccaattaacaaaagaagatgtattaaacattaaagaagccgcagacaatggaattattgatgcacaagtacaatatggttattgtttaatgaaaggcattggtgtggataaagatgaaacagagtcagtgaaatattatcaaatggcaatagaaggaaattcaccttcaagtgatgcgttttgtaatttaggttatttctatcaaaatggtatcggcggcttagaaaaagattatgaaaaagccgttgaatactataaaaaagccgctgaaatgaataaccctatcggcgttgtaaactatggaattatgctgcggttaggattgggcgtggagaaaaatgaagaagattcaaccgagttgttcaagaaggctgctgacatgaaaaacacagctggaatgtactactatggttatgctttatgcaaaggtattggagtcaaagttgatcaaagagttggtgtggaatattttagacaagctgcagatgacaagaatccttttgttaaagcagtgtacgcatatggttatgtactcgaaaatggtattggtggagtgaaaaaggatattaaagaagctgatagatattatggaagagcggtaaaaatgggttatgaattggctaacgaagcactcaaaagaattagagggaaataagtctaaaaaatgatttatgtaactgttttttgtacttgggtttgcgattcaatgtaactgttttttgaattcgatttaatcgtcataaattctatcgtactatgatttttgtgaacaaaatcattcatcattgaaagatgcatatgaaacagcaatacaatttcatagaaatgatatttttatatatctttatgaaaacaaaattggaaaaattaataatttaactggattaggaattaaatgtattttatattataattatgatttttaaaattagtatttggaaattattttaaatttttaaaacagcacttatgaatgctgttaaaaatggtaatatcgaaatagttaaattacttcttaaacaaaatagaatcaatatcaatattaaagatatctatttgtcttatttaatatttttatcattaacttaatgttttaatttaatatttggtgaatatttaaattatgtcatacggcactaacatgtgcatctttaaatggtaatacagaaatagttaaattgctttttaaacaagaaggaattaatatcaatgccaaagacatttgtttgttttatttaatatttattcgaataatttaatgttttatagtaatatttggaaattattcaaaatatttgagacggcactgatgtttgcatcagaaaaaggttatacagatatagttcaattgcttcttgaacaaaaaggaactgatattaatattcaaaatatttaatttttttgtttaaaatttatataaaaatcttggatttaaaaattaaatttggaatatatatatataaattatttaaaatagtaaaatattacttgtgaaaatgttcagatattatcatttgcttcatatcgtataattaataaaaatggtcagagctaggtctgatttttacattttttaaatgattatttgaatattttagaatcatacttttcttgtttacgaatgtttggctcttaatatctaaatcatataccaaaaaataaaataatttataatacatcgtttttccaaatcaatcaattgttggatctttatttgagctcaaaggattcttgttatataaatataataggaattttagcgaattctatattctttaatgaaaaacttttttataggaaaataacactcattttgaaaatatgatttttttcgaaaaacagaatccattcggaaattcatataaaaatattttttcggcattaattctccaaaaaaaaaaaaaaattaaattctgttgggaaattcttttgtttacgggaaaaaattcattccaaatcgcttatagctttcgaaaatcgtatatcgttcgcaatttggataacaatattaatattcaatttattaaaaatgttgtgactagcactttaatatttcttcaacaagtggctgtgtatttatattttcgagtaatgaaacttcaaatattttgtattcacaaccttacaaatgcaatttacattactcttttacatcatctaatgtaaaaaattttccatacgttttatcgcatttgttattgtatacaacaataaattgaggtctttcaccagttttaagatgttcatcgactaactcaaatgttttgaaacaatttgattggttaggactgagaacaataattatcttatccgcaccacggagatacaaaacataaagcataaaacacttttcatctgctgatatgtcccataagtcaagatgttttaataatgttaagcaaaactctattggttggagtataatcaccatgcttagtgcctaataaaatttcattaagggttgttttacctgtgatgccagcatttgatatttttcttgtgttcaattttttcttctgaataactggctaatcctgtgtggcccatatactttcctcaacggcctcttacaacgtagggcccatcacgtgagaacgaattttatgtacgattgattttgactaaaaattcggcaattgttagacgatcaaaaagcaccgaaaaagccatttcatcatggttaataatatgaaaaagtaaatctttttgaaatgaaaaagtcggctcctctcaaaatgtttagttgaactgtcaattgacagttcgattgtattttcaaatgttttttctccttattgtttgttctttatcagatttccaacgtattgatttcataagaggtcatgatgatgaatgcaaacctgaaatacacgaagaagaattgaagaaagaatgcacaaggaaatcatctgaagttttttgtgataattatatcaaatattatgaagtattaaacgaaaatactgtttgcgaaattgattattcaaagctctcaaagattgagagtttggtaaaatcggattttgtttcaatatttccagtgagctcatattcggaggaaattggtaacttttcaagtatatctggaaagcatcgtgtgtggattggatcttctaatggtttctttgccagtgctgatgtttcaaattcaattccacttcttgtttttgaagggtcaggctataactttaaagggaaattcaagggcgatcacatagtattttatgatccttattcttattcatttgacataagtgatattgaagcaaatcatatttatagcaatgatctttctctagttaaagcatctaatgcaaaagaaaaaacatacattgtacaatcgctcaaaaagattgtagttagcgacgatacttatacaatacacacttcaggaggacccacggatacattatcatcagatatttcgattatggtaagtccatatgccgaatcatcatataacattgaaattgaacaagaaaaaggaataaattctgcgaaaacacttaaaatattatttgaagaaccagaaatcgcatttaattctaatctttatggtaattcatatatagtttttaaaggaggaaaagttaaagatattgacaaactcattgaagcaaaagttggatttgattttaaaggtgattgggataatttaaaggattttaagttggatttaacaacttatacatcaagtaaagataaaatcgatacttctggcattccgaattctgtttcatatgaaataaaagaagatgaaacatttgggaaagcggctgatgatggcgatggattatcgaaaggtatgatagctgtcattgtcgtagtcgttgttgttgttgtaattattgttgttgtcattattatcgttgtcattaaaaagaagaagaagaatgctcaagttaaaaaccttgaataaaaactgtttcattttaattgttaagaaaaaagatagtaaattctaaattgtacatcaagtaaatggaaaatgtcttaaaattcggatatttttgatagaattgtatatgtcccgaataataagttcgaatggaaaaaaatgtgttgggtaaaacacgattcacaaattgttgattctttgaaatttattttaaatgttttttattgattgaagtgatgtaataaatgttttaaatttttaattatttctatgtttccatttaaagatgcaaacataagtactgtcataaataaagcaaatgtttcccagatattattttgaaatatcaaatgattaaaggtggagttcaaactgtttgttgccacaaaatttttattaattcttaataatgatgctagtttttccaattctacagggataatggaaacacaacgatagcccaacttaaaagcggttttacccatatcgtacatgattttctgaatataaccgttttgggcaacgatacgggcaactttggtaacgatatggactaattgagtgatttttgatcgtgttgttattcaaatttgaatacagccgcttgggtaacgatatgggcaacgatacgggctaattgaatgatattattatttaccatcgtaccatcaaacgaattacctgtaacactcaacttattatactaattaattccatcaaaacatatgacatatgacaatcatgccaaaattagtatgtttaattcaataatggcactaaaaaaattgcaaatttcatcattatattattataaattttggatttggcaatctaaaaatttaaaggtcaacccataatttcaaaatttcattactcgaaattatagtaatcaaaattgaagaaattgaaacatattcttataagatagatattaacagatgtatttgaaaaaagtcgatcattttacactcaaaaattacataaactatttaattaaaaatcaaaaaaaattcaaaatatcttaatatataatatattcaaacataataaaacaatgtttttaaatattacatatctagtgttatatactcatataatatttaaactttttattgaggaaatattcgtcaggtaccattaacgttttttgacacaccacattttttgtttacagaaatctcaaatgattttgggatattttttttgcccagggcaaaaaaaatatcccgaattagcaacattattcttaattatcaaaaaatcttcaaactaaatatctattttttgtaaataaatgggatttcttacacgaatattatgtttttgaaaattatatgaatattttctgaattgatgaataataatttatcaattttaagatattaaaaaaacgctctattacattgaaggaaattgttcatcgttatgtttattacgtaaattttattacaacaaaatatattttaaatttatgaatgaattcataatgttaaaatggaaatatctcgaaattgtcaggatgctttccaaaaatagaatttttagaaaagaaatcttgaatataatattatattttatttgttaactataaggtcaaaatatcattcaacgaaagcaccgtacctcttttttgttggcataatgatttttctatgtgttttcttttgatgtattgtgattatctccatatagatctatatcatgcttagatgaaaaggtacctaaattactactataataaaataaagaaaacctttttgttaaagcacaattttcataaaattattcagtatcagtctttttactcatgaagtttgtacaaaattttatgcagtcatttttcggtttcagaaaaagttcaatagtttattgcattaaaactttcgttatgctttgctttttgctgccattggcttattcttttgaagtcaattattcactagcgccaccaatgacaaaaacagatgttcatgaaatgggccagtggtctatgcagggtgttgctgtaaatatgaaaaaatttatcagattgacttctaacataaataatgcaaaatcccctgctgattatggcgcaatttgcaacagggttccaacaacattcagagattggttagttgaattcgaaatctctgcaaaaaatggtggattaactggtggcgaagatttcttcattttttacacagaggaggtatgcccgatttattctgaaacatcacatggcattatacttgattttaagacttcacaaacagatgttgataatttgactccaatttaccttatttcaaatttaaacacaacaatagctccacaaaccagaaccgagttaagaaataaaaatgtcccaacacgtttcaggctcactaaaagaggtgaaaaaataacactagaacaatttcaagattacaaattccgtatgcttatatctgaagacgttcctgggttaccaccatttggttacttttccgtaatggctgtttccgatgaattttctgatgataatgatcttcattcatttatgacattagccttaagttctgtcatagagaaagaatatgacccatcactttccaacaagaaccgtaaaatcattgactatgatttccaagagcgtaaaaagaaaaagtatgaaagaagattaaacatgcctacagttcgaaaatacataacagaagcaactgaaaaaaacaacaaactatttgacggccaatataacttgatagatgcctttcgaatcatcaacgaaaccatatcaaggcttgattcgtctgtatcgttggagtctctgaaaaagttcgtggagaccgttataaaggactcaattttggaagccgctaaaacgatcagtttcgggtttgagcaattttccgagattagatccgaaactcaagaattatggagcggccttagatcaaaccttctggaaatgaacttggaaacaaaacaagaaatggaaaaaattaaatctgattttaaggacttggcggaattgatgctgatagatgacaatggaatagatataagagatttggatattccaaaggcaagggaaaatcagtctactgtctcgaaggtgctaatagtgattatgattatcgaggttttgtcgtatgttttgttctttgtcgtaaaacatagacgaacaagcggcttcaagaagatagattaaagtgagtgttaaatataaaccataaattttttgttctttaagaattttttttgaatttaagctaattaagcataaaactgttagaaaatttttaagcatttccaacatttcttgtgattttgtttaaataaatgtttcacatcataattaaattattttttttaatgattttcggataaagattcacttagaccaaacaaaattagactattttagcacatacttgtatagttcattaagaagtttttttgaaatttcaattgattcaacaatgtaaagacctattatttgagatttgatatattcaccacaaataatcaccataaggactatagttgtccattcaaataaggaacaaaaacgaaattttaaaaataatatttagaacaaacaataaaacataaaggtcgatcaccaaatcatagggagaacttctgacgaaggtgcactgtggttttcagttgttttgacacgtgactgcttaaatattgttgcattcattatattttgtctgtgatcaaggtttttgtctgttgtttcaaaaatgtctgttacctttcctgatatttcatttcgaaggttgcttaagtcaagtaaacgagcagcttcaataattgtagatcttcttggaatattgtccatgagctcattaaccatgttttcttgtaccctatatgttggggtaatgggccgtgattgctttaaatttctgtgcttcattttaaagttgtgatcaaagtatgattgtgctgaaggtgcttttatgtgttttttcattatcactgttcttatatgacttccgtcaccaattttgaagaaagaaaacgtgaatgaacccatcaataaagtcccattatagacaaagtatctattatgagaagcatcaatttcagtcaaatattcttctaaaatttttactggatcaagtgcacttactgttagatcaatgcagtttgagtctaagtcatgtaaatgtattgtaatcaatgtggacatttagatgtgaattaaaaaattttcaatattgaaagcacttgaccagtttttaggaaacgacaaaacattgtttctatgtcacaagccatgaatttttcaaatattttttgtgttgataaaagacattatgaagtggatttaaagaaggatgaattatgatgaaaaacaaagaatatgatgaaaaattcttttttgaaatattcgatatttcccagtttttgagagatttgcaaaatctttatcacaaagaacggttttgcctgacaaaagaaaggaaccaaaaacgaaaaaagaaatgatttaggtgttagcacaatctagcaaaagagcttttgcctggttccacaatgggatgtttacagcaaaaaattctaagaagttaaaagcatcaatgatgtaatatatttttatttacttccatcaattatgttttgttggtgcaaggtgccgtatgcatttaggaattttcataaaagttattttgaatgaacaaatagattatttattaatattgtattcaataagaatgtatttgttaccatctatcattacaccatatattcaatcatgtattgtgtactgttgttaatatgtaaaagcaaattctgttacaagaacagacccaagaaattatctcatcccaatcacacaattttctttcgaaatttcgtttttcattcaattttcatgttcaattgtgtaatcaaaagttgagctttgtggggtataaaccatttaaattcaatcttaaaactgtgtcaattttccacaccagcagttggtcgcaaatactaccaattactaattattacttaataatttttgaaaaaaattcacagaaatagctgtttcgatgctttgatgtgttcaaattaaaaaattaattttatgtattttcttcaatacgcgatttaactataaaaatgtgtaattgaatactgtgaagcaagaaaaaatctatgggtgatatcgcagagataaaagaattcacactaaaattatcatttttaaaaaaatttacataaggatttttatctttagacactcatttttcaggttgatattttatcaaatacaaataatgctataacttcagcatttcctattcttcacttttttggtataccaaaacaaaaaaaatcactttttcactgaaatttcgacagtttaagttgcaaaatttcttcttgcgaattttggcaattttagttctcatgcttcctaaaacatggcaaatttaagtctctatacttttattcttttacttataaaaattatataaatattcacaaatatgtttaaaatccaattgtggacgattcgtcataaaattgtatttgttgacttttgccatcatcatacgacagctttgtgtcattaaaaatactagatggaattaagaaatcatcattgaggaaatcatcataagatatggtattgtctttttgtgcttcgattgcaggatcagcgaattcatcgaaatcgtatggagtgaaatcaaattggaatatgtctgatatttgattctttggattttcattcataactggggcaggtgttggaacttgaacttcaggtgttggcgtcataaaagtagcacttcttcggattgtccactgtctcagctcggagaaatgaccctttaaataagggataatgttcaataattgtgtagcatcatcaccttttgttggaactgttgtatatcccattttagcaatcgcaccattaattgttgacttgctcttagctatcaaaactcttaactgacgagtgttaatagcgattccatttgggaaccaacaaattccacatacaagataacgcttccaatcatcttcatctcctctggcacagaactggcggatcagatcaaaagattcattcaaagttgctaatctcttattcctattatatctattttcaggagaaccaacatgtttctgaagttcttcgaattctgcttggtcttctggtgagagcatttcaatgtaagattgagtttgatgagggattattaggtcaggcatttatgaaaataaaaaatgtgaaaatttcaccaaatttgttcggctatttatcttcacaatgcccacattgaaaaaccgatttttgaatcgaaaatgaacgttgctttggacagaaattattgttgtctataaataaactactcaaaattattgtgtcctcctcaaaaagtcgtctaaccgaaccgatcggatggcatgtttcggctttttatgacggtgatgaagtcaaaaatatcgaaaattttggaaaatttttgccaaaattttaaagcttaaaacaatgagaaacagaagttttgagcaactttagctttaaacattactaatctttgatgtttcttccaactttaattttcaatattttattattgtccatttgatgaagtacaaattctggtgggtgaagagtaaagagaattgacttaaagttttagcattgcatcattacaataatttttgaaaattaatgtgatcaatcagtaatgtttaaaaataaattttcaatttgaatgcaagaaaaaaattaatcaaagattgaattttttttaataattgcaagctgaaatcttcatcgcattgcattcgctcgaccaaaaataaacgccatttattcaattagtatttttgtgtgtttatttcggtttttccgcggtttttggatacgaccacaattgatgcctccacaaaccatcgaagtgaggcaaataaatgacaatcaccagtacatgatgcaactctgtactagcattcgtaattataaaaaagttgttaaagtatacaacccacaaatgtatcgaatgttaaaagttccaaatgaatgggtcaattatttaatatcttctttcttttccattatctttatcacatgtatgttaagattagtaagtgtaattccaaaagatattgataaagagagtaaacgattgacattctataataaccaaaagattcgaaaatgtaagaacaactatattaacaattattgtaacacaactacagccccagcgctcattgaaaaatgtgagagttggaagaattgttttgaaaatcacaaacctcaaacaattacgaagctttcttatatgttagaaatagttgacaatttctttgttttcttgacgccaaagtcagcagcgctattaggtgttgttagtgctgtttttatgttttgtaatttatttcattaaaaatttatttttttaatttttactttttatcttattcgatgtactgaataaactctaaattttgttttaaattttttaataataagttttaaattattaatagattaagtggaacacaaaaaaaaaattattttaaagagaatttataaaatttattgagtagagttgattgcttgctaaattcaagatattattattaagcaattagatttgtcttatgagtgatgatgttggtttcgttggggtgcccttcgctcatgaaaggaggttgaaacggcttattggaagctggatggtcatccgtttaattttttatgaacagcgcaagccaaactccttcaagcagagactctagaacaccttcgtgcacacaaagaaatgcatttgatgatagacgcaagaaaattattggctttcttacaagttcgaaaggtgcattagcactggtttttgcgtcatcactcatttttgctatttgtattattttgcataatcatgtttctaataatggacctcttttctttggagcaggtttaatgattttgcttttcagtgttttttattatttaggaaccagaacaagagaaagaaaatctaagcaaaacaaataaaggtgcctttttactctcacattttaaattaataaagatacttaacgatatattttttttttttaaattatcaaacaatcacatattaaaaacatgttggcaagaggttataatttgaaatgatgcattcttgaaaattcgaaatccattaatatattttaataatatattttaagataaaaattaaatttcagaaacatttttatgctaaaaagcaatcaaataaatttgagttttatatgaattgctttttgtaaatgtataataatttttatttgattgtttgaatgcgtgttttaatggaatacattcaaaaatttctgcatatcacacagaaatagttaaattacttaatgatcaaaaaagaattgatattaatgctaaaaatattcatttttttttatttaatatttattttaataatttgatgtttcaaaataatattcggaatttatttaaattatttaatacagcacttatttatgcatctaaaagagggaatatagaaatatttaaattactccttaaacataaaggaattgatattaattttaaaaatatttttttgttttatttattatttattttaataatttgatttttcaaaataatatttggaaattacttaaatcattaaaaacagcacttatgattgcagctgaaaattataaaacagaaatggtttaatattacttattgagcaaaaaggaattaatattaattttaaagatatttatttgttttatttaatacctattttaataattaaaaacttccaaaatcgtctttggaaaatattcaaattatttgaaacacatcttacaattgcatctaaacgaggtcatacaaaaataattaaaatgcttattaaacaaaaaaagattcaaaattaatttttcaaggagataatgctaatccaaaaatatttatttattttaataatttgatatttcaagcattacttcaaatggaatttcgaaataagcacattaatctacttcttaaaaaaggtgttgaatttcatgaataaacttttcaactaatctaaatttttataaaatcaaaaggttaacatgatatttttagggatttcaagcaataacattagcacgaaaattaaacgtattcgggctgccctgtaaattgatgaaccaagaacagataaatccaacatcaaatctcagattttctcgaagaaatagaacaacaccaaggctacttggtggatgggatacaacagaagaagagtataaagcattaagttttacgattggactccctccaggttattatattgaacctagtccagaaacagaaaaaatttcaacagcaatcgaatcattttggagagatatgataactggtccttcttcttgctctgatcattcactggttgacacgcgccaaaatactgttaatgtcattatctataaagatatattcacgaacgaacagcttgcagcaatccttgaaaaacaaatgcgggattgcattcctgaatatcctggaaatgggattgtttctgttaaaatccaatatccagataaaaaaaatgttaaaatcaaatttgccaacgaagaaatcatgcgaatgtttcgagaaaactatgatattattgaatttgatggatgtattcctattattaccagtttttattattcaggaaatgaaactcaattcattaattttggaagaactcttcgtacaaaccttactaatgtagttgttaatagtgacaaagacctaacacaatacaaagctcaatttcaatttgagattaatcgtcaacctaactcaccacttcaatttttagtttttaataccatcgaagatgccaaagactttgtgtttgccatgaaagatgaccttgattgttctcttcttaattttcctggtccgtctccaccatcaaaagcggtaattttaccctcaaatgcggttatgacgataaagaacgatacgcttcaactttcggatgttttaaatcaagacaaaattctcacgaaatttattgattccgaaatgatccctagtggtggccttaagactcttatattatataatataatacataagaatgtttataaagatgattcggtgtttcaaatggtttctaatgaattaattgaatttgcacaaaaattcggaaaagttgtttcaacaggtgtaaaactagaaaagaatagcaacgtaagatatattccgttttgtattcattttgattcctcgcgaagtgcaaaaatgtgtcaaacggaaattgcaggcaaaatatacttaggaagaatcgtaataacgcaactggccgaatgagcaatacgaaaatgttaataaataatattaaattatgagctgatgatatttttgaaaaaggtgttttacaaattataaagtgaatataataaacgtcgggaaaaaaaaggaaattgttaaatatttatcgataaagtttcttatgctttatttttaaagattatttgtttatgttgttgttttccttaagaaacaaaagatatctaatttaatgaaaacgtcttaacattgtaattttggatataacgcgaaaaaggtaagaatacatagagaagatatgtaatatcgaaattggaaccaatgatttttaattaaattttgttttatatgaaggaaaaggccacataaagatatattatattatttgatttattattaatacaaattataaattttagatttattgtctcctctaattaatgaagaaattgttcaaatgaattggataaaatgtgtttaatggagatctatagataaaattgaagaaaaagaatagaactgttcgtgtattcaaatgaaaatctaaacatttattcaatatacaattacaaagagatattcctcatatatttatataagttccgccatgtttaacgatttttacgaatcaaaaaattcaaaatcattttcattccctttgttgattattattttctcttcatgacaagataataaatataagaaaaaaattaataaaaattctatttaaaaaaaataaatatggatatattaaaaaaatttattaattttgttcgtttcgtccatagcccatataatttggaggtggttgtggtggataacctgcatattcttgttgttgatacattggtcgatatgcattatatggcatttgttgttgctgttgatagccctgataatcgggctgacttccgtaatttggttgatattcattataaggtggatatccttgtggtggataattaggcggataattgtttggaggatagttttgttgaaaatcattgtacataggatattgagaatacatttgtgtttgtgtctgatctgcattttggtaatcataaaattgaccttgcatggcttgatttcgatatgaacctgtatttggatgcttttgttgtctgttattctgaggaagctcgagctttcctgatcgtatgtctttgtagcgatcttctaaaatccttggtatgtggaataaggcatatctgagttgaggattatcaattaactcatcatgcgcttgttgtgggtttgattgaacccattgttgtgcttctttcattatatctaatagtttatatatatccatttcttcaaggatttttaagatttgttcggagccactcattttggggatattgactatgtttgttagagaaaaaagtttgctcaagttatgcagaatatatatcaacaacatatagttaatgtcatgcctaatttttatgctcaatagtaagggaaaaatattgttttattgtctttaacaaaaaaaaaaaaaaatctgaaaagcaagagcttattaagaattattacttgtaaaatatgaacggtttctattgctatcgttatggggcatcccaatgtcacttttctttaaggtaaaatgacaagctacatcacatggaatataatattaatcatagatttcactaaaatagtataatattttttatcacatgtttatcaacatcatataatcctcgttatttaaaaaaaaaaatgccaaccaattttggaatgtaaaaatcaaatgttagatcatagtttaaacgtaacgttttatttgtatgtgttttaatcggtaacaatacaaaaagtttcaagtcacatgggcgaatgcgaaaactttacgttttgtgggataaatgtttcctttccatataaaactccatacccagcacaaagatcaataatggctaaatcaatgacagcattcactcaccaacaaaatgctttgcttgaatctccaactggtacaggtaaatcactatctttgcttgcatcagctctagcttaccaaaatcacataatagccacaacttcagaaagtgttaaaatatactatttaagtcgaactcatagccaactcaaacaagtagttaaagaaatcaagaagcttccttacagaccacaaataggaattcttgcatctcgtaagcgcacatgtatttttgatcaagtccgtaattcaaaaaacattgattcaaattgcatcgctgaacgtcacaattgtcctttctcaaaaaacaacaatgttatacccgacgaatttttacaccaagtttatgacattgaagatttagtaaattattgtgttgataataatcgttgtccatatctcatcactcgcgaaataattaagcaatcagatcttatattatgcccctacaattacattcttgacccttcaatcatggctcgtcttcatcttgatatttttggttcgattcttatcattgatgaagcgcataatattgaaaattcgtgtcgtgattccatgaatgtaaagctatcgcttcatcaattcaaggaagcaagacaagaagcagccctggcaaccacaaccaacgctgaagagggaacttggctatttaacatgcaaccgcatctgcagaacgttaacgattttctgtaccatttaattgaatggtttacaacacgtaaacagtttcgggagaacgacaacgaattcatacccgaaaaggatgtcaacacgactttaggctcatggcatctaagttcaaagacttgggtaactattagcgagagcttaaaagttcttttgacgccagacaaagaaaccggaagtcgcatgcctgataaatttgttcttccattacaaaaattatattatgtcctgaacgagatgttcaaaaacaattcatcacaaatgagaaagttccatatcttatacaaatatgggaaggatgagaagaacgaacttatgatgatcttatgtatggatccttccattgtcttttctccaattgcaaatatggcgcattcagtaattcttgcgtcaggaactttaagcccattaaactcattctcgtcagaactcggcgtagatttcgaaatcaaactctctgctcaacacatcattgaccagtcacaagttgccgcatttacaattccttcatatgaaggtgttcaattaacatcatcttacaagtcattgaaaagtaactttgataaaatggcaaaagcattaggaacaataacaataaagttaatgagagtgattccagacggagttttgttctttgttccatctcatcactttttgaatgagctcatagaaaaatggaaaagcacaaaagtgtatcaaaaaattaacgatataaaaccgatttttgtggaagatcaaagtaacgatagcgacatgttaattgaaaaatataaagagtctatcgaatacggtttgggcggtttgatgattggggtatgtagaggaaaaatgagtgaaggtatcgattttgctgattcgcaagcaagagctgtcttaatgttcggaataccatatccaaattataacgatattaatattcaactcaagatgaattataatgataaacattcaagcgctttcacaaataacgtaaggcaattgatgaacggaaatgaatggtatgatgcacaagcttttaggtccttgttccaggcaattggaagatgtattcgacataaaaatgattacggagcaatcatcctaatggacgaacgtttccagaaacaattaaactgcttcccgaactgggtccaaaagagctataacaaggcgcagaacattgacgcaattgtcaacaatctttccatcttctataaccacatgaaaacggtctttccacaagttttgcacacagcgctcaacttcaggttccctctgtcgattgtttgtctcggctgtgatgccgatttgttgaacttgtacaaattcgaacaagtatcattcatgaaaatcgatcgaaaaggatttatgggccttatgaacattgaagagagctcaaatgaatgtgcgtttgtccctaaggaagctgtgaaagcttcgacgatttcatttgatgattcatattggtcaccagatgatgagatctgttataaaaaagctttgtgctccaactgtggagccgaggttggcgtattagtgtttgcaacgcctttaaaagatatgaaattttgtgatggattttggattctcacagaaagggcagcaatacgccaagggaacagctacgtgaagatgaatgagcttgcagcagctattgaggagaagaaatgattttgtggcgaactcaagtttgaattaattttgatcgttattatttgaaaaatttttagttaaaattgtctttactttcttaaactcaattattccttctttgtagatcatgtgctgcttgtaagtgcataacaaattatgacatcttataaattttcgcaattcttttattggtgaatttacattcttttttttttcatttttcttcgataggtaacagcttctttttcctttaaaagttcatagtatttttagctaatattttcaaatagtttgttgaatccgatgcaaggtgttatggcagttatcagtgataacttatcacactaattggtgcacagaaaattgtttgcgtttttcactgcttctattatttcattagaaatatatctggttcttttaaattcattaggggaatcaatggaataaacaataacaaacacaccgtcattacaaaaactagaaactataaatgtaccatatcttcccaatccattggaatcccaaatatccagaataattaaacatgtttaattactttctaccatagcgtgtacaaccaagtgaatgttctggatttgaacaatatctttcaaaataaaatctgatgatagtagtttcctcaacatgttaatacgatatattaaactcaacttgcgattttactataaaacgttaaatgtcattgtggagagtcagtcccacctgttgtttttgctgctttccatggattaactgcagttgtttccgaagcaactatatttggacatagaagataattcaacaacaacgaatttgtgattaaatattgatttcaattttgaggcacaatttatgcataaaaatcagataaacagaaaaacacttaaatttttttgatattgcttttcattgtaacaccacatgttcaacacagtgaatggtatcactgatgaagcatataatgataataaatattattttaacgagtttcttctaaaagaatataaacaaatttattttactgaaagacgtgtaatttcataaattgataaaaataaatttaatgtcacactattggtttacatattatttaattcgggatattttgtactacttggcattgaccagattttttcagaatagtttcgaaatcgtcaacgaccgatccgacctgtgcatcagtgtcatggtacttacatccgagaatgatttttttctcatccaacacatccctcaaaggcgcaggaaacattatagctaatttatctgattttataattgttatatcgaaatttgcattgcaaatatatattttatcattttcaccttcggctgataaaaaactcctaaacaattcacgatgagttttaatctcattttcagtggttgctatacttatagatccatcttgaaatggaatagactcgaaaatgttcagcaaacgcgagtacatcaaactttcggtttggtctgaaaaagtttcgggcaaaaagtgctgcgcgaaaagatattttttggagctaataaaattggaatgattaaatagaatggcactattgttgtttctatcaacagggaattgggatgtggggctaagaagaaattcccattgatctatggtatgtgtttgtgggaataaatgatttggaatccatcgatatttttgaacaatggacggtccattacttggacgttcccaaaagagttcaaatagcatagaaaggtcttttgcaattgggtcacaattggaaaattttgcaagatatgataatgaattgccggatttaatattaaaaaaggctgatggaaaatatgaactgcggtcatcagcaactgcaaaattaacatgtaattcgtaacgggaatctgtgaaataacgaacagaaacaccaggcggtaaagttaaggatttactgttggtataaacacgaactgtcacaccacgatgaattgtttcattaagaatattgaaccattggacgggagtagatgtaaaattatctggtaaagatataacaatgtcaatattgttttgaacagaccctataaatgtactaaataattcaatcgttcttgatgatgataaaaatatatttgcttgcggtgcgtcacacttatcatcaatttcatattttttctctttctgaagaaatatcataagggccaccatcacgagactgatgaaaagtaatattgcttcaaatatatcgaaaaaagataatttcttaagaaatcttaaaactttgttcattttgaattgggatgccccgttttcggttgtagaaaatcatcttcaaattcattaaaagctttgttaataatattattgaagacaaatatgtttacattaattcaacattacgcgtttatattttacgaaaagtatgacttgtttcacaaattttcaatttttaaaaataaatttatagctttatttttgtttaattccaattcaatcaatacaattaagcaagcaaatttaagcaattctaaaagtcatagaagaaatttttttatttcttaatttatgcaatcaaaccaatattaagaagcatgttttcaaacctaatgtgttgatacttctccatgaatatgagtgcatatctgaggcgatcaaatttaacaaatccaaatcttttgaatccaacttcatctcgaggaactacaacacgaacgaagtaattgcatgcattatccttcaagaattcttctagcttgtatttatcaacaccttctggcaaattatcaacacgaacggtgaataagtcgtcgtgataagaaaatgggttgactgtagtaattggttcatcaacccatttagtcttatcttgaatcaatccactttctgccattgctttttgaacttgactttgccaactttgattatcaaattgtttcttgatcaaatcatcaattgttaattcctttccgctctcgacgttactagttgggattaaatgaaggtttactttagctggaactgaatctggaaattggtttgttgtaaattctggattttttagtctttcattaatttcgttaggtatagacacactcaaagtgtgtgtctttgtatcatatttttgaatgaaaggagcaagtattggaagaggcaattgttcggccatgttgatttggaataaccgtttattccattgtcgaccgtttacgcttttttttttttggtcgtgcaactttttgaattgatttctgaagattaagattttacgtctcgaacaaccgattcggcacaatgaatggatcagggccgatgcttggcccatatgcactcattgggaaattgggccaaggaacaagtgggcaagttagacttgcagttaatgtagaaactaaacaaaaagttgcaattaagattattaacaaagaaattttcgcatcaaagccaaatttacaagtaaaagttcagagagaaattgcattgatgaatcttgcagatcacccacatttgttaaaactactagacgttttggaatctcctcgacatctttacattgtcgttgaatacgcagctaaaggtgaattattcaactttttagtagaacacaagtcgcttgatgaaggaatggcaatgaaatttttcagacaaatcatttatggattagaataccttcactctcttggaatttgccaccgagacttaaaaccagaaaatattcttttagatgaaaatctaaacataaaaattgctgatttcggttttgccagatttgtgaaatatagcattgccgaaacatcatgtggttcaccacattatgcagcaccagaagtcattgcaggtcatccatatgatggacgaatggctgatgtctggagttgtggtgtaattttatatgcattattagcagtatgtttttccaagtgccagcaaaattgcggcgcttgtattcaggattctaacacatagggttatcttccatttgatgataagtccattcgtggtcttctcaccaaagttaaaagaggtgtatatcaaatgcctaatttctcggaaccagccaaagactttatttcgaagatcctcgtccttgacccatctaagcgccttacgattcctggcatgaagatgcatccatttttcagaattaacctcccatcggagtacgttatcccgacaccgttaccgattccgtcacttttggcgccgatagacctgtcgacggttaatcccggggttcttgatgtgcttcgaaaaatcggctgttccaatgatgaagagctttttgcagatctcacatctaaccagcacactatggctaaagttttttgttatatgcttgcatcaaaactctcattagaacaaatagattggagtcaatctatgagtaactcatttaacgcacagacagaaaacgaagatgtttatactttaaatgcattgaactcatattctggatcgtataatgatccatttcaattccaaaaccaatcagtcgattttgcaacatcagtggcacatagagcagattgggttcttggatcgtcagaagaacaagttgaagacatacaaaagttcagcattattgcaaatatgtcacgcgtttatgctcttttagcaatgcaaagattaatgcgccagcttgacatgcagtggttccactcagatgattttgtgataattgcgcgaagagagcccacgtacatcctcatccgctgtattgacatggatgatgaaaaagtgacagtttacattcagtgcattaacggtcccggcgaattcttctctcacatttgtcatgcggcagatgatattattaaccagatgaatatgagcaattggtattgcaattaaagtagacttttttattcatttgatttttgatgttttaaaaattttctaattaattttcatttttataaatgatttgattacttatgttcattaatgcatttgctttgtctttataaaaatgtgaatatatcaaaataaaatgctttaaaaatatataatagtaaattatcacatagttacacatgtactttcgctaagtgatacaccctatattacatgtttttacttgaatcatccatctgttttttttacatgtttatttatttttacaagcaatactttcattttattctcaacttttatctctgataatagctatttgaactaatggaaaagtgacaatcagacccattgcattcaatttcagcgaaattattcagagaaaatggcggctaaatctcaaataaccgtttacaccgccatttggccttttgactttttgaacaaattttgatcgccattcgatgggaaacaaaagatccggaaggcgcagcattgttgcacctcctctttcccgagctaagagcataccaacacgttggctttcgtgcccagaatttggccaaccgataacaattccacaaaatactaatctaatatttataccaatgaagacaccactacctgaatcatattctgaagcacttggtcccaggtacgaatggactgtaccaaaagctattgaaaaagtccaatcacttgtttcaccaccaaatccacattttcatgcaatcaatgtatcacataaaaacgaaataatcacagaagatgattggtccgcacataatatcacatattcaagggtttcaatttctaaagagtataaaccagaatctattgatgttttttgccaaatcattggtgataaactaaacgaaactaccgacggaactcttttatgtttactttattgcgggtcaggtcttaatcgcattggattttgcctatcagccatccttacaaaagaatatggtttttctttaaaagactctctacaaatttgtgatgaatcatcacctcgcttaatctataagcaaaggcctttagatgttttgtgtgaatattttcgagagggaattatttctcatgggccagcaccagaatgggtcaaaacagacaccagacctggtcctattggagacattcctttacctcttgaaaagttcaatactctttcgaaaatttccaagaaaaatttcactcttgatgaaaaatatgaagttttgaaaattcttgcatccgcaaccactgtaaattggcttaaaacaagtgagtcattccccgttatgaacacaacagtttggaacccacagagtcttatcgagattcaaacgaacgttcatttgtgcacttttgagccaagaggagaacgtttatttttgatcgtaaccggagattcaaatgtttacgtcgtcgaaccgtcgatgattgtcactccgatacgtgtcagatccaaatgtgaagttcccgcagtcgttagttgtgttctcattgaggaaaagaagagccgtcctgtgtttcttttgactgacattcttctctatgggtctcttcaaacgtataagcttccattaaaagatcgtctttcatatttagcaaacgaatttgcattggacacctctgatataaaagattcaggcgtacaattcatatttaggcctatggctgaggtgtctaacgcgtctaagcttaggagagacttgaactcgttgttcgttaagtctgatggcatttctttcttcaattgtcacgaggaagctggaaagtcactttttctgccgataaagccgtcatttgtctttcaatttgtttacaacggaaacgatagggcggttttgtacgctagaaataatattccaataggaatttataaggcaccaaattcgaagtataatggaatggatgatagaacaaatagattcattttcgatattgataaaaatgaatggttgccgataaccgttggaaataacaatttgccatcgacgatagaggaggttagagcggttttgacattccaacaaaataataacagcgcaatgatagataaaatattctctcaacttgataagatatcatatgaataataaataaacgaatttactgtaattctttgattttttgtgatataatgaaattactttataacaaaatttggagttttatatcaatcgaaatcgctcactgtgttcttacaatattaccattaatgaataatcaaatctaacaacaaaatagtttaatagcaaaacttgctgaagtcatcttcataacaaaatttggagtttaatataaaagaagtcgctcattatgttcttacaatatgaatattaatgaataatcaaatctaacaacgcaacaatttaatagcaaaacttgctgaagtcatcttcacaacaaaatttggagtttaatataaaagaaggcgctcattatgttcactcatattcaaatcgcacagcagttcaacattttcaacattttcttaattcttcatcaaacataatctgaatcataaatttattcaaaatatttattttttatttctcattttcctcttgttcgcctctgccctcttcttcatctcctcctgcctgtgcttcatgatcatgtccgcctgcagcttcacgttctgcttgaacatttccctcagcccgaactcgtgcctttcctccggcagcacgtcgtcgttgttccgcttgtagtgcgcgatcccgttcagcacgtcggcggcgaccaatcctttgcatttgtgcttgttgccgaaggtgaaaacagtcaaacagattttctcagccacaaaagacaaaacgaagtcgaacaatgtcacaatgaccattttgttacgaaactcagaagttgggaacggaacaagctcaagaaattgctgcacaagttcattgttattcaaaagcatcacaacaacaaaaatgatggaaaatattatactaaatgataaaatgcgattttcaaaaaatgcttccataaatggtttcccgcgataatttgtgatgaacgctgagatctgcatctcacaggtggctataaagatggctgtgttcattagacttggatggaatttaactttataatcaaatgcttcattagtataacctgtatcaaataccattcgcttaataaagataatacagattaaatgaatagcaaattgtaataaaactgatgtgactaaatataaattaaattgggattcaaacggtcgctcggagcttaacgtgcgaagaggcttggcgaacgttacggctatcgtggcaaacgatagggctaacgagaaaattgtcatttgacgatcaccaaatttaacgttctctataaacaaaactgacacagtataagccgatatcatacaattcaatgaaagttgtttgaaaagatctatcgtagatgatagggtggcccgaccaaacctgataatgtcaatacaagcactaattgtggctcgcttagaaacaaatggtgctgcaatagaagcagcgcccaacttaggcttgtactcagtttcatttaataagtcaggatcatcaatataattttcaacaaggccaataccaacatcagcttgttttaatgcaccaacatcattagtgccatcaccacacatcaaagttttgattcccatttctttcattttaatcaatatatttgcttttgattgtggagacattcttgcaaatatgttacattctctaataactttctttagctcttcttctgacttaattttatttaatcctttttcagtataacaaattgaataattatccagattttcatcaggcttaacctcattaccaaactcatcatgaattatttcatcataaatcaatggtggttttgtaattatatgaattcttgatgcaacattacatgctgttaatgggtcatcaccagtaattataaccactcgatgtgtagaacgtaataattcaacaattgtatcttctgttccacgttttaatggtgatgaaaacaccgaaaatccggcgaacgttaagtccttttcaacttcttcacgagtgacttcactgtcaaagttaccgttaattcgtttatatgctaatgcgagtactctgcatccttgtttagtgtagttacgatatgtttcatagtatttatttggtacttctgtaagaagttgtgctatagcttcaggagctccttttgttaagacataagtttttgttgaattatttgttgttatgttagttattgttgacatacgtcttaattctgatgagaaatgaaatgttttcttattgactatgattgaattacgaaatcgtatttttccatcagaattcattttgaatgaaagtgacttaaatgctgctgattcaagtgaatcaccaattaattggccttcttgaccaaccactaatgaatgacatgatcctataacatataatgattcttgtgataagtcatttaaacggtttttgaggttccctttaatttctttttgagagctatcggcagcgtcactttttgtcatatcgtcaacgcccataaacttgtattcttctaatgttaaagtacctgttttatcaaaacaacacacggagatagatcctgcatatggtatacgaaatggttctgtacaaaaaactgaaagttttgataatgctaataatgaactattcacagataatgtaagttccattggtaaatcaggtggtatagtagatgtaataattagtaatacttctactataatcctaaatgtactaattgttgtgcttttgattccataataaatgacataaattgaggccataaccgcaaaaaccgtcaaaaacatcaaaagttgaatggaacctttcgactcgactgcaattcgttgtgaagcaaataaaatcgtacgtattaatttgccttgtgcactaccaagacctgtagataatacataagcaatacaaccttgatcggctttgtaaattacattatctcctggtaaaatttgttcgattcttgttcctgcaaatactatatgacgcttatctgtgttgagatttaatggtcgattgtttgggagattagatattgagattttagcttgtggtgtagattcaccagtaagcattgcttcattaacaacacatctaccagataaaacagccatgtcggctggacattgtattccaggcgtcttaaggaatacaatgtcccctggtacaagtttgaagctgcttatgattttccattcaccatctcggtaaacggtcaccttgatgggttttgtttcgactcctcgaagttcgagaagattagattgtcgagtacggactgtattagcttctacaaggataagtgataaaagagatacaagtgggaaagtgaaatattcatcaaacatccaacaaatattggaaaatatttgaaatacaaaaaatggtgcaagaatatgttctttaagaagttctttgaaagatggcattggaatttgataagaattagggccataatattcaagtcgttttttggattctgatgttgttaatccttttgatgtaagatatgtttgaattatttcattaacaggataagtaagtggcttaaagtcattgttaacaaattctaattttttttgttggaatattgcatatggtgtatctgtgttacgaattaattcaacaatatcaggacttccacgatgtttaggataaaataaaacatgcgtggcatgttgtggatctgattttttataagcaaaaacttttttgaatgttattgaccaatgagaaattaataaaattaatatatgaaaagaagcgactataaatggtaaaacaaccttgaatgtatggggttcaagttgtggtacatcaagatgatcaacaataaatgcaaaagttccatttgatggttcaccaacaatttctggaacccaattttgttttaaaagaataaatgatggaactattgtaagaggatacaagatcaaaaagaataatgtatcgaaacgttcccatctttggcgtttggacaaaagctcgaacctcatttttcgtttgaccaactttgctcgaataaattcaatgttgtaaatggcctcatagaatattttgaaataggatcttttctcaaattttgaaaaagccgttatgacttgtgtagaccgtttatttgggatttaagaagctttgtctgaacacttcatatgtctgagctaccccataaaattacttttggtccagttgataaatcaagcataggtcttttaaaaataatacatagagagttgctaccaattcattattcagatgacatttatgaaataatcaaacaaaatcttggagtcaaaggtattcttgcttattataatgatgacacagccgtaggagaaatttgttaccgaaaagaaaacgttgatggtgttaaaaaattatacataatgacaattggtgttcttccaacttatcaaagacaagggatagcaacaatgttaattaataaggcattagaagatgcgaaagaagaaactgaagtttatttacatgttcttgttgataatgaagttgcaattaagttttacacaaaacttggattcaccaaagtcaccaaagtcgaaggctattacaaatctcttcaaggcagcgatgcgtatttatttaggaaagaaatcactaaataaaatttgataaatttggaaattgtttactccaaaattttaacctaatttcttttcattgttctaagtgaaagtattattcgcaatttttttgtgctacttaatgaataaattaatttgatcagaaagcactttttctgaagtttatttacattttgacaggacgatacgaaatatattttttttatattttttctcctaaaaattcttctaatacacctttataaattgaaaatacgtctgttagagattgatataatgattgagtgaaaaactggaaatagaaatctctaaagaaaatgaatctcgaatacatttgcttatgtgcgaagcaaatgaacaaagttcttccgattggaaacagttcttcagaaccgattacgtcatttgggaaagcaacaacaaaatctgctttaattttatcgaccacgtctattaatttatcaccaaacgaatatgggtctcctctactgaacgcgtttttaataaagaaatactgattttcatcattcaaataatttgtaatgaatgaattgtatttagttttacgtctaaagacatcttcttccaaaagtttattaatgtaataacttctgtcattagctttaatgttattataaacaatttcatcttttgctgaagattcggaagatttatagaagtaaaacttatcataagtaaataactgtgttagataaacatgacaaatgatttcgtaacatttaacattattattatattcgtcaatgataccttctttaacgaaactgttgttatttttaacatattcaattaattgatcatattccactttaattaaatttggatttgaaattatttcttcgaatttatgaacatttacatgcttataataatattgtttaatggtgaaattaactaatgatatgtttgcaattaaatatgtttgatttaagatatgcttgacattaaattcaagttctttaagcctttcgatcattggcgtaaatccacttaatttaataatttctgttttgtcatcttctgtaatagaatcaaacaatgaagtaagcgtttcttcagagcgtgacttaatataattatatattcgtgacgctaataagtttcgtgaattaagaccttcaagtggtccattttttgcaagttttaaaagataatctttaggtttaattcgattaggacataatggtaaaaagtcaacggactttaaaaagtcatagatttcttgtttgataagttgattagatgacttacgtaataaatttttttttgatgaaagtttcttttcccagaaaacggttttgaattcaatttcatccatcccgataaacggttcccgatactccaaaagtgccgccgtatcgtagttggataaaactgtcggttggaaaagtgacggaacttcttctcttgatgttccgtttatatattttattgatgatttgtccgaaatatcacaaaagcactgacataacctgccattaaagttattagtgccaaataaattgtttaaaaacctataaaagaatttctttggtgtttgataaggttcaattattccaagaatttggagaaaagaaatatcttttttggatggatataacgcatacttaataaaagattcttgaaaacaaatgttcatattgccgccaagttcaacttcaagaagaagaatatgatatatataaacaggaaaaatttctgcatatttataacataaatctaaaattgattgttggacatcttgaatattaccatcaaatttgccaatggataaaataggagataatattggacaaaaggtggtataaataaagcgaataaataaaggagaaaaaaatgctgatctgtaatataaaaatctgattgtgttgtttttgacgcgactaaggttatcacaaaaggctctgttaccaaagtcagtccaaaaataatgaacataagaaggccaaatggaaaatgtgaaaatgtcaattggttcaatttgttcaataatacagttgatattgtcaagagacaccactttcattgaattctctttaaataattcttcaattgtagtgttaggactttcttttaaattatacaatgactcaattgcaacttccggcaatgaagtgttcataataatagatgtatatagaatgtaaaggagtgtaaaatatttcttttgcgataaaatttttactatattttcatctttgagttttttatattgtgcttcacaaaaaagaaattcaaattcttgcatgaactcttctgaatctattttatctttgcatgcttgtaagagttcagataatttccttgaactgatttggcattccatgtttaaaacggagtgccctaaaatatttcaaatatcggcattttttagataactttttaatctcaatttaatcggacaaaaatactctttataaaatgtataatctcacgagactacaaatattttatagacagataataagaatctcccgcatacattaacaaattcaccttgacaaggttataatcagaaaaaaatatgaaaacatattttattcctgtcattcaattacaaattaaaaaacatttggtttgcactttattgttattgcatcggtgatccagtcttttttgataaaaatgtgaaacatatacatgtatgctcatgaataaatagatggagtcaaccaacgatccctcttataattaacaaataaacttatttactagcacacaatatttttgttttctgttaaagttttaataattttatttactctcaatgagttcatttttaaaatttcttttcgtttgctttgctcatcaaacaacgcgaagcttattcttttataattccgattctaaatattcaattgaaattgtgaaattattagcggaaatgaatttatgataatatgtatttcttgattaaatcagtacgaaaataatggcaaattattagtttatgtatacttaatccagttaataaaaaaaaccgcggccgtttagagtagtgctccccaaaacttgcattcaaaattcgatacgtcattaacctatcattgttaattgtgaatagaagtgaactttttgagcgtttttctttcataagtctagattaagaatattctttctctgttaaacatttgacattatatgtattgatgttgatttctttatttctccgatacgagctgattgagtgatttttattcgtacactcattcaaatttgactttgtacaacttgaacatgtaaaatggtcttcggcatataaataaatgcaaactttgataaattattagttttgctggtactgtcctacaacattcaaaaattggcactcaattcgttttcagaaaaaatattttgattcaatttcattttaaataatttacaatcttcgccatgttttttgaacaaaaataaaatttggcaaagatgctgaaacagatattatcaaatagcaagttatcgacattgcatacattatacattgcatcaattaaaattaattaaaaaaaaacaattattattcattaaactatattacgaatcaaaatattgtgaaatatttaatcgtctctgtattacaacacaaattttatattaatgttacattaaaattcatttttgacttaattaatattttatgaattgatcaataatatcaattgcttcgcatataaatttttatgaattgtcatgttctacatgattaatcatgttatattagtttaaaattttataaaatttaatctttacgacgatcatagcaattaaaatagaaagaaataaatatacgatgtaatgtggaggttgaatggaaataattacatcaattgctcattgaaataataatgtaaacattgatttgtaaactttttgaatataattaatcatgtgagcttcatttctgaaacaagaataagtttgaattcatctttaactacaccccatgttcactatgtattatctatatcaaatgaaagtcgttcaaattatatatatgccaaatcatatttgaatgatttgagcaaatgatggtacataaaatgatgaaaagaaacacatatatgtgagaataagcacatataagtgagaataaacatatataataaaaaattgatgaaaataaattagaattagcacatataagtgaaaatgaacataaaacaagaagaatcataaagcagaaaatgaaatattacaacattcattccacaccatctttgccgaattttattctcattcaaaaacatggcgaaaatcgtgtaatcatttaaaatgtgattggattataatattccgtcagatcacgaattgagagccaatttttgaatgcatatcacatttaattcaaattttccataatgattgaatcaggcttttactttttgataaggtattaaaatttcccacggttgtcgaatagtaccgttttgattttatatatacccatttttaccttttattcgtacaaacgatacgaaaattgaaagtttttcgatcgtaaatcaaaccgttacttttgtgtagaaaattattcaaaaaaatattttcacttcattttatatttgttatgacgttcttcttgttttcgaaactcgaaaacagttagttggggctcgaatcccaaatctcagtttgagatcgagaacgtttatgttcgataatttccaataatttcaaaaaatgtcgtttttaggaactcaaagtgcgacagtaattagctacaaaagattcacaattttgcgccaaagcagcgattatcacgaaattgtcgaattttatagaaatttttttcattaaaataattctatttttggctttttgcatatgagaatctgaaattttcatttgttgagctatatttatcgataaatatgatttctctaatttttaaattttttgtagtaattttttcatatttacatccaattgttgcgaaagatttaaataatgataaccttaaatttgcattaattattaaaaatattataaattttattttctctcatttttttttattgatttttttggcgccaaaatcacatcctttaatgatattcgacgaagaaccaactaacttttcaagataagcttaaattaatatttcagaaatatccgaaggaaaaaattttcaacatggatgaaacatgttggaaaatttcgaacaccccagcaaaagtatgacacaagattggagtgccaacggttaagatccaatcaatccaaaacgagaaattaactctgacggccatcgagacaaatacaatgcaaatgggtcaaagttgccgctttggatttttgccaaaggcaaaacgaataggtccgagaagaaatatgggaaatcaaacgaaaatttgattttcacccatactgaacgtggatgggctaatgatgatattctgatttcctatatagaatggattcataataaagccaatggtgaaccatgtgccttagtttgggacatttttcctgctcagtaagcagaaaatgttaagttgaaagctcaagagcttcaaattgagctattatttgttccagccgggggaacatcaagatatcaacctcttgatgttaaggtatttggggaacttaaatcaagagctcgataaaaatttgagcatttggcttttaagaatcaaacgagaaacataacatatcaagaatcaattgaaattcttgttgaatcatggctcagtatttctcgaaaaaatatcgaggaatcatgggaattaattaaacaatgaaaaattcaaaaaaatcacaaatgtgaagtcataagtttgatgtgttttttaaaattatgagcaattcatcagaaaaattcaactttttcagataaaatcatcgaattgatgcaataaacctttgaaaaaattatttttttttttacactattatttgcgaaagaatgaatgacaattattgtttacgcttcatctctcaattatcatgaatcctaaatcaaagaaaacatgaaccagaataaattatcaataacaatatgaaatcattgtctaattaagagaaaagatttaaacaaacatagtcaaataagtttccatgcaatttgtcactttttggtttttttaaaaattataattctattttcccagaaaccgagtgagtaaataaatgcaaaaatattaaaacccgtacaatacctataacattgtaataaaacgattctgatttcaatttgttatttgtcagaaaaaagtcgaaatgatcaatcactttttcacttttttgaagaatttcatattttcacaatatcaattgattgtgctcatgatgtagtttttaaaaaataattttcataaaaaatattattgtttgtgtgttgagttattcttaatttaaattgaataaaaaatacgttaaaaatatggatctgaatttaacatgatatttaacacagcaggcattagtatattctaacttttgaatattgttcaaaatgcatgtttctgtgcgcataatttttttttttatgatttttcaatattttcagtgacacatgacatctaatatcatttacaaaatatctgtctaattttttccaaattttatgcaaaaaaaacatagatattaactcagctataatacgacaaaaaacgaattcaattatttcagtatattttaatctgattttttggatttgtgagaaaatattcaatgcattcaattttgaatgcattcaatctcctgccgatcattttattcacaaataataacaaactatgtttgattcaaattatatcgtgtgtacgaataaaaaataaaaatatgtatttcaattttttaatttcttcttcattatattttggatttcgttagattttgtatattctcattattcaaacaatatcatttaatttagagattaaaaattgaaaaaaaaaataaaataattcgtgtaaatatcataaaattataatatcataattatactaaatttattatgaatagcttttatataaaatttcatatggaaattttttattatcttattattttacatcatttaaaaatatttcactgataattcaagtacttcagggatacttgttttctgtcacttttcaataaaaacattacgttttcagctttgtaaacagcttccgatcgcaaatacaacaaaacatgcatcaacaaaagttaaaccaatgaactgactaaaacgcggcgcggttgaaactctctgtatcgtttttgactgatttattagcaagtttcccaagttttcgcgcaaatgtgttctttctttctggctttacccatgtgtttcttttgctcattacaaacctctccaaaaaattcaggttcaaagatttttagtgatcaattatctatttctcaaaaactcaaacattctccttatttcactttagaatccaaagggcatacatatttacctatttcagcccataacaaggagtgtgtatccattaaattcacaaaatttattatgctaaaaatgaatgaatcgaatacattcaatatcatcactgaagaatatcatcatcattcttctttattaaagttgccgatgtcatatgttaagcattatttcaaattcttttctttgacatttaatcatttttcattaaaagctcatttaccaatttcaatgaaaaataatttcatgaagaaaatgttcaaattcaatgaaaattctcaagttctaatgtataacttttttgttttgggtttttttttattttatgaaatcaaatttttaatgaataaattgaaagcaaacgaaaagaaaaaaactgaaaatattttaatttttgttatgtttttcatgagtacttatcaaatatataatgaagataatttaacacttacaatcataaattcaaatgaatttaatgaaatttctcaatataaaaatataacgaaatttataattatcagtgaaaatatttatgaaattccaagtggttcattttcagaatggtcttcagttgtttcagttgattttggtaactcagtcacaaatattgggggttctgtgttttcgtcatgttttaatttagaaacgattataattggaggaaatgttacaacaattggtgatggagcattttcaatgtgttcatcaatcaaaaacattacaattccaaattcagtttcagcaattggaaattatgcattttcatcatgttctaatttaactttattaacacttggatatggaataagaaaaattggagtttcagcatttgggaattgttatcaacttgaatgcatttattattatggagattcagaaccagaaattagtgaaaatgcattttataatgttttaacaagtgttatcacatatccaacatatgtagggagtaaatttggaaatttagatgttgccaaagaaaacacagaaggaacatgcgaaccacttccaacgcattcatttagtcaatcgaatacatttactgcatcattacaaagtgatatttcattttcattatcattttcatgtacattaacaattacattatcaattacacattcattaactatttatgaaacacaaacgaaaacattttcattatatataaataattcgacattttcatatattgaaacagaatttatttattacagttatacagttgttatttattcgacttattataattattattccaatttctttacaatgttttacacttccaatgaaaattcaccaaatggaattacgacaaatgctttgattggaattatttgcggatcatttgcatttgttttggtcattgttggaattgttatatttttagtgaaaagtaataacaagaaagaaaaatcgaaatcaaagttacaatttaaggacacgacaacgtcaagtacaaagcaaatcgaagaagtaaatagtttagttgaagatattgtgaaagaagatgaagacaattggctatgaataaaatgtgtaataataaacattttttgattcaatttttatataaaaattatgtgttgtcatattaaataaaatgaaatcatattaacgaaatatcatttttactttaaaatgttttgaattagtgtatttaaatatgtaattttggattttatgatttttaaatagtatcaataattttgaatactgattgtaaatacatttaatgttcaaaagcttttgaatgaaattggataaactttacttgaattcatcattctcaaaatcgaaaaatattttataaattaaagatacaatgtaattgatttcggacataaagaactccttatattttgtttatttcatataaaatcattaatattcaaacaagaaatagctgaattgccaacgttttaaaaaagtattaattttatgatgatggaaacatcttagataaatgaacggcacaccaaattaaagcataaattccgttctataacatatattcattgtgttatttaaaagtgaaaatataatgttttaaggctgtttctttgattgtcgttttgaaaaatcgatagaaatatttaaaaattggtttgaaaaacgacaataaaacaacaggtttttaaaagtttaaccgtgagattttaaacttttgagatagccgatgtataattggtgaaggtctatagatatattacaagctgaaacatgatgatctttcttttattcagcatttcgatcatgatgaaacgatttataaccgatacaaagcttattacaccttatatcattcaaaaagaaatattacaaatacaaaaccacgaaaacatgaaaagtatgacttacaaatgtgatggggatgtatcaataaatgaaattatgaacaaaaaatttaaaagatttcataataattataaagttttgataaacaaattatttttaaatttgataccatataatgaatctacaatagttgtacatcagaattttaataacaaacaaaaaattccaagaacatatttttcaaacattttgaaaaaatacttcgaatttgatatatttgtcaaaaatggtatatttgataaaacatacaacaaatcttatgaagatgtatatcctataaatcgtgaattttcacatttttttatgatgcgaaactacaacgaagaaggaccaaacattttgaatgttttacttcatttaaccatcattttttcaatgacattttcggttatttatatcaaattttatcagaaaaacacaatttcagttcagaaaatattaacgaccaaatatgcattgaaagtaaaagataagaaaaaaattgaaaatattttaatttttgttatgtttttcatgagtacttatcaaatatataatgaagataatttaacacttacaatcataaattcaaatgaatttaatgaaatttctcaatataaaaatataacgaaatttataattatcagtgaaaatatttatgaaattccaagtggttcattttcagaatggtcttcagttgtttcagttgattttggtaactcagtcacaaatattgggggttctgtgtttttcgtcatgttttaatttggatacgattataattgtaggaaatgttacaacaattggtgatggagcattttcaatgtgttcatcaatcaaaaacattacaattccaaattcagtttcagcaattggaaattatgcattttcatcatgttctaatttaactttattaacacttggatatggaataagaaaaattggagtttcagcatttgggaattgttatcaacttgaatgcatttattattatggagattcagaaccagaaattagtgaaaatgcattttataatgttttaacaagtgttatcacatatccaacatatgtagggagtaaatttggaaatttagatgttgccaaagaaaacacagaaggaacatgcgaaccacttccaacgcattcatttagtcaatcgaatacatttattcaatcaaatacatatgcacagtcagattcaataacattctcagaattatactcatttagtcaattgaatacattttctatttcgaatacatttactgcatcattacaaagtgatatttcattttcattatcattttcatatacattaacagttacattatcaattacacattcattaactatttatgaaacaaaaacgaaaacattttcattatatataaatcattcgacattttcatatattgaaacagaatttatttattacaattatacgattgttatatattcgacttattataattattattccaatttctttacaatgttttaccctaatgttaatgataatcaaaataacgataataaaacgacgattatcatcatttctgtttgtgtaatcgttatagtaatagtcattatcatattattaataatatttttgaaacatattcgaaataaaaaagaagaaatttatgaaaatgataaatcagaacaaaatgaaaacgaaacgactaatacatttactacaggaataagtaacataaatattgaagaagatccatttgctgaagattttcaagaagaaaaatttattgaacgaatataattttcaatattagatatttgtaaatctaatcataatactgttgaactattatcaatttttatcaaacatatatatctgaaatcaacacacaagaaacatattatttattagagaaaatgatagaacaaaacttaattgataaaaacattactagaaatatttattcagaatatttttcgcattacaaatcagaaaaagaaaacaaatatgcatataatgatgcattcgaaaaatcttttttttaaaattatgaggagctcagaaagaatgattgggaacttcttaaactattaattaaagatgaagctaatccaaatgaaagtacaaaaataattcgaaatgatgaaataggaaaacttcaagaaatagcatcacaaaaaaattttaattttaatcaaataattaaaccatcactttatgaaagatattcatttattaataaagaaaatgtatcatgaattggttatacaacatttttttcatcagttttaatgttttaaatatttacttatgaatagttctaatgttgataacgcaggtaaacatgaaattgcatgtgaaaatgaagaaatagttcatttatgtgaacaaaatcattcttcatttgaaaaatcatatgaaacagcaataaagttttatcaaaatgatatttttaaatatatttatgaaaataaattagaaaaaacacaaccaaattcaaaaaacaataaaatgttaggaaacaatgttaatgatttgtgtttttgttttagcattggaattataaaatattttgaagaagaaggaattaatgttaatgattcaacaagaaatggaaatttatgtctcgttaaatattttcttagaaataatctaattccaacgtgctccaattcttcaaagaaattaacccaagttataactgtattgacttgtcaagttttcactttttgtaaacatttaaaacaaaatacaaaaagtagaacgttaatgaaaaggtgtctgcaagtaaatgcagaacatttctcagttcttgacgatgaagggacccttgctctcacgagcaataataatttccaggtaatagatgttgagtctaacctcaaacaaacatttaatcttaataaatctatcaaattaattcaaagttcacaaaaccttacactcgggaccgatggtgcaacttatgtcatggacaacaaaagtaacctaacatcatatttatttcctattggctatgaaaattcaataccaacttcattttcatattcagcttcaaaatcacatttgtcaatttctgtggataacatagttttagtttacgatcttacaagaaaactggattcttctcttgttgccttattacaaggtcatgatgaaagagttgtaaaatgttcatttttaacatacccaggatatgagcacatgctagttacctgtggtgaagatagcagatttatagtttgggacttaaacaaaagatgtatatgttatgaatcaccatatgaatcttcattttcaattaaagcagtttcagtattttcttcaacgcattacttcgctttaacttttgaagatggctatgttcgactttatgatccttcaccaataataaatgggaaaccatcagtttcgtttgtcaaaatgatcaacgtttcaaaaattgaattggaagatttcgaagaagaggaagaacaaagcataataatttcaaaagttaaaccaatcaaacagccaaaaccatcaacagcaggtgtacttcctccctcaatcatttctgctgattctgcatcagttggtagccgtgaatatcttttatgtgctacttctaattcgatcattgcattaaatatcgccacatttgagaaatttgtagttacaacttttgacgaagaaatcactgagatatctttccatgggttagtagttgcatccaagtcatctttttccacgaaaattacaattcaaagaatttcgattggtttcatacctgaaattggtttaaaactatttcctgaagatcctccgcccgaaaattccattttaatgaccagtattcagcttaaaactaagcaaacaacgccaattgcaacattacacaagaacgttaaaagcagcggttatgccaaaaaaccgccatcatcccgctttaccaacaaaaaggttatcaagaaaccagtcatcaagaaaaatgttaatcctcaaccattggttacaaaatttagtccacacatgaatatgtcaaacacatttactccatttgaagtaccaatttatacagctgcactttctgcagatgggaaacgacttatttgtgcagacaataatggaacaattgtgtttgtaaaatcaaaatcaacaccagcatatattggccattcacaacttgttacatctctttcatggaatacaaaacatggattcctaagctcgtcgcttgataggactgttaagatatgggatattgataggccagatccacttcttaccatcaacaaaactaagagcgaaacgcggggcaccccattcaccgatgatgtcactttttcatcgtttttttggaacgataagtttatcgttctatcgtatggcaaaacggttgcattatatggttatcatcttccttctttatcaagtaatgcaaaagcaatttcagaaatgcaccaaactggaacttataagaatgtccattctaccaatatttcttctggtaaaatagtttctatgtctgcatctaatttaccttcgtcaccaattgttttggttgttaatagtgaaaaattaattaacgcaattgatttttatactgggcaaaaggttcttgacattcaatcacaacatgaacgacctgttcatacaataattggaaattatggagggatttatactccgcgaacatcatcaacgccagacctagcaatcacaggcgcatttgataacacagtaaagttatgggatttgagatctgcaagatgtgaaagaacatttgtcagtggatcaaaaacagtcaaagttggaatgtgtttttcgcctgattctaagtatgttgctgttggaactgatcgcatgggagtcgaaatttgggatgttaagcaaggtacagttattgagaaattgaaagagaatgtaagaggacatactgtaacatggctacaatggaatcctgcatcagggagattacaatgcggacttgaaaatggatcaataaaaatattttcatgagaaattgcgaaattgacaaattgaatgatttgctaatacaaacaaatcattaattttggacagcttaaaaacgcaacattctaattagaatgaaacttctttgtttaactttttgtttctgtttgcacttttacatatcctattcaaaataaaactcaagcaatgaatgaatggaaagctctccaatttgctgaaaaaataatttttgagttagatagcgagaaaattactcaatcaatacaagcgataattggaatttatgataaaaattatccctattcttttaatctaatcattagtcaaatgatatatttatcatttgtaaagcaaaaagatgattttgatacatatttaaatattattaaagaaattgaaacattagaagaaacaaataaaagttcttccaaaattttggatgttttcacacaatttctgcttcataaaaattcacaagaatcatattatcttcttgagactctcgttttacaaaatttaattgattcaagcgtcttaaagaataagaaagatccttattttgctcatcatatgtctaaaaaagatcttaataatttagctcgttatcaaatcgtaaagaaattcttcgaaaacattgatgagctttcaaaagatgattggaaacttcataaacaattaattcaagaaagaggcaacacatcaaatattacaaaagctattagaaatgataatattcaaatacttcaagaaatatcaacacaaaataatttcgatcttaataaaataattgaattatcactttatgaaataaattcttttgttgtgaataataaaattacattaattgattatgcagcattttttggatctgttaaatgttttaaatatttacttatgaatggtgcaaatgtaaataatacaggtaaatatgcaatcgcaggtggaaatgaagaaattattcatttatgtgaacaaaatcattctgtttttaaggattcatatgaaattgcaattgaatttcatcgaaatgatatctttaaatatgtttatgaaaataaaattgaagatattccaaaattagaagaacttggaaagaaatgtgttttatatcataactatgaaatatttacatttttacaagatgaaggaatgcaaattacttctgatattattaatgaatcagcaaaaattggaaatctttatctcattaaatattttttagaagataatcaaccttcgaaagatattttagttttttcatgtgaatctagaaatattgaagttgttcaatatgttttaacaaaagaaggaattgatgtaaatgctaaagatatttatttgttttatttgatatttattttaatattttgggatttcaaaataatatttggaaattatttaaattatttaatacagcacttatgaaagcatctgaaaaaggttatacagaaatagttaaattacttcttgaacaaaaaggaattgatattaatgctaaagatattcatatgttttatatagaatatattttaagaattttggatttcaaaataatatttggaaattatttaaattatttaatacagcacttattagagcatctgcaaatggtcagaccgaaatagttaaattacttcttgaacaaaaaggaattgatattaatgctaaaaatatttatttgctttatttagaatttattttaataaatcaatatttcaaaataatgattttttgttttcaaataatgtttggaaatgaatcaaattatttgatactgcaagtatttttgcaattcgaaatggacatagtgaaatactgaaattatttcttgaacaagaaggatttgatgttaatgcatgtgatttttatttattttaaatgatgtttcttaaaaaaattaaatattttaaaataaaatttggaaattattttaattgtttgagacattacttatgattgcagttgaaaataatcatattaatatagtaaaaatattactagaacaagaaaatattgatgtaaatatgtgtaatatttttaatgttttactaaagtttgtttaaataattttatgtttcaaaataatatatggaaattctttttattatttcaaacagcacttcattttgctcttaataatattgaaataatgaaattgcttcttaaacagaagggaattaatgttaatgtgcatgatatttattcatttcgcttcatattaatatcaataatatggaatatcaaacgaatatttggaaattatacaaattattcgaatcattacttatgctagcttcttatgataatgaaaacgtagatatagttaaattacttctcgatcatgaaggatttgatgttaaccttagtatttatttgttaaatttaatgtttttaaataatatttgcaaaatttacatattatttttgatggcacttaaaagagcttcatttagtaaaaaaattgttcaattgattcaaaataaaatacaagcttcaaaagaaaaatgagtaaatagacgtctcgtcattattattaaaattttttgaaaaatattattattttttttttctttttgaaaaaaatcgacttttgcttggtttacattgagggaccgtttatcgaattaagcattcaattaatttaacggtttggtcgacctttccaatgtctacagtagtcgcagctgaacacaagccaatcattaagaagaagaagacaaggttcaaccgtatccaatcagaccttttcgtccgcgttaagtcaagctggcgtcttacccgtggtattgattcaagattccgtaagaaccaacgtggaacacctgcacatccaaaatgtggttatggaagtgataaagaaacaaagtacatgcttccaaatggtttcagaccagttattgtacacaacgttaaagaacttgaaccattattcaccaataacacaaagtattgcgcagttattcaccacgctgttggaggaaagcttcgtcgtcagatcgaaaaggctgcacaagaaaagaacattttcgtttacaatgctggctgcaggatgaagaaggaagaacagtaaatcgcattgccttatgtttttttgttacgtgtacattgtctttatatgtttcattgtgggaaaaaaaaattattaaaatatcataaacggctgcttcggggcgtcccaatttttgaatatattgaaatttctgttgagaacgatcatgtgatgaaaagcttgaattgaacaccttttaactctaagcctaattccaaaataaaatacttataaatatatttgaaccagaaaaaaaattgcatccagaatttgaaaatttaatataaaataaattgatagaaaatatttaaagataattttaaacatttataaacagccgcattggcttcatccaaatgcactcgatgtaatgcaattcaagacaaatgttttgtcatgtgatatcaattccaatttttttcaacttctttatttctttttgtattttcaccatcgtcaccattttgtcttgttttaattggtccgaatcgcgtgtgtattgcgaaatcatgttttgaatgttatcgaattctttttgtgatgtgatgtgttcggaatcggtttccacagaatttttcaatgaaataattctctttttgagaaccgaaattttgttttttaatttttcttttttggaaattatttctttcaaatatccaattctatcacttaacaccatttcttcaaatgccaattttttcttattttcaatcatttcattttcttcttgaatattttttcgtaataataatttgatttcttgtaaatttgtattgtttccgtttcttcctttttcgatttttatttttaaaattttatggatttctctttgttcatttatatcatttttaagtttttcaatttcgtttaatttttcggatatttttgcgtccaaattcaaattcgtttcagcgctttcgcgtaatgcgatttcgaatctttttcgttgtctttcgattttcgttgaaccattaattaaagtaattttctcaagtcgttcgattgcgttttttaagtttttatttgtttcttgatatatatttaatgaatcgcgaatttgatttaatttaagttcaattaaatttttttcttttttctttttataatataaagaattgtttttactgttgtttttgattttatttgttatttcgtttacattcgcattcgtaagttttgtttgtattggaattgttcttttattaaacgatttttgttttgtggtcgaaagtgatacataaaatgattcaacaaaatcaaacgaaatgaaattttgttgcttttggttttttcgagtcattttaatgcgatttccaagaaattgtatctcgttgttgattttcttgagttttttcttcgcttctttaatcatttgttcaatttcagattctttgaattgctttagtgaattgacatttaagtctttttgttgctttttcccaagcgtttcaacattaatgtataagtttttggtaaattcggtcttataaaaacttgtaattggttccgttgataaatcttgttgatcattattagtttttttatcatttaatgaaggtaaaatagaacttgttgttggtttgattatatttgctattttgggtttgaaatcaactgaagattttgcatgtgtaagtataggtcttataaaagtgtcactgtcggttttgtcatctatcgttaattttaacggtttccgtgcgctaacggtcgttttgctgaagaattcttctttcgaatgtttgcggatgatgttgacgagtttatcaagttcagcattgttgtcaccttgatcggaaacatctaatttgaaagagattgttttggaactatttgaggttccaattgtcactgaatcagaatttttggaatataattttttcgatttgcttttacgtttttcattttctttgcgcttttttctttctgagttatctgcgcgttcgctgcttattgatttttcgccataactttggtattcttcgttctcatttctatggggttttctattattatataaaattgcttcgcttattctttttggttttcggctattacttttgagttcttcactctctgattcttcttctttgatgcttttggatttgtttttcattatttgttgttcttcgctctctgattcactttcttcttcgttttcatttctatggggttttctattattatatattattgcttcacttcttcgttttggttttcggctattgctttgacgctcttcaatatctgattcttcttctttgcttacgatttttactttgttttttgttttgcgatgttttcgcttttctgatttatcagtgtattcattatgtattgatttttcaccataactttggtattcttcgctctctgattcactttcttcttcgctttcctttctatggcgttttctactgttatataaagttgcttcgcttcttctttttggttttcggctattgatttgacgctcttcaatatctgattcatattctttgatgcttttggatttgtttttcgttttttgttgttcgtcgttctctgaatcgctttcttcttcgttttctcttcttttatgctttttgcctttggatgatactacttcacttcttcttttttgtttttgttgttcttcgctctctgattcatcttcttctttgcttacgttttttgctttatttttcgttttgtgatgttttctcctttctgatttatcatcactttggtattcttcgctctcccattcatcttcttctttgcttacgatttttgcttcatttttcgttttgtgatgttttctcctttctgatttattagtgtgttcattatgcattgatttttcatcatcgctttggtattcttcgctctctgattcattctcttctaaacttatgtttttgaatttgctttgctttctttggcgctttttgctacaagacgatattacttcgcttcttctctttgctttttcatcaccaatttgctgttcttcgctctctggttcactttcttctaaatttatgcctttggatttattttgctttctttggggttttgtacaattagaaagtattaactcgcttctttctgattcattttcgtcaatgcttctgcttcttacatgacttttattatttaatacctcttcacttccttctaatttttcttcattttctgattcattcgaataatcgcttttgcattttggtttgcttttctttttagatagtgttttttcgtttttttctgctttttgtctgttatttcggtattttccgccttttgatttcgtgctatatccgcttcttctgcttggctcttcactacttttttgatattcttcactttctgatgcattggaattattgcgatgactttgatactcatcatttttatattttgtttcatttttctgattaaattgttcactttcggatttatttgtttctttgttattacgcgtcgctttatttggtgaattttctcttatttcatatttcatgcttctgttctcgttattatttgtctgatattcattttctgattcatcttttccattttctccattattcacttgatgaagtttttcattatttttattttttgaagaaatattattataattatattgtcgactttctttctctttgtaagttatgttttcattattttttcgtttttcattttgctccaatttagaatttgtttcttttgttatagatttttggttttctgtttcattattattattattggataaatctaaaaaatcctttttgcctttagaaaaggtatttttccttgtttgcaaaatgtttaaatctttttccttttcttgtttattttgattgtcactttccttcactttttgaatgctttctgatcggtctgttaaacttcttgttttctctgtaggaaaatcagataatttaccagttgaatctgcaaaaattccattgggagttgagcttaagtttgaagaatttaatgaatatttttctgagaattcaatagaatttctttcacaaaatgaacttaaagaaatggctgacaatacgctcgacccaaaagttaaagttgatgggaatgctgatagagcataatcttgaaaaatttcttcaagatttgaaaagattggaagtgctgattgaagttgaccgtttaattcattgaaaaattgatcgtcatcaacagaattattgaattgagatttaatcagaacaattttcgccattttgctttgtaatgaagcaatttgttcttgaatatgtggcggaattttgtatttagaaaaatccatctcttgaagatatttgatggcttctttctttaactctttattcatattaacaagttcatttttaagagagtttaacatagtaatttgacttattatctcttcttccgaatttaatttttctttataagtcgacgaataagactttatatcttcaagattaatttggagcttttcaatttcagattggattcttttgagagctactccacgtgttttctttaataagcttcctgaatatttttggagtcttttagtagctgcttgtttttcttttattgcatccatttttaatttctcaaaatttattaaatccttttgaattgaatctaagtaatcacgcttttcaatgatttctctttgcaaactttcatttgattgaataatactttcaatagaattcattaattgttcgattgaatacaacaattccttattttgacattgagctttatgtagctttttaagagtgaacatgatgaaggctttttaatgaaattcacgttttcttattttcggtgtgattgaaaacgtatttttctaattagcagcttaacggtcaaaaatctttttcagatcacatgacatatgctttatcgtagtgaaaatgccatttatattctctgaaatattcgtgtcattcattcaatttcgaagataaaagtgtcgcttatttcaatcaaaagtggtcacttctgtttgtgaggtcttttttgaggggtatgtttgccccgtaacggttgtttttttgaaattcagaccataaccgttgtgctcggccttatttggtgaatcatattttagatgtctaaatctgggaaaaaacaagcttctcaaagtgccgatttgacattcagtgcaagcaagtcaaacttctctgaatggtatgaagagctcatggcaacagctggtattgttgacacaaaacattgggatgttaaaggaatgccaatcttccttccttatggctactcaatgcataaagctatcatgagccttttcgaagaagagtacaaaaaaattggtataaaacaatgtcaatttccagcatttattccaaaatcattcttaactcgtgaagcagaacatgttaaaggttttgaaaaagaatgcttctggcatgaagataaaatgtgtcttcgtccaacttctgaaacagcaatgtattcaatgtttcatttatgggttaagacagaagaagaccttccacttatggtccaacaatcatgcaatgtttaccgttatgaaactaagaacacccgtcccttaattcgtgttagagagattccatggaatgaagctcacacagcacatgcaactccagaggaagcctacgagatccttgacaagttttgggatattgttcatcatgttttaaccgaatgcttatcaattgatggtctcagattgagaagaccagattgggatcgttttccaggtgctgagtacacagatgtgttagatgttgtcatgccatgtggccgtgttctccaaacaattggttgccattatctcggacaacatttttcaaaagtatttgacatcaaagctaatggcgtcaacagctatatgacatgcattggtgtttccacacgtgcattagccgctgttctttcaatgcatggagatgacaaaggtcttgttttgccaacaattattgcaccatatcaagtcatcattgttccaattcttaacaagaagaccgaagcagccatgattgagaaagtcaacgaaatgaaagaagctcttgttgctgcaggaattcgtacacgtgtcgatcttaatcaacaaaagcgtcctggtgagaaatacttctactacgagatgaaaggagttccattacgtatcgaattcggtatgcgcgaccttcaagccggcaactttgttcttgcaattcgcggaattgatggcaaacaaaccgtcaaaatttcagaacttgtccaaaagtgccaggagtctttggttcaatatgacaatgcacttcgtgaacgtgcacaagctcatcttaagtcacgaattgtagactgcagctcaatcgaagagattgctgatgtccttcaacaaggaggattcgcaagaattccatatttcacaatggataagagcggagcggatggagctgacgaaatacatgagaagtgcggcggagaaattcgtggatacagacctttggaacaacaaccgggcgaaggagtgaagtgcatcatcactggaaagcctgctaaatactgggcatacgttgctcgtgcatactagaaacaaataaagaactaaattttatcattaaaaatgataaatgataaagaaaattaatgtttttgttgcttataaatgtttaagaggaaacttttggatgtctttctctttattattttattccacatactttgcatacgaatgtttgatagaactattttctgcaatatcaattttttcgaaaaattttgttatttgattggtacttgtgtgggtgtcctgtttaaacagtgtggaatcaatcactaaatactttattttttccaaataatatgtgaattttagctcagcattttgatacgaaaaatgttttaaacaagtttcatgataaagaatatcaacagcatttgtattgataatgaaaacattttgtcttcttcaaaatgcggttattgcggttttgttgaacaaaccttgtcaaattcataacaatggatttctcttacttcgaaaaacttaatcaaagaagattcattaaaatgacaaaaataggacataagcagcgtcgccttgtaatttatccaggttttaaaaactttatttcaagaattgtcgatggtcaatcacttcaaagaagctttgagcaaatccatttctttgacaatgattttacctttaattctgatgaatgctatgcttttattatcccacctgaaatcccagtaattcgtcatatcatgtggtgcaaggaaaacacagagtctaatccaatggttgaactttggttccaaccaagaatcaatgaaatagtcactgcctttttagttgattccaattttgcacctgaagcaattctatcaaaatttccaacagaagaaaactctgcgttaaaaaatggccaaacacctgttgaaaacctctttatttataacctagaattagatgttgttccacttgacaatgacgttttgacaataaattcaccattttcatttatgagggcatggacaatgaatgatcttacagtcgtctccgagtttaggaaagcccttgatgttattagtaactacattggctttgctagtatcagtgcaattggaaatttatctacatcaattgctaaaacagttcctacgcccaccagcaccaacacaacacatttgatattgatagacaggtcaacagatctcattactccattaatcacacaaatgaattatgaaggattaattgcagaatttcttggaatagactgtggtgtcacctctgtcgaaaacgagtctggcaaaaagcaacttcaaatcctttcatctcaaattgataaattatttggatacatcagatcaatgaatcataccgaagtttcagctgaaattgagagccgtacttcgcaagtctcagagaagtttagtaagaaggcatctaatgccgatgaaactgtcagtctatttcgtgagactgctcaagcagcgcttgagaaccaaacattagttgaccatattaacatcaccactaaagttttaaacatgatgaaacaatcccgtttcttccgtcgtatgatgaattccgaagctgacgcattaagtggcacttttgatctaaacggtctctataaagagatgcttgaatacggagaagatttccgtcgtgttatccgtatgttatgtcttgaatccttattacgtggcggagtccaagattatcctaagttaattaatttcattgtgtttaattatggatttcaaatggtaccatatcttcttcgtttacaagaagctggactttttggacaaagcggacctaagtggagcccatttgtcaagaatttccagctctttgtaagtaattacgaagaattaaatgatcaagctgcatattgttatctcggttatgcacctctttcggttcgttacgtccaacgaatcatcggaggagagtttgcggctgtgaataaggccgtaactgagattttgcaacaagaatgtttgcaaattggaaaagtgtcaaacaatttggaaggcgattttttgatttgcttcgtcggaggatgcactcactcggagttaaattgcttcagaaggctccaggagagagatgttggatatcaaaacaaacatttccaggtaatgactactgacatgatgagttcgaatgacttcttcgatcatatagcgtaccaaatacctggatggtcaccaactgtgtgagattatgagtaaattagttggctattataattttatattttaacataaatatacaatgaatttaatcgtattaacaaaatggaattggatacgtaatttgaacaaaacaaaaatatgaataatttactaaataaataaaaattattttcgtaatgtgaagtgtttttgaattgaaagagaaataatcgtttacaattcaattattctatcgtttatattcttgaaataaaaaaagtaaaaaattacatatatagattagtttatattttgaagtttctttttcctgaaaagattatcttttatactttttggtagtgtatgcatttctttcgccttgaatccaatgactgcttttaattcttcaaattctttgtcatctgtcttaagaataggaatcttccatttcttgtcataatcttgtatcaatcttcttccttttatagtaatgacgcttttgattgacgtcgtatctacttcgtcattagtttcttcttcattaaaactttcgttcagattcgaatcgtttgacactttttgaccgtttgtttgatgagtgactctgtaaacaaaagacaatgttcttgagccaagcatccaattaatacagagtacctcaatggtgtctttgcttgttggatcaaaacgtgattgaattacatcttgacaagaattattgatgtcaataattcgtaatttggtgaaagacatgtcattaatatcccttgggtgatatagaatagcaaatagatcttttgaataagcagaaatttggaaaatatcatcaattgtttggaaatcgggtgttgagacttgtgtctgaaaatttttatggagatcatatatataaaatgtaccatcagcagaagcaataagaactgagctatcttcagtttctcctttcatgtatggaataaatgagatcttatgtttacctttagccgatttacataaaacatcactgtaagaaaatactatttcttttgcaatagtgtcatagatatgaattatcctattaatatctatgaaggctaaatatttggaatgttgaaattctgatgaaaatgcaacagaggtaataggtacatcgctagagtaaattatttcaggttcccaagaacatagtttaaaacgccataaaattacttttccatcgtaaccagatgatgcaagaataacttgatctctttcgataccaaatgacaatccaagtacatcatttgaatgcgcatgaatagtaaaattagtggtatttgaaggaagagaagaagattcatttccttgaagatcatttggtgaaaagcccaaagaaataggaaacacattaatggatccgacagaattgcctatggctagatttattgaaaaacgatcaacggcaacacatgtaacacttggctccatttggtctggtgaacgtttaaacccaagaaacttgaaaaaatacaaatataataataattaattataatcactattagaatcaaaaatattaaaaaacaaaacacttcgagcaaagggccatctatctatgtataaatttttacatttaaatattaattaattaaatttaaactaatacttttgatcctttacaaaaaaaaattacataatattaataattattctatgtcaatcaaaaataaaaatatttatcatgaatagaatgttttcttgtgttaaatttaaacacagttaatttatgatttaatttttgttcatcatatttgataccatctatatcctaaagaaaatttacaattccctttttcttcctttagctacaattaaaattgctatatcaaattattttaaaatattccaaatattgatataaaatatcaaaatataacagcaaaaattattttatttaattagatatttttggcattaacatcaattccttcttgttcaagaagtaatttaactatttctgtatgaccatttgaagatagaaatataagtgctgttctgaataatttaaataatttccaaatattattttgatatcctaaattattaaaatgaataatacaaataaatatcttcagaatagcatcaattccttcttgttcaagtaatttgacaaatggtggaatattatctttattaagaaaagctttgacaaagtataaattataatgggacgatgtttcacaaataatatcatcgtaaatttcagttttatcttctaaaaatgaaaaaaattgatatttctgtttgaatgcatttatttcctaaggtatttatagtatttcatatgaaatttccttatcaaatatattcattattgattcaactgaagattcaatatccatgtcatctatactaaaaataatatgaaccatattacttggtttgttaaggcattcgaatttaacaatttacaaaaaatgaagcggcttgagtgtttaaagtattgaaatttaaacatcgaattatgacgaatattgaaatcacattatttaaaaataaataataaacggtatgataaatttaacggtctttaaaaatatatgaatgaaaatttaacaacagatttcattatcgagtttgtaattcacaatattaaatgtaaaaactcaaaatgcttgccaatgccactgattgttagtgtcccaggctgcactgattttgttattaatccaaaaattgcaactgtctgtaaaataagtttcgaaagtggaaaaagacttaagttcacacacacaaacatgaaagcaatgaaaatagtatttgctttagttgaatcatttaataataagataattcatggtttttgttgtattgacttttttaatttccttgattcaatagatgactcaacaccacaaattttcaatgtagaagcaactcttgttacacctaatgggaaaatgtttggaattttaaatttttcatatcaattcttcaatatggaaagcttccaacaaacaaaggaagatctagctatttattctacgaaggtttctgccacaaaacaacaaaattcatctatttatactcctcgaagaaaaatatcattccgtccaacatcgccaatttcagcattttcagagtcaaagcctcacactcctacatcgagtaggagctttagaacacactctgttacagattcttcaattcatgaaagatatctatccaaaagtgaaacaactagtaaaagctcaagcacaagaacaccgcgcagtggaggcgaaaatagatcaaataccagtccattttccaggaaaagtcgtacttcatcttatcattgattgatttcacaaactttttgttattaataaaaaaaaattgcgttaatttgtttcttttataaaatcaccaacaacgatttttataagtaatttcgaaaagttaaattaaaattcaattattacaaattaatttcacaaaagcttaactctaattaacgtttattttttagattttacaggtttgaagaaatctgaaatttgtttattgttggatttcttctgtggcttctttttgttctttggcttcttcttttcttcattttctacgacattgttgactaactgagtaatgaacgattctggataaatctttcggagctcatttttaagattatttgcaatatcagttgggattgaatgtctaagaatgtcatatgcaacttctatttggaatttatcttcaagtggattttgttgggaaaggcaattcatgagaagttgggttttgttaataagaaattcataagttttgtttgctgaaaagtaataaagagggccttcacccatatcaagagaatcacatatagttgaaatatgcgggattaaaatttcagcaattggttctaattcagttcctttaaaaaattcgtcagcaataagcatttgttttcccctagaactagcaattggaataattaaaaaaattgggtgcatttttaatggtactaatacagctccatttgaaacaaattgttctccaacaaaccaagaagaatgaggtctatcgataattgataattcataaatggaagaaccatttactaaaaatgtatgttcttttccagttctagggtgatgaaaggtataatattttgcttcttctattaagttttctggggaaaaagcaaccctcattgaaccagagactaaggggcgccccaaatccgtttatacgaaaacgttaaaatccacctgaccacagattatatgggaaaaatttgcaaatctcttgtattaaaacaaacatacgaaagcaaatggacaaaagatagaataaaacaaataaataatggctattttgctgcaattcatggttatgatttattaattattgatataacttcaggtgaaacatttgcaaaattagaggcagaacaagaatctgatgatacaatatatgattttgttgttgatccacttcttcgttatgcaattacatcacatgtatcacaactgttaaaaatgtggattccgcaaaatgatgaatggtcagtagttgctcaatggaaatgtcctggtagatttcctggtaatgttcaacttgatccatcaggtcaaattcttgcctgttccacagccgcttcttcatgttatcttttttcattacaaaaccaaagtctcattcgtcgttatgatattcccaaaggccaaaccacatatatgacatatgattctgccggacatttatggattggcgataattatggtcatcttactgtcattgatcatgaaaacaagaagaccaaagtcataaataatgaagattcgcatcatcaagctgttacttcgattgtatcattacatccatatgtcattacttcgggtcttgatgaagttttattagtatttgacactgatggtgatgttatccaaaagcccgttgctataatgtactccattaattctattgttgttgatcccgaacatcaaaacactgtttatgcagccacaacagatggcatcaaacgtgtaaacattagtgagttacgaatccttaaaatcaattccactgaagtcgatcaattattatattttgatcaattatattcatttgatgcagatggtattttaaagacggtatttaatgataatccaatttcatattcgttaacatttaatcaaatttatgatatttcatatgatgaaaaagaagatgttatagcagttgctacatcatctaatcgatttttaatacaattattaaaggatcatcaagcatatcaactttatggccatgaaaacactccgttatgtttaacgacatttaatggattacttttaagtggttccaaagatacaactgctaagttatggtcattaacagaacaaaaattattatgtacattaattggtcatacagaaccagttacagcagtaagttttataccgaaatcgaattgtgtattaacaggaagttcggataaaacattaaaactttggcgtccagttgaatcagttactgaaattaaatctgctttagcatccgtaatagcgcatgataaagaaattaatactataactgtatcaattgatggcaaatatatcgctacaggttcacaagataaaacagcgaaattatggaaacttgaaaatgatacaataacatacttaagaacatttgtcggacataaaagaggaatttcgagtttagcattttcatctgttgaaatggttttagcgacatcgagttccgataatagtattaagttatggaatatcaatgatggaacatgtatctcaacatttactgagttttcatcgacagtattacgtttaatgtttattaacaatgggttacaattattaacatgtgaatcatccggaactattaaagtaattagaattaaaactggagcacctgatttcattaatgattcatcacataatggacaaatttggggactttccattatgaatgatgattatgttactgctgcttctgatggtaaaatatgtgtatggaaagataacactgaagaaatcgaagctgcagaactcgcggcaaaagctgaagctgctgaagctgaacaagaactaaagaacgctttaaataatgacgagttagttaaagcgttaagaatcgcattcaagtttagaatgccaaataagttacgcctcataatacggaaaattagcgaaagtggatcagacgcattgttgcaatatttcacggaattggaggaaattccggacttcgtacaatggatcgattacatcgctaaatggacaacaaactcaaagtgggcggacgacgcaacagaggcattgactgctttgctgagagtgaaaactttggacttcttcatacattataaaaaggagttcagagagaaaatcgatgcaatgattccttacttggagagacatatgggaagattggatagattggcggtgcaggcgtatgctatcgatgatgtgattaatacaatttctaatgaataaataaataaaaatttggtaaataaatattatacaattacaataaatttaattttccacttgatgtaattgtgcggaacaaacgtagaattaatgaactcaatcgcaagaccattttcagtgatttttatatacttttttcgcttaattttgttttcaatattgaattttaatgtgaccaattcatgatataacaacataattgaagcatgcataactaaatataaatatattttcgaaaatttcacaccccaccagcccagaggacaattagagaaaaatgttttttgtgaatcaataaatatatatacttttaattggagataacaatgagcctacttttattattttatttatgaattaaaatattttcatctcagcttgaacaattcaactttctgattatttaaacaaatttgaattgatatatccgttattaatattttccacatgggaccaaatgaacattgcgactgggaaacacatctatcaataaatcaagaaattattagttttaatgaagaaaatttctctaaatctttaggtttaataatcaacaaatttgatgaaatccatcctttatcttatgatttaattattattaaaatgatatattattcctttgtaattaaaaacaataaaaagaatttatttttgaatattataaaagaaataagaacatttgaagagtgtaataaaatcaaatcgaatatatttgatatatttggactatttcttaaaaataaacatacagattattttatacagcactcacgttagcatcaaaaaatggtcatatagaaatatttaaattacttcttgaacaagaaggaattgatattaatgctaaagatttttatctaatattcgttctaataataagatattacaaaataatatttggaatttatttaaaatatttcaaacagcacttatgttagcatttgaaaaatgttatacagaaatatttaaattacttcttgaacaaaaagcatagatatattaatatttacgatctctgtattataatcaatcttaaaacaaattcaaaatctaaaaaggtttcaaattagaaattattataattgcataatgaaatagaaattcaattttactaaacaaattacttatttttcatcaaaatattttcacttgagcaaattgattccgaaaatattttcaaatttaccgatttttcgctatttttaatcattttcttaatcaatttcaactcataaaatgaaattcctcccaaaacaattacataaaccccactaaagtcctttaaagttttctttttggagctaaagaacttactaaataatccctcagcaggttgaattccatcttccaattttacgtcattaaaaattattccttttaataactttggcaaataaaacaaatcctctaaattattttcttttttctggttaaggttacaattcgatttacaattttcgaagatactttgaatttcatcctcatttctcatatcgctcatgccactgttacaattccgaaaagcggttaaaacctcagaattaatgtcaaaaccgccaaaacaatggaggaatccaattaatggcaaacttttccgcaaatcatacgaaacagtagagattaaatcttcaaaatcagcaccctggaggatcgagctttcgagttgttcaagctcgatatcatctgatgagtcattaaatatatgtggtaatgatggatgtgctttagttagctcaaattgttcattaggcgtgaggcttttccaatgctttagtaagctgttatatgttttatgtgtacttgtgagttggaaaaattcggagatctgattaagaagttcttgttcaccataatttaactcagtagaaataaatgtggaatcaatgagagtggaaacagtgctatgtgatgaagatttatcaagatatgatccttgatgtacaaataaaggggtaataatttcggaacgatcaataagaaatacagctgtggacacctcactatgcttagtattccacccagactctaataaacttcgaattttgttgctataaggtccataactaaaaaatgatgtaacagaattatctaaaatggataataaattgtctgtaataacttggtcagggatgtcagttctaaggcctaattgtattggaagtgtttttggaaagattggtaatatttcaaataaatcatctatttgaatggaaacttgtggaattgtatattcaatgtcaggagttgttcctattatatgaatatcaaacccaaaattatccaagatttgaatttgattatcataattagatattggtcgagttataaatagagcaatgtgctcaaaatctatagttgacataagacgttcgattaaagattttactttttcaggatcacctagagtacaaattaataaaaacaatgaaggaacatatttcattataccaccagaaagagcaattgcatctgatgcttgttcatcggctaataaaattgtattttgaggaatttcgatatcttggaaaatatttatgtgtttcgccatttgtcactttttaatatagtgttgaaacaaatttaaaaggtttaaagcggcataaaatggtattcaaaaagtcacttttattgccgccaccaaatgaactaaggcgggcccgcctaatgatttatcattttttgttaatgagttctcaggaaaatgatgcattttattctccatcagaaatgagctctccaatacatgttcctgaactcaatttagctacagaagaaaaaggttgcttgatttcaattaatcttcaagaacaaccaaaacaaatagaaagctacttatcttcatttacaatccgtccaaaaaggcaagtaagcttaccaaagaagccttatgtatttaagccatttcaatcatttttcgaaactgaaaatgttgttcagcagctccaccttatctttagcgaaaaggaaagccagaaacatgaatagaagcctaatttgtattcaaaataaataaattatatttttagattattttggtttctgattaataatttacatgaattcgtttaatattgtaaagctcttaagagttcatgggttaaatgaacaagttaatcgtgttcaatttgcaaattgattaaaattgaaaatatttcaaattatttaatcattaaaaagtttttgtttgtaaaagaactacacacgttcagtattggtataagatttctttccaaaaagaagttaatcaaagcatttagttgaacgttaaatttttatttgacacttttttcaatacgatacggttttgacacgcaatcagctatgagtggaaaaccaaaagacccaaaccgtaagcgccgcggaaggccaccaaagaaccacaatcgtaatcctccaaagcaagcaactcctaaagttgagttgcccaaacaagatgcacccaaaatcacaatttcgattgagcatccaaaagatcctcttcgcattgtattaccaaacggtaacgaagctacaccaacaacaaagccacaaactcaaccacaacaaccagttctccaaatcacacgcccaacatccaccaaatgcgttctctctgtttcaccagaggcagcgcagcacatgcttgagcgcaaagcggagcacacttacacaatcaaacaaatgcgtgctaaacgtcatacacatgaacttgcatctcaaagtgttttcagattccacgccgagctacaactttataagcgttatatttcgggcggtgctcatcgtaagaaagtgaattcacaaaaagcaaatattgcagttcttcaacaacgaatcaacaatattcttcttcaatttaatgtcaacactttccatattacattcaaccaaatcttatcacttggtattgaaagtgatacatttgttttatcatttgtcaatgttgttttcaagcaagcagcacttaatccaagccttgcattactcttctctgttctttcagctaatgttatgtatgttcttaagcgaactaagtatgcaaatatgttacgaaacttattccaagaacgatgcaaagaatcatttgcggtacctaagaacgacactgacaaagggaccttcttcttgttacgaggcgttgtagtctttgctgggcatcttttcagagacggcatcattcagatgtcacttttgtctcaatttgcgaatgagttaatcaaatcaaaagaaccgaaatcggttcaattactgataagtttattcattcatggcggaactaatctcattgagcaaaacaaagaaatattaacaacattatcgaaacgaatggaagaaattcatgatgaagaaatcattaatgaatataatgaattatgtgaaatgactaaaaccggtctgaaagaaaacgaacaaagcgaaagagaattaaagcatcctgaaatgcagcattcgccttcgatcgatcaagatttagatatgaaatatccttcgctattcaaacacagtgagtcaattccagcgcagctatcggctttgtcaggtgaagaagaagacgataagacgatggaatctatcgtcggcggttacctgtactcaagtaatccagacgaatttgcggttaaaattgagaagatcggttaccataagaacgatcaaaaaacggcggttgacttgattcgagctgttgcaaaacaaccggaacaaaatcaacttgtggtaagtgaactggtgttgtcgatgaggaacgctggttacttcgatgatacaatgctcaaaaatgcaattaaaattgtatctaaagaatttgcaaacgaagtagcaccagctattgctcttggacggatatacgctattctggtgaacgaggaaatcacaacgtttgatgactttgttgatttatttggtgatatgaaaggaatttggaaatcagtaattccttcgatattcacattcgtggaccaaatttgcggatcgtggttcgataatatgatggaaagccaattttggagagatctcgatttcatcgatgcaaagacattcgaagagaaactcgacaaaatgaaggaatgggacattgctgatgtgtacccgcattatgatgcagcgaacggattcatacaacttgtcaaagaaggaaaagatccgtctgattacatatcgaaacttgaccaaactgtaagtcgcgacgaactaacaaaacttatcatacagcaaatggaggcactcgatgataaggaaatagataacgtcgttacgaagatgaaggagttcttcagagctgaaaaggaaatcatcgaatcaatggccaccaaatcaaaggtcgcggcgaaagtatcccaactgcttcagtaaatgagttgaagcttacattcgtttttttgttttgaaatcgaatttgatgtaaatgagatacaatgtgacgctgattggaagtgtgatgaacacataacccgcgaatgcttttgccttcgaaaatctatggtaagtatgtgttttagttgtgaaaacacgtaattttataaaatgtgccaccacatttttgatgtaaatcattgaaattgacaggacgcgacggttatttcaaggaataattaaattcatatctggtcgaatcaggctgaaaattttgttgtaaatgtgaaattaaaaatgtttcagctcctcattgcaattgtaacttcgactgcaataacatatacagtaagatctggtgatacattaacatcaattgcacaactttttagtgtcacaattgcacaaattcaagaatggaacggaatttcaaatccaaacttcattacagttggacaagttcttaatattaaagaagcgaaaagaacatatattacatatacagttaaatcaggtgattcactttcagtgattgcagcaaactatggacttacaacggaagatcttgcaatatccaatatgaaagcatacccatacacactttatgttggagaagttctcttaattccagttccacttccaacaccatcacgatcgccgacagcttcaccttcgaaatcgccaaccccatcactttcaccactagcgaacattaccactgattcgtatgttgttcaacgcggggatacactctttagcattgctattgaacatcacactacagttgaaaatatttgtattattaatgagattaaagatccaaatcttatttatgatggacaacttcttcaacttccgaaatcgacagaatctatcgataatttttctaatgaaccgattgtctaacaaatttatcatttcttgctcatcgccttcaaatgtttggatggtataatacgtcagaagccattgtcagcgatcttcagaaatgcgttgaagagttcatcagtagtcgacaatcatttttacgtttcataagtcactgtgcatataaatcgaattttggattatatacacataacaccaaagaagatattaatacgaaatacacaggaagtggatatctccaaattgaagggtattctaaatacgaagaattttcagaatatatttcagattcgaaagttgttgacgaaggtcatttgtatgtatctgaacattatccatttcttatttcaggatattattggagacgcgaaggtattgactcgtattgctgccaagggatcagtgaagaagaaatcgcacttcgactttatgggaaatatgaaggagctgaaaacattcgagaatattaccaacgcgcgcttggcatcttctaaagatatttatagtgtatttaaatgttttttgtttttgttacttaatttttttgtgcatgacaaaataatactaaatctataaagtgttgttatctatcgatgccaaaaattgagagcgcgccgatctgtaagaacagttcgtaacgttttcataacgttcaagtgtatgtaaatcatataaaaagccaaaacttattcaacgcttatttggtcggggaactttttgatcatataatgtgcactttttaaaatcaaagaagcaaacacttgatgaataaaagaaaaaatgattcatataaatcattgtttgattaactgtctaaaatagatgcagttgtatcaggtatggagcacaagtccgccgaaggattaagtatgaaaagaaattcttgatataccaatgttatcatgtaaaatccatcgtttcttatataaataactgtgtgcttatgctatttatatgaattttcaaaattattaaaattaatttttgaattttggatcaaaaatataaaaaaataaatatgcataacaaaatacaacaatatattcaagtaatcattggatttcacttgcgttgcaaaaagagttttaactttcaactttttatgcaatgattcaaagtaatataaaatcttttcgttatgaaaaatatttcataagagaatattctcgcacaataacaagcgtttgttcaccaatatcatacaacaccactatctctataatgaaaaacttagtcgagcgacatttatcgactagttaattaaccgaaaaagttaacaaaaaaaaaaatcaataaaaacgatcaaaatcgattttgaaacggaattgaatgcttcaaagagaaattcggttcacaattttttcaaaaattgtgtaagataaaactacaaaagcattagaaaactgatttcaatgtggttccaaaaatgtttttgattctattagcagcggcaaattcagttgcaataacatatacagtaagatctggtgatacattaacatcaattgcacaactttttagtgtcacaattgcacaaattcaagaatggaacggaatttcaaatccaaacttcattacagttggacaagttcttaatattaaagaagcgaaaagaacatatattacatatacagttaaatcaggtgattcactttcagtgattgcagcaaactatggacttacaacggaagatcttgcaatatccaatatgaaagcatacccatacacactttatgttggagaagttctcttaattccagttccacttccaacaccatcacgatcaccgacagcttcaccttctaaatcacccacagcttcaccatccaaatcgccaacagcttctccatctaaatcgccaacagcttctccttctaaatcgccaacagcttctccttctagatcgccaacagcttctccttctaaatcgccaacagcttctccttctaaatcacccacagcttctccttctaaatcacccacagctactccttctaaatcacccacagctactccttctaaatcacccacagctactccttctaaatcacccacagctactccttctaaatcacccacagctactccttctaaatcacccacagctactccttctaaatcacccacagctactccttctaaatcacccacagctactccttctaaatcacccacagctactccttctaaatcacccacagctactccttctaaatcacccacagctactccttctaaatcgccaacagctactccttctaaatcaccgacagctactccttctaaaacattttctccaacagaagcatttacgcaatcaaacacatatacgccaacagaagcgccgccgccatcatcgccaactccagctccgacgccattgccaagttggacaacaacagtaacagcatcgcaattatctgcgtttggatggtataatacgtcagaagccattgtcagcgatcttcagaaatgcgttgaagagttcatcagtagtcgacaatcatttttacgtttcataagtcactgtgcatataaatcgaattttggattatatacacataacaccaaagaagatattaatacgaaatacacaggaagtggatatctccaaattgaagggtattctaaatacgaagaattttcagaatatatttcagattcgaaagttgttgacgaaggtcatttgtatgtatctgaacattatccatttcttatttcaggatattattggagacgcgaaggtattgactcgtattgctgccaagggatcagtgaagaagaaatcgcacttcgactttatgggaaatatgaaggagctgaaaacattcgagaatattaccaacgcgcgcttggcatcttctaaagatatttatagtgtatttaaatgttttttgtttattatttgttatttccaaaatataaaaattgcatttcttttacctttttataatttgattattctgttaatattttcatttcattgtgttccaaaatatgaaataaaagacttaatgcacatctttagtttattaatcaaaataaagtatgaaaaaattgtaagaatatctacttgagtgtaagtgcatgcaactttccatatataaagcatatacataataatttttgaagaaaaaataattgtggcaaatgattactaaaacaaaaagtttttaatttcgcaataaaaattcggcaatcctattttactaaattgtttacatattaaatgtaacaaaacgatcaataagcaattaaaattttataggttcaaattgcttttgaaaagttaacgaaatttattccttcctctctgatagttgattatgttttaatgtaagtgaatgtttatacacatattttatatgaactaattttagaacatattgaaggatgtggattcaaacattttccttatttcaacttgttcaattataatttttttaacacatagaattcaatattaaatccataaaaacctctaaattctaattatatatttaatgttgtagattatatataaaataacatgttattggcaatttcaatccataaaaaatatataaatatttataatttgttaaatgtttaaattaaagaaaatattttagaaaaaattgaagatctatagttcttcttttgtgatctgggaaacttaatacactttttcaataaattattattgacttaaaccgcacatatcatctggaagaacatgcgaaaacgcaaaacaaatataagcaaaaaagaaaaaatatttccccaaaacataaaactagaattattctctaagcttgaacaaataataatgaatctaacagaagaaaatataaatttgtcagctaaacatacaataaaattatttgattttaatttaccatattcatttcatcttgttataagtaatttaatttattatgcatttttatcacaaagaaataagtgtactacgtattttaaatttttagaaataattcaaaagaaagaagaggaaaaaattaattctaaatacaatattattgaaatattccttaattatatcataaaaaataattctcaagaagctctatatctaattgagcaaatgattcgacaaaatttaattaatgcaaacattacaaagataattccttcaaaatattttgctcattacaaaactacaactgaaaacaaagaatggttatgtggtgatcgattttgttcaacttttgtaaaaaattatgaccaactttcaaagaatgattttgaacttcataaaaaatatgttaaaaaaggacataatccgaatgaaattgcaaaaataattcgaaatgataaaatagaaaaacttcaagaaatatcatcacaaaatgattttgactttaatcaaataattgtaccatcactttatgaaagatgttcatttattaacaatcggaatgttacattaattgattatgcagcatttttttcttcagttaaatgttttaaatatttacttatgaatcaagcaaatgtaaataatacaggtaaatatgcaattgcaggtggaaatgaagaaattgttcatttatgtgaacaaaatggttcatcatttatagggtcttatgaaatagcaattaaatctcaccgaaatgatatttttctttatctttatgaaaataaaatggataatttgtgtgaggaacatgatacaaaacctcataaaaattatctgaaatatgaagatttaataaaattttgtgttatgagtggaaattatgaaatcctatcatttttagaaggagaaggaactaaaatcaatgaatctatcatcaaaaaatcagcagaaataggtaatatatatctactcatgtattttcttcataataacaagaaaataccaaaaaatattttaatttattctattaaatcagagaatgctgaagttgtggaatatatcattcttaaacatagaaaagaaatcaattttaattctgtaaatattttttgtaaaatttcaatgctttcatacaatatttgataatgattaattaagttatttagaacacctttgatatatgttgctgaaaaaggttacacagaaatagttaaattacttattaaacaaaaagaaattgatattaatgctaaagatatttatttgttttctttgagatttattttaataattttatatttcaaaataatatttaaaaattatttaaattatttagaacagcacttatttatgcatctaaaaatggtcatacagaaatagttaaattacttcttgagcaaaaaggaattgatattaatgcgaaagataaaattaatttgttttattaggtatttattataataatttgatatttcaaaacaatatttagaaattatttaaaatattatggacagcacttatttgggcatcttcaaaaggtcatacagaaatagttaaattacttcttgagcaaaaaggaattgatattaatgctaaagatattgatttgttttatttgaaatttattttaaaaattttatatttcaaaataatatttggaaattattttaattatttaaaacagcacttatgcttgctacttcatggaaacgcatagatatagtcaaattacttcttgaacaaaaaagaattgatattaatactaaagatattttattccttgacctaaaatttattttaatgatataatatttcaaaataatttttggaaattacaaaaaatatttaaaacagcacttatttttgcatctagagatggtaatttagatatagttaaattgcttttggaacataaaagaattgctttaaatgttatagatgatttttatttactataatcgatattattcagagttgctttgggttttaagccaaaatttaaagttttattatataatttgaaacaccattaatttgggcctcaaaaaatggtcataaagaaattgttaaaatacttattgaaaaagaaggaactaatattaatgccaaaaatttttgaatgttttgttcaaggtttaaattaattaaaatggatttcttaataatgtttggaaaatattcatattgtttcaaacagcacttataaaggcatcttcaagtggatacattgaaatagccaaattacttttaggaaaagaaggaattgatgttaatgctaaagatattatttctatattttgtttagaatttatttatacaattggatgtgttatatgtgtatttgggatttgtttaaaatacttgaaacagcaattgtgtttgcagctaaaaatggtcacacagaaatcgttaaattacttcttgaacaaaaaggaattgaaattaatgctaaagatgaatttttgttgttttatttgatatttattattataatttgatgttttaagataatatttggaatttacttaaaatattttgtacagcactcttgaaagcattgagaaatggttgtacaaaaatagttaaattacttcttgaacaaaaaggaattgatataaatgctaaagatatttatttgttttatttgatatttattattataatttgatgttttaagataatatttggaaattatttaaattatttagaacagcacttatgttagcatcttataatggttatacagaaattgttaaattacttattgaacaaaaaggaattgatataaatgctaaagatatttatttgttttatttgaaatttattttaataattttatatatcaaaataatatttggaaattatttaaaatatttggtacagcacttatgaaagcatctgaaaaaggtcatacagaaatagttaaattacttcttgaacaagaaggaattgatattaatgataaagataaaataaatttaaataatttgaaattttaaaataatatttggaaataatttaaattattcagaacagcacttatgtttgcatctagaaatggttatacagaaatatttaaattacttcttgaacaagaaggaattgatattaatgtaaaagatatttattcgttttattttaattttatttttatttttttagacttcaaaacaatggatcatttacacaaccgcagaccaattctaaaaacagattaccatttgggaggtgtctggaaaaatattttgttcaaatttgtgaaatagttagacattgataataagaaacacttaaataagtaacatttacatatgatgaaccaatcattgataataaatatgaatatataattgaacttttgttttccgtttttgttttaacacgagatgaagtaatagcaaatgtacgcgatttagtcaatgtattactttgtgtatatgtatcacttccttcaacagtatcattttgttactgtcataccacaaaatgttgaacttttatatgaattttgtgtcagaacatatttgatacaagaaaatatggaaaatattaaactttgaaataaataactttcctttgttgaaatattccaaataaaacaaaatgcaaaaatgggaattgtttatgcgtaaaggtttgcaacccatgaagcaaagtcgtatccaccatcgacttcttgaagttcggacttgaggaattcgacgtcttctggtgagaagaagcgttgaagttgtgcctcggtgacgactgggttattttgtgcgatagcgcggaatgcctcttcagttgtttcctttgtttctgccttagagaagcggtcgagcatgaacttgacgtagttgtcgaagtcgagggtttcagcaccgcctgtgtacttgttgatgatatccttgcattcatcatcggtagctggttcaccgagtgctgtcaagcatgcgttaagttcgtagtactgaagtgtgttagagttatcagagtcgaatgacttgaatgtctcacggaattcggcgagttgctcttctgggatttcgagacctttagcggcagcaatagcgctgtcgatggctgcgatgagtgtgttgatgtgtgcaagaatttggtcgaacatgtcgacgattgagtctggtgtatattcggcatcaagttgaagatcattttgttcgagctcttcgtatggtgcattgagctctgagacggagcccttcttttcttcgacttcatgtgacatttggataagtttctcacgcttctcttcgttttcgccatcaacgccattgacttgttcttcgagtttcttggactcttcaaccttctcgttggcgagttggttgtatgattggatcttagcattacgttcttcttcttccttaaggttctcgatgttaagttcaaggtgcttgatgtgtgatgcaacttgttctgcgtatgactcaaggagtgttgttgagtacttggctcttgtgttaaggtttaacttgtctaattcttcatatggtgccttaagttcttcgatttcgccgcggattccggtttccttctccttaagttgttcaagaactgctaattgttcttcaacggagccggaaatggagtcgatttcgccgtggacatcttggcatttttgaacaagttctgtgcacttagtatcatatgcattgatgaggtcaagttctgcttgcttaagttcttccttaaggctcttggtttggttggctgctgtttcatcaagttcgttgagtttgttggtgaggacttctggttcgagaccttctggtgcaactggttctggacggccagttgtcttgcactttgtgcctaatgatgcccatgtacggagtgccttagcacgaagttcgacgatgtttggacgaacattacgtgtgtacttaagaacatcaataagtttggccttgatgccaacaacagtcttttcataatcactgttgagtaatgagtcagatgcggattgcatggcatcaatggctgcacgtgcttcttcggcatatgtgttcttaagatcggcgatttccttttggatgccaattgtacgcttaagcttttcggcttgttgttcaacctttgattctccagcaaagaagtggaagaattcggcaacttgtgtaacaacagatttttcatctggaataacatcaacaagatcttctggatcaaggtagactgtaagtccgatttcattgcatgccttgaatgcttgttcacagttgtttgtgtggttggattggtcaagggcgttgtagtctaataagtttggacggaacttgttgattaaagcgcagaaggcaagacctgatgaccatgagtttgtgaagttggtgatgttaacaccatcatagccttgtgtgttcttttggcaccagataagaagtgcagaacgtgctgtggcttcttcaacagagatatcttcgatggcgaacttgttgatgcaagaccatgtaagacctaatgtaagctttgtgttcttgtcaacgatatcatctgggctgatgttaacgagtttgatgcccttcttgttggtgatgtaatcaatggccataccaacattttcgatcatgtgatacctgttcttgcattccttgtgccatttgccagtgattggttccttaccaataatttcgagaagttggataagcttgacaccatcagcaaattcatcaagaacgctctcgaacttgattccctttgtagcaaggtgtttagcgcaccaacgtgagaaaactttgatttgtgtcttttcccagcctttatcaagaattgtcatgataaaaaatgaaccgaatataaccaccagacaatgtccgcaaatgataaccacttttcatagaaatttctatcgtgaaacgatcaaatgagacaatgtgaagtgaagtggtttgtgttgtcaaatcacctgacatggattaaaaaatgcctcaatgatctttctggttaaatatgaaatcaacattacaccacataaagatgacgcgttaaagtttacgtttatttttgaacccaaaatactattatttagttaacaacattcgtgatacatttaaggataagtgaataaattttttggcaaatagatggaattgctatgataaggttgtggaacaaattaaaacatgttttcttacacatcttattctgattaaacagcttaagaggccatttataacttttctttgccaaaacagtcaaaaagctgaaacaataacataaactttacaaaagccatcaaatgcttattgaaaaagttctcatttttttctgccagttttcaaatttcaataaattttgtaacttttaggatttaaacattttaatcatattttattaatcatttcgcatatcatctattatcatgctacgtatatttcttttataaaagttactgattattcataaattattatttaatttttatttatttaacatacatatttagctgaaaatttgtgcaaaacaattgttttcatgaatttttttgcacacatcttctaaaaaacaataaaaatcattatttttcttttgcaaaagtaactcgaacatttggtccaaatttaaatcaaatttacattcacaaacttcttcaattctttgatatatttgaacaaaattttggggataaagcaaagcaattactgccaaagttttacctccatccgttaatattaattttggtttctttataatattttgccataagaacaatgaaattctcgaaaactttggttctaactcacttaaaattttattatttctacttattataagaaaatcacaaaaattgatcagaacagaaaaaacattattaagataaaattcattgttaataaagaaacaaataaaattcatcataaacatcatgaattcatggcccatttcatttaagtgtcgtttagttaatgaattaaataatgaaattattgataaagttggatttggatattgtgataaaacattaaattgtaaagtactcaatacggtgtaaagttgttgaatcaaattcaataaaatcggatcttcataaatttggaaaactttaaacattacatagtcattatcaagtaatttagataataaatcggaaattctacgaatcaatttaattttatattcaaaatctattgattcattataagatttaaatgattgaaatacaaatttagaaatttctttaaataaaattattccatttggagaattttcttcaaatgatatatttttcctattaagaaatgaaaaaagcattttaattgttgcataaattatatttggatccaagttttgataaataaaatttaatatatttggaattaaatattcagaaaatattaaaaaatcttttgtttcacaaattccgtatttacaaatactttctaagtctttaataaatatatataaattacaattttctgagaatgtgcttaaaaatttttctgtgtggtaaaacttatatgaagccataaataagaagccgataaattcttctcttgcctttttatttaatcccataaataaaaatcgttcttctgaatggtttaagattaagtccatcaaagtttcattcgatgggaataccttatgaagatttttgatcgcatattgaattataagcggtttatcataaaaagttataaccgatattaaattcctttcaaataattcatttgacatttcaaaattgctagaaaagtgcgttaaccgaaaagttgaaatgaatttaagtactgaaatctcaagtgaaaaattttctattttttgttcaatgaaattttttgttaatcgaataattcttattgcatcattaaataaaggttcccaatattccgaaatagtatcgtcaattgaagatgatggctcaagtattaataacattgatataaaattcaaatataaagaaagttcaatttgatcatttgtttcattaaataaagacattatcattgatatcaaagaaggaacgatttgtattaatcctttaacaggagataagtccaaatcatccaaaaatataaaaacgtcttctaaatcgatgttacgaataatttgtaacaaaagttcgatataacttttagttaatgtttcataattttcatacagaaacaccttcacttcagtatctcccgatttcatcatcgaaaatgatatacaaccccaaaagtttattaaattttgtaatgtttctttgttttcatataacatttgagcattcgaaaataatgaaattgtccaattaaaacattcttttataaatggaataaaaaattgatatttatttatttcattgtgtgttaacctcttcgaaaattgtaacaaaatattcgattttaattcgatttctttttggttctgaaaaaagataattgaatctgttataaattgttcataaaccaaatctttgcaaggtggaactccacgttcaaatgatgaattagaagtcattacaaaacattggatacattttagtgacattttatgttctgtttttgtataaatattaaaatataaatttaagtttgttggatccgaaatgaattgtcgcatttgtggtaaatgtgcaatttcgttttctttttggttatatgataaacatgaaagtgataattgtaacgataaatctaaaaaagccgaattagttaataaaaaatctttggaaatattgtaacatgttggtaaaaatttatttccaaaagtattgaagtttgttgaaaattcactcggagcgcttgaaaacatttgtatggtgtatattagaagattgagtccgagtgcttggtgatttaaatcgggattttttaaaaattgtgatgttaaattaaaaactgctttggtttcgtctgatttccaaaaggtaacaataatgacaccaaaagttgatgaaagtgaacgaatggttggtgggttaaaagaatgtgtgtccaaaacttgaagacaccaatttgcaatttgaagagcataatttaattcccacgtaatacaaaattgttgagttaattttaaaagtgttgatgataaaaataattgatatacatcattcggatttctttcaagataagattgacatattggaaaacttgatggatttgtttcaaaatcatgaattcttgataagatttcttcattagctggattagagattaattcttgaagttcttcaaaggaaatgctattcatttacttgaagtgattccaaaatgttctttttaaaaagaacgtttataaaaatagtgaccgttaagaagcggttttgacaaaacctcatgggttcatcttcaagtaaagcagaagaaactatgcttctagatattcttataccaaaagctttcagaacatgcgtggatgatttatcgacagagcatctcacagattccgaaaaaacaaaaataaagaaatttgtttatcgttttgttgaaacatattatgaatcaaaacaaactgtcggagagcaaatgctactttcagattattcagatttcttgtactaaacaattattattattattttttcgaaattttcaatacaaaaatcagtggttttctttttatttaaagtttttggttactccaacttccgttgtatgtgtattcaccttctgctctgatgaaaacaaattgacatactttaacaccaggcttaagtataagaggtcttgggctaagattgcaaatttcaagtacttgcctattattaattcctggtgccattaaacttgctgtgaaatgaataagaagtcctaatctagccattctacttcttccttctaatagtccacacatatttggtggcaactttacagtttcttttgtgattccaagacatgatgtaaatggtttcaacaaaaatccttcaccatcttcaacatgtacaagttttgtgattttctcacttctataatcaacatcagcttcaagtgttattggcgtttcatcttcaagaaagatacgaaattcattccctaaagtaagatcgacacttgcaggtccaacattttcaagtttgaaaggttcgcttatctctatattgcccttttttatttcttcaattatggcatcatgtgtgagcacacaaccaatgttacataacgtagaagcatcagaagatcgtacttgcatccaagtacgagtttttctttacttatatggccagccatccattttcaattaccgcttgaccatcacaaaccgttgttgtaacgctcgaacgttaaaaatgaaaaaagtcaaatgaatataccacttgcttcaattgattatatatctaattgtatcttcagaatttcggttaattcaccctattatatatttactatgatggtaattttagggccaacagttggatattttgatcaattgaggaaaatgattatcaataaatctccatttatgtttaataaacatacagcactcattcaaatgctatccaacttattgaggtttatatattggcaatttgaaccatatattttttatttgctttgtcaatcaatatgcgtattttcattgcaacttattctttcttttttatcttttcactatatggatccaggagaaatatttgacaatgaaccatttatttataatcctttaggatacagaattccaatacaaagcggttcagaaaaacattataattttttctacatatataaagcaacaacagcaatgcagttttttctgtcgttgtgtttatatttctgtataattttattgatcttccagattggaagtgcaatcatcggatacaaaaatatggctactgttacaatcctgctctccaacatcattgattcattcacgtctcttccacaatttgttcaaattgtatggtatagagaaatcgaaaatgtttcttctgttcttgttgctcaattccttgcaggcgacattatgaaactatgtatgtacatacttggtcacgcagcatggccattcaagtttggtgcatctttgcaaacatgtttagatacaatattattaatttcttatgtcaggcaaaaatgctttgctcagccaacgaatcaacaaagccgaagaaattctatgcaagaggaaattcttccaaaatgaatacgtttaatagatttataaatattttctatctacgaactatttttttttttcaaattgaacttatgataataagttagttgcttcattcattagataagcttgagcgaagaaatgcttcaaaaggaaacttttgttttttgtgtggaacaaaaaaactaaattcgctttttcagtactttacgtaatttataaaatgtgcgattgcttcaaatcaaatgcccaacttgaagacgttgataaatctcaaatgattgaatactcaaggcaattatttgatttattcaaggatgatgtgtacgtaacaatttttgatccagaatggaaaccaatttggcaatcagcttcatcagaaaatttttcacaagaattccaaagacaaattgaagatgtgggaaggttaattgctagcagtgaagagtctatccttcaactcaattcaggatggcgagttgacgaattaacttcttttcgtttaacttgtcattcaagtcgaatttttgtttatatcctacagcaaacatataggcttgtagtaatcaacaaatattcatcacatgataatattgaagaggatacaaattttgatcaaaccataaagtcactttgtcacagtgtttcaaattctatctatgcttgctcacaaagcgataaaactgtttagactttataataagcttgcggaaatttatgtttttcttataatcccataatttcttcatttttattagtaaaatctctataagttatcttttgattaaaaaagctttctaaatgatgttaagaaagttttttgttttggaagatttcttcgctttttttaacgttcaaacagtgtcacttttgaataacactaacaatgcaaatgacaaaaaaaattttataaacattagtaataattcaaacagtttaattattcatgtttcttgaagttgagcgttttctttcttttcacaaagaagaatgcaacgtaacaagcaagttcaatgaatgaaatcatatacaaaaatgtcggaacaaacgacgatttcatttctttagatctgctttttgcttcatctgttaagttatcatagtctttaattctgttataaaatgacatcaatgtattaattgaatcatttttagagttcgataacgcgtccattgcgcattgcgatattgagtccattttatctttgacaatgtttttaagattttttaagtcatcttgaatttcggtgaatgatcgagatcgcttttccattttatgttcagtcctcatcaaactaacagttagcgttgcgtgtacaagcctctgtaagtctttagttgttaaagaatcttttaaccgacttctaatttcaagaagaagatctcgaatttcttgcccagaataattgtttttcccagattggtctagtttatatgaagccttttccatttcattgattatgcgctccgcaagtgggagaacagggtgtgaaattggctttaaaagttttctaagtttacgacggtttgcatcgtccatttcggttttattgaatttttctgtgtgatttggggggatccttgtcaaaaagtggaatagctctgattcgccaatgccttcttggctctcagcaaaaaatgagaagtaatttgcatttggaatggttgcttcgattggatcaccacattgggtaaagtctgaacctcggtcatctaatgcataacatgttattgtattatctttgtatgttatgcgaactgtgacgttttgagagtaaacctggcagaggtttcggtgaatttgattgtcgtcgttaagataatgaaatgctatttttagtttcatattatctattcttgtaatgttgaaagaaatttgattaaaagatgttgcattggtgtggatataataaggacagaaattgtctgagattataaaggataaggaaccttttgaaacttcagcacggaactcagataaccaatcattagaagtagtgggtaagcgctggcatataccgctgttttgttttttataatctgatgcaaaatgaatagaactcttgagatttgttgccacaccaacaagagaccaaaaccccagttcatttgaatttgataacgttattggaggaaagatgtcaaatgatccttctaatgaaaaacataagaaaaggaatgttcccatataaaagaaatgttatgtgaaatagctgaattctattttgtcctttgtgatttgataatcaagataaaacgggtaaaatattgttaagacgacgcaatttcaacctttcattagtcattttgattttcaatatgataaatgagaagtcacttaatttatgtttatgcacataaagtttccagataaataacaattgtttccatagtcatagcaataaaaaatcgtgtaaatgtaattgactttgaaacgtttcattctgattggaaattaaagtttcatttacacttcttctaaaaaaatcatcgatggtactttggccgagtggtctaaggcgttggatttaagccccaataccgagaggtgcgtgggttcgaaccccacaggtaccagttttttgtttttgatttatccttgaatcatgactttcattctattataaatgtattcccttttgatgcgatttcttctataatttcattgttcattttcattccttctttttctgaaaacatgaagatttcataattattaaatacgatatgcattttttcccaagatatattaaatttctatcacttaaattacaattatcttatttaagatattacaattatcggctctgatgcaaaacgccctccattttgcggtttttgaacgataggaaatttgaggaaaaatagaaatgccacattagggcaccccatccatcatcctgacggccggtttcgatcgttatccattgaaaaacgaagtttttcaatggataacgatcgaaaccgctcgcaccttcggtgctcgcatttgatacatattaatatatatattttgacagacaaaatatttgacataacgataatatttaagttattaaataaaatatataagatttattataacggttatcgataaaaatttattcatattttttgtttgtaaagtagtcaaaaagtcgatcatttttttattgatgcaattgcaattcgaaaccataaagaaagtgttaaaattaaataacaaaagcttcatcaaatgggcctctgagcagggaatcattcctgatatccaccaaattcaaatatgtccgaaatgtcaatcgttaatgaaagtttatttctcaccaagttaccctgatggtgctgcatatagatgctgctcaagtaaatgcagaaattcaaaatcaatcagattagattcatgggtatcacaatcaaaactttcattaaggggatttgttcacattttagcatgttgggtagaaggttttgatataagaactacatctaaaattacaggtgtatgtgaacgatcagtaataacatggtttcaaacttttcgatctattgcagaaaaagaatatcgaaaagatatagctcagaatttacttggtgatggaatagtcgaaattgatgaaagtcattttttcggtgctaaatacaacaaaggaagtgcattggaaaaagaagaaatttgggtttttgacgaaatagacagtaaaacaatgagagttgttgctgagatttgcgaaaatagatcgaaagaagttctcattccaattatttgttcaacagttagacctaattcagaaatttggtctgatgaatggaaggcatataatactcttagtgatttaggttatgtacacaaaacagtaaatcactcagaaaattttgtagatccgattactgaggcacatactcaaaaaatagaaggtacatggaatctaataaaaggatacctaataaaaaatggatttagagacagaaattatttcgaatcatatatccattaatggtgctttcgaagaaatataggaaatacatttgaaagatgctggaaagtaataattggtgaaatttcttactaaactaatgataatttaaaatatttttattagaaaaatgatttcgaagtgtatcagaccccccccccccaatgatatattttgccattattcactttttgaaatgactttgatctccttatcaaaagtcgaatatttttattgccattttttttcctttcaaatttcctatcgttcaaaaaccgcaaaatggagggcgttttgcatcctaacccaattatcaattaatttttgattttggaattcgattttgtaaaagaagagtttgataataaaaattctccaattttattttcataaagataatgaaaaatttcattttgatgatattctatcgctgtttcatatgcttcaacgatgaattattttgttcacataaattaataatttctaagtttccacctgctattgcatatttagatgtacttttaatattcgagttatttaataacacatatataaaacatttaatcgagccaaaaaaaaaacatgaggtggccgcaagaggctggaaattttataagtaaatcttaaaacccagtgatctacttgtagctcattcataagaaggcacttttcggtttattgtacgttgcaaaaaatgaaaaaaaaaagttttgattctggttcatatattgaagaaaaaatagcaccaaatattgaagccaggatcaaagagctaacacagaaaagagatgaacttaaattacaaaatcaatctctaaatcaaaagttattatctcttcaacggcgaaacgatgaaatacttaaacaactccaacgagaatctcagacttttgaggaaaatctcaatgctcataaaaaattatatgaaaaaaccaaagcagaatgtgaccaagaaatagaaaactttaaacatgaaatggatgaagaacttaaaaaatgtactcaagttcttgtagcgcatcgtaaagatcggaattatcttagatttaatcttcaatccaaaaaagaaattgatgaaacacgaattgccatgttaactcaacgagacaacttaacgcaacaactcaaagatcttgtcaaagagttacgtgacgaaaccaacaaatttgaaaaagaaacagctcttttccgtggtcaaaagaatgaagaagaaaaggctaagcttcagcatctaattgaagaagcaaaagcctctattgacaaagagaaaatcgacactcttaaagaagcagaatctcaaagtaaaattcttgcaaataaagttgtcaaattccaaaaagtggtaatttcacttcgcgaccgttataacaaacttttatcagaagcgaatgaacttgaaatgcaaacaatggaagccaaattagtaacacaacttgttcacccaaaatctacccagtcaattataaacaaacttcatcttgaaaaagaaaagattgaagaacaaaaactgaaagctaaaactgcgcccgaagcagaaaatcgaaggaaagcaactcaacatatgaatgccatgaaaaagaaacgaaatgagttaagtggattcattaaattaaattctattaaaaaagaagagttgacgaaattaagagaattagcatcgaatgttattgagcaaaggaatgcattggttacatttatgaatgaaacaatggctgcattaagacatcaaattgcagaagaatatgatcaaaaaggtttaccttttcggacatcagaacttatattgtgtcatctaaaggatggcgaagaaaggaaaaaaggcggcgaaatgtctccagatgaacagttgtggataatggaaatgctgtactcaaggttttgtggggtgccacttccaaggaacgaagattaaatatgtttgtgtttgtaaaatcgagttaaaaatatttaattttttaatatattgtatttgtgaaatttgtgtgaattcttattattaatttcgaatttacgctcttacctatttagtgatgaaataaacatcgccacgcagaaaatattattgcttaccaacacattgaatttggtatatatgatttatgatgtgtatttaaataaattacatgtgggtataaaaattatcaacccaatttatagaaagagaaatttttttatattattagcacatttttattgttttgtttgaaaaagttcggatttgtgcctgaaatttcgatcgaaaaccactaacttctcaactaaatatcttctcaataaaaatggagttccatcattctagtggatatactaataattcaactgtaattgatataatttacttaacattagatacaacatgcatgttattatcaatgtctaactatttcacaaatttgaacaaaatatttttccagacacctcccaaatggtaatctttttcttcaaaaattattatgtatatgctttatatatggaaagttgcatgcacttacactcaagtagatattcttacaattttttcatactttattttgattaataaactaaagatgtgcattaagtcttttatttcatattttggaacacaatgaaatgaaaatattaacagaataatcaaattataaaaaggtaaaagaaatgcaatttttatattttggaaataacaattaataaacaaaaaacatttaaatacactataaatatctttagaagatgccaagcgcgcgttggtaatattctcgaatgttttcagctccttcatatttcccataaagtcgaagtgcgatttcttcttcactgatcccttggcagcaatacgagtcaataccttcgcgtctccaataatatcctgaaataagaaatggataatgttcagatacatacaaatgaccttcgtcaacaactttcgaatctgaaatatattctgaaaattcttcgtatttagaatacccttcaatttggagatatccacttcctgtgtatttcgtattaatatcttctttggtgttatgtgtatataatccaaaaattcgatttatatgcacagtgacttatgaaacgtaaaaaatgattgtcgactactgatgaactcttcaacgcatttctgaagatcgctgacaatggcttctgacgtattataccatccaaacgcagataattgcgatgctgttactgttgttgtccaacttggcaatggcgtcggagctggagttggcgatgatggcggcggcgcttctgttggagtatatgtgtttgattgcgtaaatgcttctgttggagaaaatgttttagaaggagtagctgtcggtgatttagaaggagaagctgttggcgatttagaaggagtagctgtgggtgatttcgaaggtgaagctgtcggtgatcgtgatggtgttggaagtggaactggaattaagagaacttctccaacataaagtgtgtatgggtatgctttcatattggatattgcaagatcttccgttgtgagtccatagtttgctgcaatcactgaaagcgaatcacctgatttaactgtatatgtaacatatgttcttttcgcttctttaatattaagaacttgtccaactgtaatgaagtctggatttgaaattccgttccattcttgaatttgtgcaattgtgacactaaaaagttgtgcaattgatgttaatgtatcaccagatcttactgtatatgttattgcaactgaatttgccgctgttaatagaatcaaaaacatttttgaaagaattgtgaaccgaatttctcttttgaagcattccgtttttattgaattttttttttgttaactttttcagttaattaactagtcaataaatatcgctcgactaagtttttcattatagaaacaatagtattatatgatattggtgagcaaacgcttgttattgtgcgagaatattctcttctatttattatcttctattttctcaagtggaaaaagaatgaattttaatttgcatattaacagttatataaataatttacaaacaaatattatagctgcctcagcctcttcagcaatgcatttgtgttgtatgccttctctattgcccttgcctgttcttctatattcggcacaggtatttccggaagggcaaagtaccattgatcgcctcttgacccgtcactttcttcacacgcgttctcagcttgttcattctcacaattctcattttcataattttcaggttcctcattaacataattctcagtttgttcattatcataactcacattatccatattaacattttgtgaattttcgcgttgtcttatttcttcctgtggaatttgcaccgatatatcactaaacaaatccgatgcgtcgtcgtcaggaataacttttgctttcaagttaccatttatgattatagcataaaggtccatcatatgattaattgcttttctctttataagctttgccttatgcatttcgttgatttctttttcgggccattccatttcaagtttcggtcctcgattcattacagtttcgaagaatgtttcatatgctttaccggaatcaattccattattagcaaatacaattttgcaaagtgttttgttcgatacaaggaacttcccaagtgccaaaagtccttgtgaaccaaaatcattattactaacatcaaggaatttaagcgtttgattcttttttagattagaaaaaagtatttgtgctgaatcttcaagttgtgcatgttttgttccttttattgttaatgattctattgttttctttgcatttagaaactctgttaaaacatttaatatggaattcgaattagatgaaaaacatccgtttaaaactattgttgtgagattagaacaaatatgtaaatattggaataattgcgtttgaacattgttttcagaccatataaattgaacaagtgattgacttggaggaatgctttggattttatggtaaaattgattccattgttcaagttgaatatgagacgatgacaaggaaaccgttaactttcttgatgttggttggtgagtcataatagttttgaagatagtcgagaaagattgtccttcccatgtaatgtcttcgagcatgattgtgctcagttgtagaggcaattgtggggcctgtaaattagttggagcagatcctcctttgatttcaagatattctagttttgttctggataataattggcacagctttccaacatctacatcacattcaatgagtgaaatttttttgagagatggaagcatttgaaaaattgtatctaaatttaaatctcgagtttttttgattgtgagtgctttcaaagataatagcgcaagacaaattgattcatacattaagaattgttgaaaaacaggaccacacattgaattatcaaaatcaagttcttcaaatggaattgatctaaatagtttttccaaaacagggaaatgatctacttggaagttagctctgcaaaaagtgatttttttaagttttccttgaggattagaagctaatgcttctgcaactcgttctaagtcctttgatgctggatcattagtaacaacatgatttaatgttgtatttcgccgaaggcaattcgctaatgaggtccaacatggggtatattgagcaattggaagaatcaatgtgaaaatagttggctcgatttgaaggcaatcaagaagtatatcagtgaacccatcgaaattaggtaataagcctatgtctaatgtgtgtgttttacatataatttttgataatcttgtttcaagtgcttttggaaattttttgacatgaagtaatcgcagctggaacctaaatcgattaatgaaagcttcatgttgatgttcaacttcagtaaaagaatcatctaaattaacaaattcaggatattcagatggaattaaaacattcttgatatgcttaattattaacttaagaaggtattcagctccacggtgagtgatcgtatatgtttcaatattggacgatcctgagaatatgaaggtttctttatcaacaagttcgatttttttgagattgttccaaaaaagttgaccaactacagagaggtttttggaaaatgttcctctctcaagaatgaaaaatccaaattctgaaacaagcatacatgcatttatttttttgttttttcttcctgtatggattacattaacacaacatataactttttcgtcttcaaggagtcctgcaattggagcaacagcatccaaaagatccctttctatttccattttccccaaagtacactactgaatttttgaatgcaattgaatcgcattgtaattctttttttgtgagtgatgaaatctatacgtattcaaaattgattgtgttttggaatattttttcaattttgaatgtttaataaccgatacaactgtgaggcacaatgaaatcatattttcttcacaatgaaattaatttactttttaatgtgcccatacttaaaaatcgacatctgcgcaattattacacacatgtctatatgaaaaatttgaatatttttattgcattataaaatggatcttaattacgacatttcaaaattacacctaaaaatgtatgggaaaattcgtaatcataattgaagaatttggaatgattgatataatgatttgtgatgaaccaacctaagttacaaaaagcaaaaaaaatgaaactgtttattatcaatgtgtttgttttggccttgtcggtgcttggcattacaagtcaagagagttcaaattcattaccacaataaacacaatgcatacaccaactactgcaatcacaaaaatagctatgacgaaagaaattaattggggacattattttcaaaattaaggagcatagcatttttttagagctatcaattctacgaaacattaagcatttgtggtgatccataggttgatacaaaatttgcaaaattgaattttaaaataaatatacaaaatttaatataaatattacatcatccaaagcctaagctcacatggctatcatagaaagtatgtgttcgagtgatctggatgcttctcacacaatataaatgatattttgttacttcaaaatcagttggatggttattattcagagcgaaattaaattgaatcgaattgggttgacaaataaatttcattatatccaagtagtaataaaaatttccttcgattacatgaaatgtgttgatattcataatatatattcaataattagatttgtattatctggtgtatatatttacaataggtattagtattaaagttagaaaaatttgaaatagtttttgttgggttccgccaaaattcacgaaatcctggcggttgctgtaattcaattgaatgaaacaacaccaaaattcaataaagttgttgtaaaaacaatgcttcaaaaaaatcgcttttgattttgggttgttgtcaaattcaatttcaattacaacggctcgtttcgaaccgattctgttcaattttttatcaaaaaattcaatttctgaacgaattcaaatattaacggtttactataattctgtccattatcatgattcttgctctgctcataatgccttcatttcaagaatattttgatgacaactccactttaatagtatatgagcaagaagatcttgtgaattcaagtgatattaatcacattttcatatatggcggagttacagatattggatcatggaaattcgaagataacattaacctgttgacaatatacataggagattctgtcgaaacaattaggcaaggggcattttttcgatgttcaaatttgtcatcagttacgttcggtaattcgatcacaacaatagctgaatatgcttttagtgaatgcaaaaccttattcaatgttacattacctgatgcagtgacttttcttggaactgtagcatttgcttattgctcaaatttgacacttttagttctcagcaagcaacttcaagcgattcaagaacgaacatttaaattttgtgcgaatttgcaaagtgttactattcctgatttagtaacatttataggtgaagaagctttttatgattgtccaagcttaacaacattaaccataggggaaaatgtgaggacaattggagatagagcatttaagaattgcaacaatttacttaatgttacgattccggattcagttacttcaataggccaagaggcgttctataattgcacaagtttaattacattaatcattggagatggccttacggaacttcgaggtgacaaatttatgtattgttcaaatttagaaacacttatcattggagataacattacatcgattggatccgaatcattcgatggatgcgtaaacttaaaaacagttatacttggagaaagtgttgaatcttttggtgttcgagcattccgcggctgcaccaacatcgaaacaatttatttttacggatataaccagccaacgtttggatcagagtcatttcttaatgttaatgcaatagttataactaatgatgaatacgaaggaacatttaatggaatgacaacaatcaaaatcggagatctaaacccgatgcagacattcacaagttcgaacacatattctcaatcagacacttacaccaagtcgaacacatatacgaaatcaaatacattcataagttcggatacattcacacgttcgaatgcattcacgacttcttataatgtcgatttcacgctcacagttacgtatttgttatcagtcacaaactcgttttctatatataattccacgaagttgaacacattcactttgtcattacttgagtctgcgcgtacttatgttccgatggtgattataatctatgagtatacaattgttcggtatccgacgtattacgaatattattccaatttctttatagctgcgaatgataatttggaggatgtcaacgataacaaaacgagtcttcacgttattgtcggagttgttatcgctgttgttgttgcatttgtgattgctatagtttttgttgttgtgatgcgtaagcagaaatatgtttcatcagagatatcgaacaaagatgaaaagcagaacaaagtcgaaatgatggatactgtttcgggattatcgctcgatcatattggagaagatccattcgcaactgatttccaagaggaaaatttatttaatataacttaaggacattttgcgtcttctttgtgtgtaattttggcgttttttatgttgtaacatgttgcgaattatgcgcaagatgaaaatgtttattttgtattcataatttacaagaagaatccaatgttgaacaacatattaaatttacattaagtgagaaaagcctaaattttccaattcaaaacataatggatgaatttgatccaaatttttcatatttatataaaataattatcgataatttagtttattgtcgattttattcaaatgtttaagtatggtatttatataattttttgaaatatttcttattcacaaaaggaattctatggatttattctttgaaacaatgttttagttctccttacttagtgatttagtgatttaactgtgaagcgatttccgatgtaattaccattggctatttcatcaatcattgcaacagcataatcagaatttgatattttgctttcacctttttatatgaatattgtttcattaccacttaacctaaacttaccttgtttttcacctggataaatttccattgatgagcataatactgttcctggaacaaccttttgctccaaaacaagtgtaagcaatttagcatatatgctggtgggaaatccatatttcgagtaccattagttatgagtgtacctgcaccaccaacagcaagaagacgacgtgcatcaacttttttagctgcttcaattatattctttgttgaattcacttgaagttcttccattttttcaaatgttgaattttttggttgacagtaaacatgaacagcaatttcaacgccttttaatgcattttcaagttcatgtaaattaaaaatgtctactgaaacatatgtgcattttccttttggtaattcttttgatggattcctgctaatatctatcgaatcatagcctcttgaaacagttttttcgaatatgttagcaccaataacagcaactttcatattaagaaatggagtgattctttcttcgcacccaaacttgaatgctcgacgactggctggacgctgattgcaatttgtcaaaatcaagcaattattgccaaaaattaatatgaatgattttaaaatctttaactgtaattcaaaatgtttttattattatattatatatattgatcaaatttaaattcaattcacatttgttatattaatataaatattattatatattgctttcaataaattcaataaataacacatttaatggatattttttaaaaaatatcaaaataacgaattccaatcattactaaaattttttaataaggtatcatgaattgatgtatcagaaacagcgaggtcaagcaaagcccaaagcatgcttaccaagtttattttatatttcatgtcattcggctcgttcaattccgttcaatattgaaaaagttgttcaaaggatttgcgaggttttatcggataatttaccgcaaccgatcaagtgaaaaatcggtagttgacacaaaaatgaaaggagacctttttttttctcaattatctaatgtcagttcaattgaaactcattcaaaaatgcttgaaattttcatcacttcacttgtctgaatgcagctacatttacgtgtgcttgaagcattagatattgccaaaatggacatcagcaagtccgatccttattgcgtaattaatgtaagttgttcaaatgatacaaggaaaacaagagtaatcgaaaattctcttaaacctatgtggaatgaagaattccattttaatattccaagccctgcaaacactacgctcaaaattttaatgcgtgatgaggatgttcttaaggatgatgatatggcaacacttcaggtttaactttgctcacttccagttggtcaagaagtagaccaatggtatgatatgatcccatgtgcaaaggttaagaagggaggacgtattcatctcgtattacatcttgctcccaatggtgcaccagcattccaaagtgctcctcctccacacggtcctccacatggtggaccagaccttctagcaagtggacctccatttcctggtcctgttcttggacgaccatggtaaaactaagtaaatccaaacacaattccattctttttattagaagaaaaggaagaaaatttttaaatatttttgtaaaaaaatatttgatttaaatacagattttgcttaagaacttatatatgcatctacaaaattgtacaattttttgttgcatttcttcttaaaatgaacactattaatagtactaataattaaatttgaatttgaaaatataagaccatttatggaatgaacaaagaagaaggttaaaattctataagcttaatgataatctttatttattttctaaattataaagatgatgatcatcaaaaaaaatttataatcaatattttttaatatcacttaaaaaataaaatcaaattagtttaaataaagaaataagtccatggtttgatattaatatgttttttatttcccaaaatccaagctggaaaaaatagaattgtaacgtgctgtcacttttcggttatcatttaaaatgtcatggctttctgatcttgatcaacttattgagaagcttcgacgctgcgagtatccttctgagggcgaagttcaaattctatgccaaaaggcaattgaggtacttgctgatgaacctacagttaaaatggtacctgcaccagttacaatttgcggtgatattcatggacagttttatgatttacgcgaattattctttgttggaggaaatccacctgaaacaaattatttatttatgggcgattatgttgatcgtggattttattctttagaaacttttcttctacttctagcattgaaagttcgatacccatcgagaatgacaatgcttagaggtaaccatgaatcacgtcaaacaactcaagcatatggtttttatgatgaatgtttaaggaaatatggtaatccgaatgtatggaaaatgtgtacagatgtgtttgattgtcttacgttatcagctgttgttgaaggccgcattttttgtgttcatggaggattatcaccatctattacttcattagatcaactaaaagcccttgaaagaaggcaagaaattcctcatactggagcaattagtgatctcctttggagtgatccagaagattcaattgaaggatttacaatttcaccaagaggagctggatatatcttcggacccgatgttgtcatgcatttcaatcagcaaaataatcttgaacttgttgcacgttcacatcagcttgttatggaaggattcaagttgatgttcaacgatcaacttgtaacggtttggagtgccccaaattattgctatcgttctggtaacgtcgcttcaattttggaagttgatgatacaatggctaaaagtttcaaaatatttgaagctgcgcctcaaagcgaacgtggaggtgttccagaaagaactcttccggattacttcctttaaggagttgagacacaactgttgatgttggtacaatacaattaatcaaaatattagtattaagtataaattcctatccacgcaaatgaattctttgatcatttataatcttttatagagaaaaagtgaaatccgaaaatatttgacacaattattcatatcaagtcattgaatttcaagtgaataaaatttttttaacaacaaatcttttcagctttcattatattatttaaaagtgctgttaaaagcattttattcttgtgttttgcttgtacactttaaatatcgattgaaagattcgatgattgaattaaaaaaatttaaagaaaacaataggcttattatcttttaaccgtatgaattttaacttttgtattggccgatgtgtatttggtaaaggtcttcaattatatttcatcttgaaaaatgaaaatccttcaattcctcctcattttgcaggtctcaaagcaatttataactcatatgaagcttaaatctccatttttcaaacaaataaaatttttgcatatgccaaaaggcagaaacaaagaagaacttgctcatgctcataacgtggatgttccaatctttgaaaccataaccaaaaaaaaattaattttttgcaatatttccacagagttcaccaaatgtcatttagatgcaaaactcatcttaaaaaatatatgtgcgatgccaatgaaccatgttttaattcccaagcaaaaacttttagaatcagattttacaatatctcataaacaatcaagtgaaatcattacatttgatcaagctatccttcccctacaaacagtggaccaacgatagcggcttatatcaaattccttcagaaaaaagtttatcaaaaagatgatgaattgaaaacaaaagaaaacaaaactaaaaatttttagttcattttttgttttagttcattttttcatgaattcttatcaaataattttcaattatgataattcaacgcttttaatcgaaaattatgatgattttaataatatgaatatttcttcaaatatgactgaaaatattatttttggtgaaaacattactataattccaagtagcacatttattgaatggacatttgttgtttgtgtcaattttagtaattcagtaacaaacattggatccgcagcattttcaaattgttataatttaacaattttgacacttggcacaggattaataaattttggagagaagatatttgcaaattgtatatcactaataaatattacaattccaaattcagttcaattcaatggaacatcagcattttcaggatgttatgggttaaagataataacacttggcccaggattatcagtgattgcaaatggtgcattttcgcaatgttataatcttaaatgtatttattattacggtactttaccaccatcgattggaggaagtgcattttcttcagttaatgcaacagtacttacatatccaacatttgaaaatgcaaaatttggttcatttacatttaatgattatgaaggaggagtatgcataccattgtttacacattcattttcaagttcaaatacatatacacgatcaaactcattcagtaaatcaaatacatatacgcaatcgaatatattcacaaattcaaatgcattcactaagtcgaatacatttataaaatcacttcaaagctatttaactttatcattttcttatataataaccatttcagtatctatttaccaattcattgacgatttatgaaacgcaaataaaatcattttcattatttttaagtaattcaatgttttcatatattgaaactagttttatttattctgattacacaattgttatttatacaacatattataattattattcaaatttctatacatatattaatataaatgaattcctcaataatgataataatataacgacaacgattattattattatttgtgttgttattataattataatcattataacactacttgtcgtattattgattcgaattcgaaacaaaaaatcagaaaatattaaaaacgaaagttcagaagaaaatgaaaacaaaaaagaaaccacaaatacatttgcaacaggaatttctatgtcaacaattgaagaagatcctttcgctgatgatttcaaagaagataaatttattgtgcaaatgtaattttgtttaaatattaaatatgaggtaataaaactattttctttttagaataaacattaaatttcttttaaatatgtttgtatatcattaattttaaaattaattaaattttcaataacaagaaatgcatttttaaagaaaattgaaagaataaaaaaatcacattttttgtaaattatattttttttaagagaattattactcaaaatatatgtacgaaaaagaaacgaacgctaattatacagtcttagcttacaattgtaaaaattgttatgagatatggaaattcttttgaaaaggtttgactgtaaaatttattataaaaacaaaattttaataagaatcagattgattcatttcatcaagttgattttcaagacgcttcagtaaaagagaaagatcatgcattcgatcttgaagggctttttcttcaattctttcatttgatgattctgttgagctaaagtaacttttttcttgtgattttggagttgtcatatctcctaagcaagaaacatcaaatgagtcatcttgattttctgtttttttagtgatgatcattgagtctgaagaatcatcaaatgtgatttctgttgtttcggaaggacttaaaggagattgtttttgtaaagaattttcaatagctgtttgagtttggacacttctgtattttaatggtgaagattttttagtagaacttaatttatcgataattgatattgcatgtaacaaagtattttttaactcattataatcagaagtgagttcttcttctttagaaatatttatggtttcctgatcttcatttgaattacttttatttgaaattggtgttgacaaatctccaagatgaattggatgatatggagtatctaatggctttaatgctttatttgttataggtgtaaattgctgatttaccatagctaaatgaggatcatttttttggtatttcatattagaagttcgtttaaaaattttgaaaataaaattcagtatgatggaagacttattttatggatttttcgtagtaaataaaatttcaatgaagaagtacaaaagattcttatgctagtaatatatataagaaaaatcatgatttctcaaattcccaattaattgccaacaaaccaaaaaaaactcaaagaattcaacagaaaaaaataaaatcaatgataatttgtatttagttctttgcaagttgttccttgacgagttgtgcacgttttgcagcgagtttagcatgcttgaagcgttggaaatcattcatttgtgattttgcagcagcagctttaaggttctttccccactttgtttcttcaaattttgcaactgcatcagcatccttaacagcagcagcaacatcttctttcttagcagtacgttctattttaacaacgatatcagtaagtttgagacgtttgattgggatcatttgacgtggttcgttggatccaataacatcgatcataacacgtttatcatcaactatatcaacaattacagcaagtttatcggcaagagggccataagaaacaagtgcaactcggccaaattcgacaaattgtgtgtaaggcatccagataaaaggccgtattaagacggttacgaccgtttaacacccaaaaggggcaccccgtttatgccttaaaaaattttaatattaaaatcattctaaagtcatatttttattgtttgaaaagttcactgcaaggtattataaccattgtcgaagtatcataacacacaatcacgtccttacaatttggatcaatacttatacaggtcacgcatccctcatttgcataagcgcccaccatcttcgcctcaggcattttccacacagcaatgatcccatcgttaccgcctgtcaccagaaactcgccggacttaaaccatttcatcacagacacaccgtcagtatgatgtgcgaaagtgcaatgacaattaccgctaattgcgtcccaaattttaacagatccatcgattgacgccgaagcgacgatgtttgggattttagggttccaatcaatagaagtgataccatttaagtgcccttttaatatttgtatctcgcgttcatctttccatatatgtattgacccgtcattgcatccagtcgcaaacaacgaattatcaatggagaagctgatggagataaatgggcccgaatggctatgaagtattttcttgtcgccgctgacagtaaataagccaatgctcttatcaatcgaggccgtcgcaaatttgccttcgtcacgccaacagatgtctaatattgcgtcttgatgaatttgatagttttcgacaagatgtggttgttgatgcagtttgacatcccataacgatatggaataatcattaatggaacatagcgcaagaagattgtttctggggttgaattgaagggcggagcatccttgcgatatatgtgaaattggatcgccgcgaaatgtataaatggtggtctgtgtaaaggtggcaacagctaaaaggcttccgtcatgattccatccaatggatttgggacagcgagatttaagagattctggagttccaataactattttgtcaaaaaaattgttagatcgagtccaaatggtagcaataccatcagattcaagcgtggcaaattgagtaccgtttggtgaccatgaacaacattcaattgattgggaatttccattaaagaaattgaagtgagtggaagcaagattaacaacttctacaccttcactagatgctggagttggctctacatttgggaaggaactgagaatattttgaatttcattttgtattttcggatctgaactagatcttgcctgtttaattgatttttctagttttaaataaattagacttttctgtaatagtgttattaaagcatttgggggaatatgagatccattaatattagttgaatctgcaaggaattctgtttcaaaaacatacgctgaatgaggaaattcattctcctgcatatagcgccatattaagaaattaacttcatccatagaaatcgccattttgcttcaaaacgtgggatttttggtgtgccctaaaaattttaacggtcgaaaacgttaccagaaaaaggtttaatgagtttaaataaatggattcttccttcagaagtaatggcacataatattgctgatgactgttgggtttcttatcttggatatgtatgggatttaacagaattagtaaaaggatatgaaaatgatcctgaatatcaaccaattatcaaagcagctggatcagatatttcacactggtttaatccggccacaggagatattagaacaatgattgatccagaaacagaactcgaagtcccacatcttccttttgacaatttacttcatctacctaaaattactcccggaattggtactcttcctccagaaaaaccatggtggaaagaagaatcaaggagaattgggaaattatctaagcatccacgatggctaagaatagtcaatacattaaccggactcgaagaccaaatcgaagttgcaggtgaagagccaattaatgatatacttgctcgctataaaaaaattaattcacatgctgaatcatacacatggaaattccttggaaaagaattagatatggaaaaaacgttagacgaaaatggaattttagatgaatcagataagtttgcaaggttaaatttggattatgatatgtacataccagcaatccttatttactttaatgacgatttaacagtagcttagatatattaacgattttggatatttaaaattttgttttatgaattttttctatctgttgatacagtaatttggatttctaaaaacgatttaaatttaattcaattttgggctttttatagttccaaatggatattttacttattttcttccttttttcatcatgaaaatttcctgcatatagagaaaatataaattgccaataggaagatcagtaatatccatgcaaaaactttgtttaaaaaggctcttaccagcattaccttgaactttaacttcatttaaattactgttaatattctctatcatgttgcggtcttccccaagaggagtcataatggtgtttgatgtaattggttcatttccaactgcgatagcttcatcatgattttcaataatctgatttgatttttggaagttagattgaagtcgaaggttttgcttataagatggatcattaactagtgcttgtttttttgacgaagattatcaaccattagaatggtttttatttaggcattataatactcatgttctaccatcgataaattcaattaatcaccgaaatatctaaatacaaaatatgttaaattgcaaacacctcaataagatttttatattttagtcagccaattttaatctttcgtataaaaatggaattgtttttattcagtcatttgcatgcaatggaaaaactacttttcagctacgtaaaaaaaacaaaacataaatgtacttattggtattagttgatttaattgtatctatacatattggaattgatttgggaacatataactcaaaattcttagcaaataaagaatttaatattattccttcttttttgactttcacccaaaaatatgaaaatttggagaaaatggctaagctttctgaaactggaataccaattaattatgttattggtggaaaagctttaaattttttaaataaacttccttcaattggaactggttatttttctttgatgatgggtttatctgagaagaagaaaaaggaaatttcttctctatttaacattccttctgttatttatgaaatgacacatgaagaaataataattatttatcttaaaaaatatttttcaagtattttaagtaatgataaaattaataaaatatcaattgcaattccttcatatttctcattacaacaaatttctttattagaaaatgcaattaaattatgtggtatcaatgatttctttattattgatgatatagatgcaataagaaatgtgtatgcaatagagaaaattaatgaatttattaacaatcctttaaatgttttgtttgttgatatcggagcaacttccgttaaatcttatattttgaagttttattatgaaaaaaatcgagcaaaaattttaaggttatcatatgcttatgaattatatggaggaacatatgttacgaacaatatcgttgattatattattaaaaaacaaaatattgtttcattaacaaatgaagaaagacatagaatttttttagaagctgaaaaagcgaaaataagattatcttatacttctttaactaacatttatattgaaaatgtttctaatacaaatattaaaatgattctgactagagaagaatttgaaaatccaaaaatatttggaaatttagaaaaatcgattttgaatgtaatcaaaaaatcttcatctggtatttcatttgataagattgaatttctagggaactcatctttgataccaaaaatacaaaaaattattcaagaaaaattcaaaaataaaaaaacaagtatttcactaattaatgaaaacataattgcaaaaggtgcaaaatatcaatcacaatattcatatggaagcaatcaatatatcccaaataataaagatccaacttcattatacactattaatataaatggaataaatgtttgtaaaaaaggacatgaatgtttaggagaaataaatttaaataatagtgttcttgaatttacatataatgctaaagaatttttaattgatgttgattcatataagcataagtacgttgtaaataacaccaaaaacgaatccataaatattaaatttgtatctcatccttttcatatatcatcaattatatcaacaaataatagcaccataaaatattcattccaatcttcatttccaaaaaatttaaattctttaatggaaattgtaaatttttatgataataaaaaaagaatccaaataataaaaggggacattgatcatttgattaaaaaaattttacatgaaatcggcaataatcttacaatacgtgcttttaccaattttgatcaaagaatttcaattattcgagaagcagagaagcagaagaaatggatcatttcagaagaagcaaaagaatgtaataagccaatagtctttgaaaaacgtctttacatattaaaaagtttgatgacagatgcttatcaaagaatagaagaaaatcatacattttatcaagcagcaaatgaactttatgaaacaatcaatttatcaattcaaattgtgcaacaagttcgagataaaaagcttcacgatgatagaaaacttttatttagttttatagcacatgcagaaaaaatttttatatgggcaaaaaacgcaattgagataaatcaaaaagcaaacatgtgggaaaggctaccaattaatcccaaaaaattcatccaaaagaatagaaagcttcaattagagtacataagaatctcaaacaacttcattaaaaaagtcaacacaggattaatagatgaaacagggaacatgaagtcagtgaaagatattattcgcgataaactcattaacacaacgtttatgcagcaagtgatgaaatatgaaaaagaattataatattaaattaactaaaaatggtttatatcattttttaaatttacacattaatgtgtgaaatgaaaaactcataactcttcttggtgcaaagtaaaccaaagctatttttaaaattaataaaatttaaaaaaaccatcatttttctcagagtgtttaacaaaaattctcgacaaaaccacattgcttaatcaattgtatataattatccagtaaatctcttaacacaaatcattcttgaatttgtgcgaaaacctattaagcctgtctcacacacagtgagttagttaacatcatgtttgactgttctatgtgctcttttgacaaatataatatcttggctcgaaaatgggatggacagctctttttctacaattacacaaatgtttttttttatttgttcaacaaattttttatataaaaagttgttttacaaaaacatataaaacaatttttaattctactaaaattttatatatttacgcacagagaacaatcaaatgcccttcttaagcatccactgcataagagaatttagtattgactcgctctttctgattgacttccggtggaatgagtttgcatttcttgagatctttccgaatgatgcagaatttctcagaactttcttaagaatgaaaggcactgcttccacgaactgtccaagtcctgtttgttggtcatcacggaattgtttttcgagcaaattatggatttctttgtcagatatatttttcttatgttgaacattttttgcaacttcttcattttgttccactattttgtcaactgacactgatgggaaatcctttaattctgcgttagttgtgtcatctttcatatctaatagtatatcttgatcatcagaattttggaaggtatatctttgttcgaaatagcttaagtcatccaagcttgaaaggactggcttaaaaggtggttctactttttttaaatcaataccatgataccaaggatgatttaaaatttcgtcaacacctttagctcccaatcttttttcagggtttggcaccaacaatttcttaattaaatcgattgattctggggataagtcatcagcttcatcaaagttgatttcacccgtcaaaatattcttaaacgtcttctcttcagttttcccatggaacgggggtgccccgagcaagaattcatataacatgacgccgaaagaccaataatcgacagtataagaatggggcttattcaaaatgatttcgggtgcaatgtaatcaggtgtcccaactacttcggtatcgttataattttgtctgtcagaataacccaaatgacttaaaccgaagtcgataagttttaattttccatcttgagccactaacacgttatcaggttttaagtctctatgaattataccgttttcgtgaaggtactttaaagcgtgcagaatttgcaatgagtaaatttttgctgtttcttcatcaaaagaacctactttttgtagtagtgaatacaaatcaccaccaggcaaatattcgtttactaaatataagttatgtatacccgtaaatgagtaatctatgtgttagttattaagatattatcatgcaaaacaaatcaaaacaaaacaattcgttgtcatttgattcgtttcatgataaggaaacatacagaattttacgatatatggattattaaactttaaaagtaaatccttttcaatcattatttgattaacttggttcttaaacttggtgctctctttggtgacaactttaatcgcatatatgtcattggtgacttttttctttgctaaaaatacgcgcgcatacgcaccagacgaaattcgtttgatgaattggaagtcatcaattgtgacttggttatactttaacgtgtcgcctgtcttaatcgtgttcattaagacaaatgatgctggctttaaacaaaaagaaagatttatcttctgttggacaatttcaagggctgagtcaatgtatggaagaaatgttatatcaaatggaatcttttgaatatcccacataagttgcttaagatattcggtggaatcatagttggtaacatcaatttcaatgattttggataatattacttgcgtatgaaccgctggtaaaagaatcttgatcgctaaattcttttcattaggccattcacattgtaaaaatttgagcgagatttcatcgattttggatttgagggcattctgaatggcattagtatcgatatttgatttataaattatttcacacgatttgatatgttgctcaaataaatctactggtatctcctgattgcaaagacgacagacttctgtttctttataactgagattttcagcaagtgatgttctggatgaagatcttctattaaaaaatgtttccgcaagacttgaataaaattttggtaattgcaataaaacgacattaatctcaagaagttctgttagaaatttatgcgttttttcgttagtttttttaacaagctcaccgatttttaaagtgaaattagcataattttcaagtaattccttgtaagtgtattcagtacattgccgcatatattggttggcttctctaatgtatggatctttttcattcggatctgtatcttcaagatatgctcgaatatatttttttttatctaatgcaatgtcatatatctgtgatgaaattgccatataaagctcatcaaagtgcgtaaatggcacacaggactgcattttgcagaaatttgacgtttttaatttgagaatgatcgttatctgaaactttatatcaaaagcaaaaaaaccgcatagaaacaattgaaagtttgaaattgttgttttacaaaaaagtgtgataattctgacgactttacggttcggttccaaggttttcaatgctgtcagatgtcataatgcctcattcaaaaccgaagattttgaaattcggagtttaaccgattatacgaaaaaacaacaaattaaccgaaacagtgatcactgtttctgactagtttataatttatttgtgtaatatcggaaaagtggcaaaatttgggagaaaaaacagatacacaaatcgtttaagggtaatgattaaatggaattcctaacaacatcgccaagaaacgacagatgtcttgtgtaaatagtggaaatgatcattcaaatattgacttcaattatgttatattaaaggcaaaaatctatttctgacagtcacaaaaatgatacaagcttagtgcctttgaacttgcaccaactagggagtggttggatgaggcaaaactggaccgaaattgaatttttttgaatccgcagctaagctttgatttacaaatttattgataactttattttatatgaaaaagtgaaatttggatgccctcaaaagtgactcccttgaaatttttctaggcacgatttgaatgttgttttttggcactaatgttaatcttaagtaaacagaattagtagtagctgaagaactttaatattaaagtttgtaatgtggtgtttatcattaatatcaattccttcttgttcaagaagtaatttaactatttctaaataaccatttgaagatgccgacataagtgcagtttcaaattaattaaaataatttccagatattattttgatatagataattattaaaataaatattaaataaaacaaataaatatctttagcattaatatcaattcctttttgcaagaagtaatttaactatttctaaataaccatttgaagatgcaaacattagttctgtccaaaacaaatcaaataatttccaaatattattttgaaatccaaaattatttaaacaaattttaaataagtcaaataaatatctttaacattaacatcaattccttcttggtcaaggagtaatttaactatttctatatgacctttttcagataataaatgtacatttataattgcaataatttaattttattttttttttcttcctcaatacaaatagtttctttattgatcccataccaaaaaagtctatttaacaccaaattttaaagtgcaaaactaagtgtataaaacatttattaattttcatcttcttcctcttcttcttcacgttttctttctctttcttcctcctcttctgcgcgtcttctttccctttcttcttcctcttcttctcttcttctttcttcttcaattcttttccgctcttcttcttcagcgattttctcttttatgtattcttctgcttcttctctttcttcttttgttacttcatcttcatttaaatattccaattgcttaaagttatatacaatgttcaaccatggctcttcttcattttgcatcaaaggatttccatcaacatttaattgtttgagattttcatacttatctttgtcgttaagtatttctaaatctttaattgtttgaatgttattaactgaaagatttaattcttgaagatttaagagttcgcaatcaaatgaacttaatttctttatggagttctcagagagattcagttttcgtagcgaattgagatctttgaaggtttcgttttggatgaatttaatatgattggaattaagataaagacgttttaagttgaacaaaccactaaacattgtagattcgagctttctaagattgttggaacttagttttaacgtttgaagatttggaattccggaaaatgcatttggtgaaattgtcttaattctattgtctgaaaggtcaagcttggtaagaagtggaaatggaagaactggcagagaacgaattcggtttccattaagattaatagttaaaagattggaaataggttttggaaattctggtaaaaatttaatatcgttgttatgtaaatcaatgtaaacagcatcagtcatatcgcttaaaaaagttgcttttctgagtaaatttgaggataaagatataaaacgaagatgagaataatttgaaagaattgatgcatctttaattccagaatcgttcataactaattttgtgtacgcatattccatatcattaggggaatcaagaatacctaaattaggaataagagtattttcatcaagaatttctccttcaatgtcttcctcttcaattttttcttcttcctcgatttcttcttcctcctcctcttcctcattatttttttcgttatgagtttcttcttcaaaagagtattcttcttcttccatcctgagttggcacttttaaagacgaaatgaaaacattaacatgaaacgaataatattagggaatttttcacagaatttttttaagtttagcactgcataatagcatatgttttgtaaaaagtgatatataaaattttatctatcataatttttaattgaaaattaattcgttaaataatattcaaaaatcgtaaaaaacttttataatataaaactttttattattactctattaagaaaattcaggattatctcccgaaatcaataaaaataaaaataacatgcgaaaagaaaaaacaaaaaatgtcctgatggggaatcgaaccccaatcacagccgtgtgaaagctgtatcctaaccgttagaagatcaagaccagttcgaaaatattcttcaagtctgtaatttaaatataaaaatttcttgtcgaacttcaaggcagctaattcaacatataataattcgatttctccttaaccagcttcaatgtcttgaaagaaaagaccataccaatccgttaaaatcacaacggtatgttttaaaattatcaaaatctaatgattccaattttatttaattatcgaataaatgaatatcattaaatataaatgatgtaaatgaatatttaataaatgatatttactcacaatatgtttttcacatacaaaaagaacccaataagcagttgttgctaataaacatttatttaaacgaagaaaattgattactaaataatcctaactcataacgaaacaaaaatacaatatgaaaaaactgaatttcatgttttcttatataacttttaagtggaacaaaaacgaaattaatattaatatttaaacatgtttaatattttttgatctaaattaatcacttacatctgtatcaactttaactaaagaagcacaataaggacgcaaccagttactttcaggaattgtacttaaaccaacgcattcaatatgaaaccattgaaatggacatgattgattatcacaatttaccatatctccaattctttggcctctacatatgcaatagacatcgtcaattattatacttgggcgtaaatggattttcaccaacaatacatccatctcgagcttttggttttctgttaagcgtatttctttgatgatttcttcttcggcattgtttaatatttcaaccagagatcttgcggcttcaactctttgagcagcaaaatccaaaattaattgatacacagcatcaaggccttcagtagaaataaaacctttgctcttttctgaatgtgtagttgagggtttaatgatattaggatcagaaatagttcttgaaagtttttggctgattcactcttagcttccattcgtgaaatataactgtacctacgctctataagagtatgaagcctttcgagcccttggagttagaaacaaaaaacaccccttcagagcatgatcaccaaattgactatctttgtcaggaagatttaacgtatttgcaaaacaacttgaattatctccatcctgatgtttgcaaacatagcatagagttagtgacttatgtcattgaatgtattttaattctgttttacatggtacaaatcatttttgagtgagtaatcaatttttaaatttaatcagtgtatattacaaacccttagcagttcctatgtgaaaaatgtcataggcttgtgagtgtttttaatgtaaaatcattttcatcctcttttttgatgtgcaaaagaaattattgccaatttgtcctcaaaaaaacgaaaactaaataaacgttcttttcgaatgtctgattgggacatttttgctcctatccaagccaatcaaccagaccaaaatgatgttgatggcacggatggagtttttttcagggatgatgataatgagcaagaaacatttatttcacctttaaatgatcaatttgatgaaacagcagttcctgcatcattaaatccaagactaatacgaaataatgatgcaaaccaagaaattgtctccaatcatgttacttttgaaccagagattcattcttattgtgaaaaaaagattcatattaacaacgacattccgaactttaatagagggaaaggacgaaatcaacgtcagcgacgttttcgccgtgatatgagcgacacagccgatgtatcaattaccaccatttcccatgatctattagaaaatgggtttaacaaaaccaaatataactcatttcataactctgccatttcccagcgtaagcaaaatggcattgggaaatcacccgacatgaattcattatattatttctggtgttattatttacgcaatcactatgatgaagcaatgtataaagaattttataccattgcaaaagaagacgctgaacatggaagtcattatggcattgaatgttttttcaggttttgttcttatggacttgaaacaaacttcaatccatccgtgttcaaagatttccaactcgaagcactttgcgattatagaaatcgcaactccaaatatggaatcgagaagcttcgtggctttctcgagaaccaaaaacttggaatcgaaatcaaaatgcttccagaagttgaagttgtaatgaatcaattcccaacaattgaatcatttcaaactgataaaaagattaagtcaaaaagtattccaaaacaaagtaataacttcttgaaggcaaataatggtaatccaagaggtagaggaggaagacagttcgcacacagaggccaacaaaagaacataagaggtgcaagacaagcaaacgaaaagaagacacaaccttcttccgctccaaagttcgcatcgcatttggttagctaaatcatctttatgaattcattttttgtgattaaaaacaaattaatcaatttataaattctgtgaaaaatttatatttatcatcaatattgataagaatgtgggaaagtttattaagtaaagaccacattatatttatcaatgttgatagaatgtgttcatacgcattgacaaaatcgattttaagaaataaccatataaattacatggtaaaatctagttaaggcttttgccaaattatcacataattccaaatagttttcgaataaggaaaactgacatgacatgttatgtgaattaggccaccccattattagctaattaaactctcccacaataaaaatgtggtctttacttaataaacttgaaaaattcatggcaccaacaaacacaaataataaccttacagaattcaagaaatcttgtgatgttgtcttggaaaatataatggttgatgatataaatgattcaattacctttattggatttcttaacaatattcaggattatttaacacaagagcttgaatatgaagacgttccatgtatggcttattttttgaatgaatccattcttcaaaaaattgttgacttggttaacaaagatcttccaccagctcatgttgagcctcttttttcattctttatggcttttgttaccacaggtcttaacaaatattttgctcaaattcacattcatcgtccgttcacacaattattatcaaagcttgaaacgatttacttgattgatggtgctaaaacaagtcgttttgcagttgaactttggaataaattgaaagttaaaccagtttatttagaaatgatgacagatggtcattcatatccacttattgactttttctgcacttcagcacttatccccgaaaaagaacacaactatgctcgtgacattattttgtctataatgtttccatctgaagattcacttccagatatattcccgaaatatattgaagagaaattctatcctcaaatttctgattttatcatagcaacaattcaatgtgttactaccatccaattcaaaggatctcttacgtcacttttaagttgggttgatcaacttcttcaactcgccaaatcatttgatagctggaaggtcattcaagaaatacttaagctttctgcttcacaacagatgcttggtttctcttttcttctttcatatttttcagctcctgtcattcatgaaaaagtgcttgaaatttcggtttctaaagaagtgcttcaaaccgtcgcagaatgtctcaattctaatgacgatacgtctcaaatttctggcttagttttcttgaagacgttattaacttgtgattgtgacttttcatttttacttccgccaaagcccacggaagcttgtgacgtgttatccaatctacctgttgaatggttgatacaatgcgatggttcaacatcaatggaatcatatcaaagtgacgcagtttcacgcgttttgttctttgatgggatcagaaaagacggaaacaacaaagaactttttgaacaaattttggggttattgaaacggtttaattcaatttcgttaacggtctgcttatcggtaacccaattaataactgaatttgtgtcaattgctcctgatttaatttcaaaggatttggttgacgcatacgcagttgcaataaaacagtacgcaaatgtgccgtttttcgaaatgccaaatgaaaaatcatctgattgccctgaagtaagagctgcaatactggcagaattcggaaaggaaatacatacaacttttattgcgtatgaaaaaattcgatctgcttcttcttctatcagtcaaattgaatttgattaaaagtatttatcattaaattttaaagttttttcgataacaatttgacaatttgaaaccttttggatcctttttacagagatataatgaatgaaataaatatttttagaattgtgatatatcatcataatcgttcaaaagggcaccccgcctgttaacggttcgaagtcgtttaatcttctgcaattaatgaatcaacctttgtttggtcaaggcaaccaatttttcaaaacaacaagcacaagtaatccatcttccacaacatcatcatcaacaagtacaagtaatccattttccacaacatcatcatcaacaagcacaagtaatccattttccacaacaacatcatcaacaagcacaagtaatccattttccacaacaacatcatcaacaaacacaagtaatccattttccacagcatcatcatcaacaagtgctacaagtaatccaccttccacagaacaatcaaaaagtactttaggctctggacttttcacaaacacacaatcggttcaaccgcaaaaagtaaagcgagtgtgcccaaatgaaattatggattttatttctcataaaacagatgacctcaaaccccccttcgttcgtgatgaggtaataatgtggagtgttattctagaaaaatcgcaaaacaatgaaaaaattgaaaaactagaatatgaattcccaccagcagttaccaaacctacagagcaaaagcaaaccactgtcggattccaatcttcaaccacaaaacaggcacaacctgaacaaaaaattcaagttaaatatgagaattcttttgatgcagtttcccaagaaccagcaccaattcttacatctgctccatatttccttccgacagaaaaggttggtagcaaaaagaaaagtagtcttgatttttctcattttgtatcacacaaaacaacaaagcccattcaacacaaagaaaacttcagcaatttgttccttcctcaagtttctcctgttttggactcttcaattgaaagtacaagcgacataaatgagtgggaaccacttcgtattacaccagagcaaattaaatttgttagcgaaatcaaatttgatgcggcggttaatgtcaccgatacaaatttgccgccaaatcatttgaaatgttataatgatgaaggcgaaatatactttttacatatacaaaatatacctgatagtactcttaaacaaaatgttgatatatcaacacatttcataagtgtttcagatgagttgaaaaatcaattgggaccggcaattataacaataaataaaatgaaacttgaattggaagaagatccagaaagctacttgcaaaggaaatgccaagaaatgaaattggatttcatatcattccaaaaggaaacggaaaatttttccttcttcgcttgtgactttgaaaatgttccttttcaattttaaatgtaatagaaatttaatgaaataaaaaaattaattataaatttgcattttgatatcatgtacatagaagcaaaagtaaaaatggttcgtcaacacaatcacatcgaaaggtgtttttaaagttttttaattcagaaaggcgtcttttctgatcacttaaatttcgcataagatatgcagaggagtgcaatcttcccatttctattttaaaagcctttaaaatctaaaagtaaattaaatgtacattgtataacaataaacagagaggaataaaagaatcttctgatcaattttgcaaaataattattttaaaattacaaaaaattgtattcgatatgatcgatttcgaaagaaattggtaacttttattaacgttcatcatatagttcgaagcatcgttttagaatttcctctttatttctggaaggaagcaattgatgaattttttcaaaatcaccttgatagttataataatataattttgcaaatttttttgaaattctcagaatatcttcttgctttgggcttgaggattgagagcgaccccatttcctgaatcatccctccagcgaacgtattatggcttgttggtttgtagaattgatcgatatgagattgttttaattttttgatttgggccttctgacgacccattattctttggttattatttttttttcccttttttgtttgtttaattgcttggcatgtctagcagcagatggatcttttggaatcccaaaaaaagtgcgcggtgaaatgtgatgtgaaataccggaaataatgatattgattgatcggaagattcaagagaatgatactcaaaattgatcagaagattaaagttttcgcttacaaggaggataaagcaaatacgataatttattttggacatattaatttttacttcaaaataaaattcatcgatttatcctttttggaacatgatatgtttcaaactttgagaaaaattgctttaccgcatgattcattggatttttttagtatcaacccctatggacactatttttatcgatattggattaaattatgttcaaatattcgaaaaaatgacttaatttttttcgaaattgcttaaaataataaaattatatttctttaaaagactgctcataaatctatatattatttaccattatattgaaaatagtatcaataattcaaaaaatatgtataatattatatttcataaataatttcgatcaaatcagaaaaatcctatcgtctgacattgtcctcttctagatatgctcatggatttcgtccataatttatctaaaagtgcttacattaagacaagatgattttttgaattgaatttttttatacaattttgatcaatgcgaaacgacaattatcacacactttatttcattttaatattatatgatacaaaacgacacttattttattcaatgttattaatttaatttcacttggcgtaaagagtcactcaatgaaaaaaatttgaaagcataaacgatacaatatcgtttctatcgttatgtaaaatctacaaaaagtcgagtgaaaaaaaatgaatgatcaataatcgtgagcacgttaaaaatgtcactttttaggggtttccgacaaaattttacccaaaatctctgatcggataaaagaaaaaaaaatgaccaatgaccaaaagggtagatggtacgattaaatacaaatattttgtattctgggactaaaaataatatagtgtactcaatagatttccattaaacattaagagtaaataatactatgaataataatcaattatttgttgtcatgaatttttcatattgtttttcacaaaaattatcatcaaattacccttgtctcgcccaaattcgtaattttttatatcagaaaaattgatagcattgagatattatagaaaattgaattgtgttataatttttggcgccagtattggcgggaccgatggtagcgaaaaattcactgaaactgctcatgattatatcaaattcatgtgagaaccgttgttgatgcataatcagttcattatcctcatgttgacctatcattacgctactcctggaccaccgggggatcagtggcagggctgagaatggatcgccggcacattcacgctacagctgtattgctacgtcaggtaggtcaacaataacaaatttgtatacagtaaaacatcagttaacatctcagataaggatctcagcattgcatctcaacgaaacatctcaacaaaacatcagtgaacatctcaaatgaacaaaaaaataataaatattgaaaatgttttttagcttttgttattgataaatttttctatttcttcacaatatgtgaatttttcttaatataaaaagagcattttggtgataatgatacgattcacctggttttggcaaaaaatctcaacatttcacttcactttatccctccaggaatgaccaatgaatttcagccactcgataggaagatcttcggcattgtgaaggcacatgccaaaaaattttatcggaaacgcgtaaaaaacgggcttggcaacatcacaaaaagtggagcgtgccaagatatgattcaagcctgggatcttataaaggaatcttcggttttggattcatggaatatctatgatgcatggcatattgaataaaaatcatcttaagttgattttttaattttttcgaaattatcgataattgtcaaaaaaaacaaaatttataataactttatatttatatggtatttgatatttcaataacgacgaaggggtatgcgtttcaaaacattaattatgtggcttaaaataatttcgatgcatcgatcaaatattttttccattcgaaattttaaataatacatattgaattacttatgatgtagtttctattttccataataaattatataaatatcaattctttgcatgaaatttttaataaaacttgagcgttaacttcaaaagtgattaaattttgaatgcaaaaaaaaagtttttaaattaatgatacatttgagttcagctccagaaataaaataaaatgttggaaggataaatattttatatgattttaatgtataaaatatcgaatatgtgcaaaattaaatatcgtcatttttcaaagatattaatataatcatgaagtgtgtacaaaattaataattttttatatttagaattgatttaaaatatcaattacatattgcattaaacgaatttttagtgtcattatatgacattcaattgcattcaatatttctgtattttgtacgttagaccctcaccacctttcaaaaaaattacgaatttgggcgagacaagggtatatgaaaatcatacaatgaaatatgatataaaatattcgatttatcaaatttaatgcattaataataatatatgaaaacaaaatgaatttaggaaatgtttatttcaatatttaaatatttcctcttttatccttgtgaatcttttaatttttattatgtcgtcacatttatgatgttgaattttgtctgcaaataatcgaataatttctgcatttttcttttctgatgctatcataagcgctgttttatatgtttataagtaattccaaatgtttatatgaaattttatatttttttaaaatattttaaataaaacaaaaaaatatctttagcattgatatcaatattctcttgttcaagaagtaatttaacgatttctgtataaccatatttagatgcattcataagtactgtcatataaaatttaaataatttccaaatattattttgaaattctaaattattaaaataaatattaaataaaacaaataaatatctttagtattaatatcaattccctcttgttcaagaagtaatttaactgtttctgtatgaccatttctagatgcaaatataagtgctgtatcaaataattcaaataatttccaaatattattttgaaatataaaattattaaaataaatattaaataaaacaaataaatatttttagcattaatatcaattcctttttgctcaagaagtaatttaactatttctgtataaccttttgaagatgcaaatataagtgctgtccaaaatattttgaataatttccaaatattattttgaaatataaaattattataataaattataaataaaacaaataaatatcgttagcattaatatcaattccttcttgatcaagaagtaatttaactatttctatatgaccatttgaagatgcagatataagtgctgtccaaaatattttgaataatttccaaatattatgttgaaatttaaaattattaaaataaatttcatttttagcattaatatcaattccttctttttcaagaagtaatttaactatttctgtataaccattttttgaagcatttgttagtgctaaaaatatttaaaaaaaaatttaaaaatttttatgaaacgataaaatattttaataaaaatctaatgaaataagcaaacaatcttgctaaaatcaatgtatctattgttaattaaatagttataaagttccacatttccagaaaaacccgaaaaaaaaaaaaaatcaataggaatatgattgctttcgagaaaatattgagtaatatataaattccctgttatgattgaagcaatgagaatattttcatttattttcattccttctttaagtaaaaatgataaaagttcataattatcatgtaaaacacattttgctcctaattcttctaaattcttaatttcttttaacttattatcataaaaatatttaaagatatcatttcgataaaattctatcgctgcttcatatgcatcttcaaatgttgaatgattttgttcacataaatgaattatttcttcatttccacctgcaactgcatatttacctgtattatctaattttgctccattcataagtaaatatttaaaacatttaattgaaaaaaaaaatgctgcataatcaattaatgtaacatttttatgattaataaatgaatatctttcataaagtgatggctcaattgtttgattcaaatcgaagtttgcttgtgatgatatttcttgaagtttttctatttcatcattccgaattattttcgcaatttcattctgtttattccttctttaacatatttctgatgaagttcccaattattcgctttaagtttttcaaggtttttggagaaatattcagaaaattgataacaataatttaaaacgaaatgtgctttaaaatgtgaaaaaaataaatttttcatatttatagtaatcgatgagttaattaaacctttttctatcaacttttcgataagataattggattcttgtgagttatttttccgaaggaattgagaaaagatgtcaattattttaacttgatttttatttacatctcgttcaattatattcaaaaactcaataattatatctatatttttcagtcttgttataaacaaagtgtaaatgaaacggcagatgatcaagttgaatgaatacgttcgtgaattatcataaaatttgcgtaatgaagaaacagatgtatcaagattgtttgtatttatgttataaattatttctgtaagtgcaattaagtctggaaaagaatttatctttgatgtgctcattccaatgctgttaaatgacgctggaaaaattttcatggacatgtgatatgaatttttatataaaaaattaataaataaaaacatagaatgaacttcatgatgtaatccattcacatctttaattttatttggaatactcaaattttcattattcattaaaactttattatctttctgccatcccaaaggcagctcatcatttatctcatatacttgaagtttttcattaaaaaatatttcattattcaaccaaaacgcatccatcttgcccaaatctttttatgaaaatcttcttaatcttctcttatccctttccgaaggaagcaaaacctaattcaaaaagttgaaaatccaatttttttcaaataaaaatgacggttgaaaaccgctacaaatgatcaaggaagacaagaaatggaagaaaattatatatcaatattgatttattctagaatatgtaaaattgatcattatgaactacgaatattttctgttgcagattataatatatttgaaatctgaattaaagacatgaatcaaaaattacacataatttgaaatgaatagcataaaataagattttaattatgggttttttgctatcggcaaaaaacatatcctaggtcaaaaaagaatcatagtaaatttactattcatgaattaaatcgataacgttatcggaacaaaaatcattcactcagttgaaaagaaaaaaggcaataaaaggagggttttgtcttataacataagtatcgggaaaagattaatacacaggatgactaataatttttcaattgattataaattatcatacgaagggggaaaaagtaccgttgaaaaaattcaataataaaaaaactgttactatatttaaaaaagttattgtgagaaagtaccaatatatggccgaatatgcattcacatatcgaaaataacttatatacgacaattacatgaatatatttgaaattttttgagtttattaatattttcgatagatttgaaaagaatttaatatcaagattatatataatcaaataaaataattaatatttcattgtttcccaaataatttctgaaattttaatttcttaatatatcaagatataattcttatttttttattaatcatagatgtaaatatgtatatatattatatatccataatatcaagatcgtaggatgatcgctatatacgatgggtgaaaatcgcaagtcgagtttaatatatagtattaaaaagtattttattcataattttcgatgagacatcgatgtcaaattgtacattttggaaaatgaaataacatcaccatggggtacgaaaagattaaagttaaatgagctaatgtaacaaaaagtaactttagtttttttatttaattttttaatgatatttttttatttgtttgcagcaattttttctttgatttgtggaattgcggcaccaattacatttgtaacttctattggtttgccatcttcatttttgcctttgaaaaattttgtattaggaacagatgtgatatcataagcagctgcaatttcaggcgcctcgttgacttctacattcataaagtgtactgttgggttgtcgcgtgcaaggcttggtaaaatttgacgaacacgacggcatggcatgcaggtcgttgaaccaaatttaacaacaacaaggccatcatggctagtaatttctttgtttaattcttcaagagaacctgagaaatcttggagatttgatggattgctcatcaaaaaaatgaaatttttaacgtatattgaattttcagaaattattttatttactcaggccaactatcgaaacctcataaattttgagtaaaacgataacgctaaaatcggtcacttgagcgcgtgtgtccaaattagctgaaaaagttgacatttgaattaatgctactaatcggccaattaaatgttcaatattcaataatttacattaaacaaagataagaaactaaaatatttatgatacaaaacttacacttatccaagtaaaataaataaattttgatgttatatttattattgaattttatatctaatttaaatttcttctgaacaaccctcaacatcctacacatcgccggttcgatattgtgagaaatttgatcgtattttaagttccagtgaataaggtggcactttccataaaccagggaaacatagattgaaatttgcacgatttttttggtgttcagtttcttgaatcgttgtaaaaatgaagaatacaaatcgaagcagttttctagaatttgctgaaatgctttaatatctcaaatgttatatttggatttgtctttttacttaacttaagcaagccttagaatcttagatttggtcaaacccatttttgttgaggacaccaattaatattggttgaaatttttccatttttacgtaaccctattatttgtgttttaatgtgtctttaaagttatagctgactaatgaaatgcaattgtcactttttcatttttattcaattctgtcaaaaatcaatggggcaaaacgaatcactccccattctgacagaaaatcttttaagcattagtataccaaatggaaatttaactgaaataccctattttattccaccagaaaattcaataaattctattgatgtaccatataatcaaatcaaaaaatttccgttatctcttcccaatctaaaagtattagacatatcaaataacaacctatcacaagttgattttgatgatgttcaattttcttttgattctcttgaaatacttaacttatctaataatggattttcaaaaattccgcaacaacttaaagaaatgaaatcaatcaaaaatcttaatcttgaacataacgaattaacagaagaaacttcggatttttcatcattatccaaacttcaaatattaaatttgtttttaaatcgttttacaaatttcccaaattttccagactctcttgaggttcttaacataggttttaattcaattcgatcaatatcttttttcttaccaaagataagtgaattaaggttatctggtaatgagatcacagaagtttctgaagactgttttttcccatcccttaagctccttgatctctctcttaatcgtcttgtcgagtttcccaatcttatgaagatatctccaaatatcgaagaattttattgttcatataattttcttgaaacaacaccaacagaaattcctttatccatagttactttagatttatcacacaacatattaactgagttatcaattgatttcacaaatcatcaaaatcttctaaaacttgatatctcaaacaacagaattcaaacagtcccgcaacttccagctaacattgaaagcttcagtgcccagtttaacgcgattagttccattaccactccgactttcacaaaacccataattctgaactttacatcgaatgaattcacttctattcccaacttaaagcaatgtcagtcacattttctctttatgaaagataacaagattaacaaaattgatattgaaaacatcagcttaagtactcaacaattagtgttaacaaataatcgtatcaatgaaattcctgaaacaatttcattacttaatagtttaaaagtattaaatcttacgctaaatcgtattacgtcattaccaagttctatatcatcattaaaactaaacacattaataatctgcgaaaataatatttcagatttacctgaattaccaacaacactaacgacgttaatagcctttaaatgtaattttggtgaaattccagaatctgtttacaaagttccacgtctgaattttattgacttttcttgtaaccacatttcaacattggcaacattaccaaaagtgacacaaatttcattatcttcgaatgatcttaaggaaataccatctattcccgatagtatctctattctcaacttatcatttaatcgaataaaaaaatttatattaacgaatggcaaatatttacaagaattagacttatcgcataaccaattaaagaaattcaaaactacaaaattaacgtttttgagcacgttaaatttatcacataatccattgaaatcgaaattgcatttcagtaattttccggttttgacaacgatagacatcaccaaaacgaacatttcaagtccgaagcatcctatcccattgaatatcattgaattcatcacatcgaatcctcaaattgtcaaacaaaacccacaaaataagtcgataagtttatacagctgtgagaatgtcggctactccgaaatgaaaggatttcgtcccacgatggaagacaccattgtcgtaaggcgtaacatccttcctgggattgatatcttttctgttattgatgggcatggcggccaagagtctgcgcatcttgcgtcatattacattccgttgttatttctttcattgaccaacaagtcaatcagcggattctcgtcgatggttaaagacttggacatcatattacatcagaacgatgttaaagatggcgccgtattagtgtttacattaataagtcaaaatgaaatcggatgtgcgcatctcggcgacgcgcgtgcgattgttgtccggaaagacggaaacataatccctttgactatcgaccataaagcgacggaaagaactgaaatcgatttggtgaaagaaaatcgatcgtacatcgaaagcaaaaggactgccggaatattggctatctcgagagcaatcggagacttccgtgtgcccggcgtaacaaggacaccggacatgacaagctacaacagacagaagaacgacttcagactcgtgctgggatgcgacggactgttcgatgtggtcagcaacgaggaaataggaatcatcgtaagggataacgcggatgtggatttcgcggcgttcttgctgagaaatacggcattcgcaagagggagcatggataacattagcgtgatcgtggtagatatagaaaaaaattaatgtttgatgataaattttaagaaataaaattttaaatatgtattaaattagatttttggtcgtaaattcatatgtttgttcagataaatggaaacttatgtcatttttgatatggatcagattccaaatttacatacgtgtgtactgatgatgaaatatcaagcaaattttttatttatggttacaatgcaaagacggtgatggcgttttcgtagggcattgtttatatttataggttaatggatattccaatatatcgccaaatgttacaaaatcaaacatcaacataatatttacagcaattaatgaaagtgatatgttgttctatataattgatttaacacattgtttaaatcaaaaaagtgaactaattttatacaaatttttaatttaaaatagatttagttaacatattataaaaaatattattattaagctgaaggaaggaatgtgtctttgtgataatttcatcgccggggcaccccaaaatcagagagcgctgccaatgtctaaaaattctgagaagtattaaaaaagtatcgaaataggtggatcccccatatgctatcggaagacgataaggaaaaaagggttgagtatttcaaagaaattctaaaaaaattaatcaaagctagaaaaaacttttttaatacaattatgactggtgacgagtcgtggttcttttatgaatatgaacataaagaaatgtatgcagaatcacgtgatatggtaccaccgatagtcttcaagaaaattcaatccaaaaaaacaatgttcacaattttctttaatgggacgaaaatactttgcattgatgcattaccttctgattacaaatttaatcagcgatattttattgattatataataccacaatttcacgaaaatgttgattatgacaagaaacaaccaccttttaaaatttaaagattcatatggataactcccctatacataatggataacttgttgctcaaaaattaaaagaagaaaaaattaatagaattcctcattaatattattcaccagatctaagtccatgtgatttttggttctttggaatggcaaaggaaaacctaaagggtgtggagataaattcagaagaagatttagaaaatgaaattatacgcatattcgacggtgtcacttttgaagagcttcaaatggtgtttgaagcatggataaaaagacttgaatgggtgattaagaatcatggggagtactaccataaataaaagttaattaaaaaaaatatatattatttattcatcgaaaaaagggaatggggtcaaaactttttggacccctcatatatatcagcaaaaaccattcataataaagattattaaatcaattataccattttcttcctgttcccatatgataatcttactaactaatctcaaataattttaatttatctttaaaaatatttaaaattaaatcagtaaaattaacacttgataacgttatttatattgctcccaccatccaagcagaaattatggaacaatcgatagataatagttacaaataacctacgagaaaacattagtagcaatcctgtgaaaaaattattaattttttggtagcaacagaaatatgctttctatttaaatacaagttaactactttaattagtataacccttaaatgggataaatgaagctgctggattaagcttactttgagcagaataacgaagcactggaagtttaaatatatcacagaagttaaaaaatgtaattctaatttctattaatataaattctttaggaaaatatatttgtcaattttaataaaatgagtattgttactaaacttttatatttattgtataatgacaataattttaacatattagagtcatcaaagaaataatagaagggacgacaatgatttcctataaacaaaatccttagtaattctacaaataaattctcagtatatcgattaattcaatgggaattttatctcatttatatatcgacttgataatgttcattatttatttcgagttttttcattaatcactggtaaacatattacagatgacttctttgaaagtccaaaaatatgtttaacaatgaacttagatgcgattaatagatgtcattggattattacgatgcaagaaagtaatcgattagaaatccaacgatattatttcgcgggtagttatgataatcgtttatttgattttaatgaatcatttaaaaagagttcgaaagaattccaaaaatttgtttgtaatatgaataaaattattatacattatactggctcaaatgttattcccaaatattatttaacagaaaacttagaattatttatagaatttctcgattttataccgaaattattattaacaaagaatgaatcattatataatataataatattttttaattaattctaatttacgtcgtttttaaatctaatcaaaatattagagacttatgtttaaaaaataattccaaatttaccacattcttatgcaacatttttatatttttaataacttacatattatgttatatgaatgtaaaaatgaatcaattgaaatattaataacattattacataaaacaaaaagtcaaaaaatcctttcatttatatatagtaaacttgaatcatgtcaaaacttagcttatatacaatttgatttaccaaataaaatatcagaaatgttaccacaaaacacaatttcttcatcattaataccaaatgaaaacaaatcaatattattaattcatcaaagagtattaatatcaacggtatctatatatttacgtgataataatttagatgaagtaaatttcgatgataaatcacttaatgatattaataatcctttaggttgtttaactatgtattgtaaaatcctttcatataaatttaactttagtatactcttagctaaaactgcagatgaaatcgaaaaaatcatttatcttattattaattgataattttatgtgtttattaacatcattatcttcatatcatataattgcacgtatattgactgatatattctctgatttgttatctaaaatttatggttttatatctaataaatcattagaaattacagacgattctgatttatcatcaattgttcgattatttttatttgtttatggtaaatttgctgcaactttattacaaggaacaaaattatctaatttttgaaaaagaattttctcatttaatatcattaaatcttgataataataatcaaaaagatttatttaatacagatattaattgttttagtgaaattttgaataatttcttaggcgaaaaaggtgatatatatgttatgtctcatatatataagaattataagccttcaatgaacaaaaacttatcaaatgatattaaattattagatagagtttgtttagcagcgttttgtaagcatcaagatttatttaatgaattaatcgaacgaaatgaaacattttcagtaaaacttaaatcagtattagaacaaatgattcgagttagaaatatatatcgatcacaaaaacaatcaggtaaagaatcattaatatataagaaatgtcatttattacttcgattaaataaagatattacattaactccgaaacaaatgggcgattttgcttgttctaaagaatcaattgaagaaatcatttcattaattaatcaacaaaaatctcgaagtcgattaacattaattgggtttgaacttattgataatgttttagcatatgaatcatcttcgattttcatagaaattttttttttttttttatccaaaattcaaaattttgaaggtttaccagcggtaatgcaaattactaatatacatactgaagaaattatatcgaaacttttttggttcaagaatattaaaaattatattaaataatcctaaatcgaaacttagtttagtcgcttatcgattttttagagatacaaatcaactacaaaacttaaaagaaacatttttaaacaaagttttagagaaaaatattgaaacacatgacttaacattatttgctttatcattatcattaatacaatatataatataatattagtaccttctttataaaatttgatatttttgatattatatcgtaacattataccaaaaattattatttatatatttaaatgtacgataagaatatctaatgtttatttttgacgttaaaagaaagttgttcaatgaaaccaacatgtacaaggggttttaagccaagaaaaaatgatctccaagattcaactgatgctcaactccgatatcaagttttacgtttacaagaagagatcaaaaatttaaaaacttcatttaatttacattcatttaaatataagcaattatatgaagaaaacaaaaaattaaaaaaaaaaaaaattgagtctttacataccagaagtgagcttttgcatagtatagaaaataactgttttctaaaaatgcatgttaatgatctcttaacaaagagacacaacaaaaaagctatacctgattatatatgtctgtctaatatgggacagtctttatggatgtcaatggagttcaatttagtattcccttgttggagaacaattcaacgttggaagaatgaagaatataaaaggttaaatattacaaaagaggtatttgatggaagtattgaacatatagatcatcttttgtaagtgtttttaaatgagaatcattcccaaaataaccatgatgttattctagcagttgacgcagctggtatatcattaaatgttattatacattaagatggatttattgaaggtttaatggaggaatgttatattgacagatatatagctgcttatttgagatcatcttcagaggcattattatcatttatagatgaaaacaaacaaaaatattattaacgataatttcgtctattatatatgtccaatatctttaaaaaatggtggtttcccttaatgtataaaatcaaaataaaatggttcatctaacaatgaaattgtatctcaattagaattaattgcaattttacttggtggcttgggtataaatgttgttggcatttcatttgacggagatactggttatttagagtttgttaaatcaatttgtgataaatttcaaaattttaatatttcttgttctttaccaaatttaatcagtgatttaaacatgcctctcgtttttgaagatatgctccatcttgtaaaatgcatgaggtatagaatcgtatgtggaagttcaatttgtgttttacctgatagagatttggtgattaacaaaaaggattatattgatgttggcatcctagaatttattttggatggaagtcatagtaaaaagatggacgatatgctaccaataatgttatttaccgataataatatttttaaagcatttgaaaccgataaattagtgttaatatcacttattcctgcaacattacttattaagtctgttatggataaaaatttatatagaactcgaagaattgaatgtttgtcataattttgggcgttgatgtatcttaataaagaaacttataatatagaaatacgagatcgaaaacaaacacgctcaatgtcagaaggaaaaaatccttacatgtgtatatacaaatactatcgataaagtgatgtcactcgtatattctttatcaaatattctgtatcaaaacaaagatattcatcttggtgcttgtggtactcattggcttgaacatttttttggccaagttaggaggttgtgtcattacaatcatagtgcaacatattttatggaatgttgccaacaagtaatgtataaaaaaatatgcataccaaataaagacatataaatatctaaaagattttcagatagtgatgcattccttagtgaaggtgaaataatttaacattttgaaatttctaaatacatcaaggaagcttcaacaattcttgtattaaatcaaagtttaatttcagctaaaatgaaaacattattttctgaaattaatgagaaattttccgatgaaatttctcttaatgacattatatataagtattttcaaataagtactgataaaaaatgggtatcaataagaaattcaagaattgtatcatcaactggatatgctaccattagaagaaatgttgaatcttcccaacaagtttagtaaattttttttattgtcactttttagaattttaaactgattcgccgtccgaccaaatatattcaaataataatatctaaaaacgttacgatacgatttttctaatttcaagatatttgattgaattcattatatagacaatgaatatatgatattatagaattttgtctagccgttttttagaaattatcaattttctgatttttccaacttttagaatgttgtaacgcgtaaaccatttaatattgaatgttgtaaaaaataaattatttaataaaagaggtgttcttactcaatatctgtatgttaatatgagataatatttcaatttatataattcaagacaatattttacaaaatattgtattttaaatgatggcatgttctttatttaggccaatattcataaaataaattttggcggttttttaaacggctttgtcgccccttctgaaataatagatatgtaaacaatcatcaggtagtttacatttaaaaatatttttcagcaataatacataaaaaaatgacatatatattaaacattatttgattttgtataattttcttttgatatttatataaatattcgtacagagactgcgatgaaaaacatgtagaccaacaccttattataacccacgtctacaccgtagcattattcatagaaaacatatttagtaatatatatttaaaattttttttcgatttaattttgtaattttcgtaatattcctatttttcactcacttcactatggagaaagttaacactaaaaaaaaaattttctcgattttctttacatattttaattaattcataattttgggactgaacatatgttaaaatttctatttgctagcaaattttttttaaattaatgatttatctcgaattttgttgtccatattatttatcgattgaaatagctttaacggtttgcctttatcacaaaagtgacaattataatgacagttctgggatccactatctctgtaacaaatcttaacttcagaacaccagtagacgacatatatcacgctttcagtcagattggagaattaagtgagtgcagacttattttgagtgaaagaaatgaatccaaaggatttgcttttttgacatacaaaagaagccgagatgcaaatgaagcaatcaataggatgaatgggttccacatagatggaagagaaattaaggttggatgggcaaacgcaaaataaatatacatacattatttcttaaaattaaaaatatttagctcttattaaaagacacaaacttattttttatataattagatcaatcttcaagtttttcatctgattatgattcgaaaaaaatttagcaatctgcataattactttgaaatgttttaatatacggtaatgcttactcactaatagcaatgtacacatggttatagctattataaaaaatcaaaatcaaataaattgttaatgtgatacaattgatttgaattccaccacatttaattaaatcttttacaagattgaaaagaaaacattcatatgttatatcttagaagttttatcagatttttattaattaaaactcaaagttgagaaatataataaatttaattatgaagaagattcccatcaaagagccctccgtgctcctttactgtttagtttatctcatagaatatttcgtatgagctcagccaaatgagacaaaccgtgtatcacaataattacatcaaaagaaatcatcaggagtaaattgattttatgttctgacatatatataaatatatttcaagcaaaaattagtgctcttgtctattaaaatttttacctatgaaaatgaagtcgttttgccccttatgaggataacaagtaaaaaaattcaggaaaaaaataaacttaaaataattaaataaaaattaaataggagaaactctatattaattattctttattttttttctatgaatgaagcttttataattttagaagtaatttaggttaataaaattaaaattaattaataaagaatttattaaaattatttttatttataatcagtggtaacaaattaaaaaaaaaaatttattaaattatcaattttttattatttatacttggttgatcctgccaaggaagcacactatggtcatagattaagccatgcaagtgtaagttcaggtaactaaactgcgaacagctcattaacacacttattatctacttggaaaagattttttaaaagaaatcataaatggatagcagaagtaattcttgtgctaatacatgtttttaaaatttcattggaaattaaatacaatgataaattttacctttattttaaggaaatccaatcgaatgagtgacctatcaggccagtacttaggatcttttcctaattaagctattacgggtaacgggcggttaccgtcgtactgccggagaaggcgcctgagagatagcgactatatccacgggtagcagcaggcgcgaaacttacccactcgaaattctcggaggtggtaatgaccagttataatttttatttttaataataaaattatataggaatataattttccattatattggaacctagcagagggccagtctggtgccagcagctgcggtaattccagctctgcaagtttgctcccatattgttgcagttaaaacgctcgtagtctgaattaatattaagtaatttaatgaattacgttcactgtgaacaaatcaggacgcttaaagtaaggataaatatacttgaatgattttgcgcagtatgaaatttttatttataacaacattgttataaataagatcaaggagattcatcggggatagatctatttcatggcgaacggcgaaatgttttgacccatgagagagaaactaaggcgaaagcatctatcaagtggagttctatcgatcaagggcgagagtaggagtatccaaccggatcagagacccgggtagttcctaccttaaactatgccgacgagggcttatttttttattttagaagtaggaccattagagaaatcaatagttcatgggctctgggggaactacgaccgcaaggctgaaacttgaaggaattgacggaagggcacaccaggggtggagcttgtggcttaatttgaatcaacacggggaaacttaccagaaccagatatttttaatgactgatcaggataaagttctttcaggatataatttttggtggtgcatggccgttggtggtgcgtgggttgacctgtctagcgttgattcagataacgagcgagattattaccaattaaataattaataatattttaaatattatttttaatttctaattgggactccctgcgtctaagcaggaggaagaggatagcaataacaggtccgtgatgtcctttagatgctctgggctgcacgcgcgaaaaaaaaaaaaaaacaataagaataatttaaagctaatttgaaaagatcattttttaaataaaatgaaaagctactcttataatttttaacgtagttgggattgatgattgtaatcattatcatgaaccaggaatcccttgtaaaagtgtgtcaacaacgcacgttgaatacgtccctgccctttgtacacaccgcccgtcgctcctaccgattggatgactcggtgaaatcattggatttaaaaaaaaaaaaaaaagaaggtgattaaatcacgttatctagaggaaggagaagtcgtaacaaggtaacggtaggtgaacctgccgttggatcagtttagtaaataaaatttaaacaataattttaaaaataaaaaaataatatacaaaattaattttcaatcattaattaaaccttaaacaacggatgtcttggctctttacacgaagaagaacattgcataatgtgataagcgactagattagctcaatttgtgataagttcgatctttgaatgcatattgcgtatttattaatttattaataaatacatatataatttagtaacaaataataattaattaatcattttaaataaaaaatgagaaataattttaagcttatataaaattgttctaaattatataggaaaacccgctgaactgaagcatctcaataagcggaggaaaataaactaactaggatactcttagtaagtgcgaccgaagagagtaaagctcgataatttaaaatcttttttttagattaatgtaattttttaaacttattaattaaaatattaaactattgattaaatacatggctataaagagtttaagcctcgttacaattattttaattaagcataggtttaaataaaagagtcggatagcttgagaatgctatcttaaaataggtagtacatcctatctaaagctaaatatcgtaaagagaccgatagtatacaagtagtgtgaacgaaagatgaaaagaactcctgaacggagagttaatagcgcctgaacttgtttagggtaaggtatttcattaatacacccgtcttgaaacacggattagggagtttgactataatacgagtatttaattattaaaatttaaatgcgaaaagaaattaactgctcttttttttgagatggctatagagtattattgtcaaaacccgaatggaggtgaactatgcctgtacagattgaagtcaggggaaactctgatggaagatcgtctgcgttattgatgtgcaaatcatttgcttgatatgggtataggtgcgaaagactcatcgaacctccctactagctggcatcctcccatttttccctaaggatagctgtaatatttattaatagttaaggagagtagagaaatgggtagaggtgtagtggaactccggttctgcaacttatttccaaacttcgaaccttcttaaaatgaataatttttcttaaagaaattaatcatcttttgaatatatatatacaagtgggctcttaccggtaagcggttatggcgaaaaagggatgaacctaacgtatagataaagtgcctaaatttactattaatgaaaccattaagagagtccatgtatttagacagcgggtcggtgcccctaaaagcaggtatccgttaatgagtgtgttaaaactcccccgccgaatactctggcctcgaaaatgaatggcgcatatagtaattactgatactatacaaataatttttaaataattatttagtagggggatgtgaataactttaagaatttttaaatgtaaatttaaattaaaagttatttattacaaatcctaattgaagtagcgattatccaggttaaaatcctggggggctgatgaggagtagggtttctgggcaacttaaatagacccagagttagtcgaacctaatttcaataaagaaagaaagggaatatgaatgatatttcataactaaaaatttttttaataaatagtggtaacacaaatttaaaaaattatcaatattaattaaatactgtaaataatagggatttctttcctatataactttaattatttcctaagaatcaaatcaattggagaatagttgaaataatttagtaaaacttaaaattcgttttaagttacggctatttaattaatccttgaaaagataatttaaaatagaaaaatttttactcgtaccgataaccgcatcaggtcttcaaggtaagtagcttctggccattaagttataataatttagggaattcggccaattagagctgtaacttcgggataaagcttggctctgatggaaatcagaaccgatagttacagggagagcccaactgtttaataaaaacttagtattatgtaattactaataaaagtattaaacataatatgaatcctgctcagtgctgtgtttgttaacttggaaaaattcaattaagcgccggtaaatagctggggtaactatgactcttatcaaagtagcgaaatacctcgtcaaccaacagttgtgggaacgggcacaaattatccagcggggaaagaagaccctgtagagcttcactttggtctaattttgtatagtttcgttaggggtgcagactaggtgggacatttaataaatggattatgagaaaccactaccctttctggaattatacttactttttaattaaaaggatagaattagatagaaagtttggctggggcggcacaccttcgaaaaagcagcgaaggtgtcctaagttaacgctcagtaaggacagaaatcttacgttgaggataaggccaaaagcttaatttactgtgtcgttttgtactagaatcagttatgaaagtaaggcctaacgatccctaattagtcttaggtatgtaagacttggggtgacagacaagttacctcccgggacaactggcttgtggctgctaagagatcaaaatcaacgcagctttttgattcttcgatgtcggctctttccctatctagtgatgtataagtcactaagggttggattgttcacccgtatcagggatcgtgagctgggtttagaccgtcgtgagccaggtttgttttatcctactggatatttatattaagtatcatgttagtagtttgatttagtacgagaggaactgttgattatggtctctggttaaggaatttttaggaaactaaatgttccaaagctacgccatctgagataatggctgaaggcctcttaagccagaaactcttctaaaaattgatactttaaaactattttaaaattatgagataaaattaatatattttttaaataaaaatctctttagttttaatgaccaaatgtagaagacattttgtcaactagggtcctgtaagtgtaagagtggcatttagtcacgattcactgagggtcagcctaagttgtatggttattataatgtaatttaaaaaaaaatttttttcaattttttttacttatttttgtccgaccaaataaaaattcaaaatattttgtatactttattattataatgaattattcttaatattattttttcatcaattttgacagaattcaattgttatttggtctgaaatacaaaataaactatttaaaaagtctaattttttacattaatgggggtgctgcacagcaaaaatcatcaaaattttcaaaattttttaaattgcatttttaaacttattaactaatgacattcatgctttcttatgatcattttgcttaattttcatttttttttgaaatattctaattattaataattaattctaatttttaaaattaatcataaattcatcttgaattcatgattttaagtattttttattaagataatttttgatgaaaatcaatttaaaatattctttataaaaaaaatattttatgttttttcatccgaccagataatatttcacatcacatgtctcttgacactttttgtaaactagtcaaaagaaatttgaaaaattttcataaaaatttccaatttttcatcaattttgacagaattcaattgttatttggtcataaacatcaaataaactatttaaaaagtctaattttttacgttgttggggtgctgcacagcaaaaatcatcaaaattttcaaaatttcaaaaatctattttttaaacttaatatcagtagtacttctcatgttttaatgatcattttgcttaattttcaatttttatcgaaatattctaattattaataattaattctaatttttaaaattaatcataaattcatctataaaatatgattttgaacaatttttattaagatgattttcatcaaatatcattttgaaatattcttttttaattaaataaatatttcttatttaacggtcatttcaaaggaaaaattaacggtcaattagaaatcaaaattaacggtcaattaaaatgaaaattaacggtcaattaaaataagaattaacggtcaatcaagaagaaattaacggtcaattaaaataagaattaacggtcaatcaaaaatgtaaattaacggtcacttaaacttaaagttaacggtcatttaaaatagaagttaacgatcattttgcgtagaaattatttgactaagtctgttcgaccgagtaatttttcacatcacatttcaatgtgtcacttttcgataaaccattgaaaaagtcgaatctgacactaatttttcctttattgtttctgccttcctttattcgcatttttaaacttagaatgttcagtatttatgctctaatatcctaatttcccttaattttctatttcttcctatttcatctaaaaaatcaaaaattaacggtcacccattaacaaattattttgtttaggtttgttcgactagataatatttcacataatatgtcaattataaaatcacatcgtacttttgtaaatcagtgaaaatcccatcggtatttatttaatgaatgtaaaaaataaactattcaaaaaacaatttcgaattttgctgtgcaggaacacagcaaaaatcatcaaaattttcaaaaattcaaaaattgcatttttaaacttaatacctaatggcattcatatgttcttatgattattttgcttaatttttgattttcatcgagattttctaattattaataattaattcaaaaaattcaaaattaatcataaaatcatgcttaaaatcaaatttttagtattttttattaagatgattttcatcaaaaatcattttaaaaatttgtttttaattaaaaaaaaaatattttattaacggtcatttattaatgaattaacggtcaatcaaaaccaaaaattaacggtcattttaataagaaattattttgtttaagtatgttcgaccagataatatttcacatcacatgtcagtatctaaactatgcctcacttttttcataaagtagtcaaaaaatcaattcctatttggccaatggatgtaaaaaaataaactattttaaaaacaatttcgaattttgctgtgttcctgcactgcaaaaatcatcaaaatttccaaaaattcaaaaattgcatttttaaactcagtagctaatggcattgacatatttttatgatcattttacttagttttcaatttttaatgagattttctaattattaataattaattctaatttttaaaattaatcataaaatcatgtttaaaatcaaatttttagtattttttatttagataatatttgatgaaaatcattttaaaatattgttctttattaataaaaaatatttcattaacggtcatttagaattaaaaaacgttaatttttagtaagtttatctgaccagataatatatcaaattatttgtcacttttaatattgattattttgaatgctttacgaaaagtatgaatgattaaaaaatttaattttaaaattatctaaatttttgtcaatttttgcctaaattcaattgttatttggtctgaaatacaaaataaactatttaaaaagtctaattttttacattattggggtactaaacagtaaaaaattataaaatttagaaatttttgaaattgatttttaaacttagatttaataatacttctcatgttttagtgatcattttgcttaatttttgattttgattgaaatattctaattattaataattaatttaaaaaattaaaattaaccataaaatcatcattaatatcaaattgtaagtattttttatttagataaaattaatcaaatattcttttatgattagatttaaaacatgattaatatattaacggtcgatttgattaatatacgtttagatttttgttaacggtcgccacaaatcaaaacacccatcaacttaaattaaaaaaatggaattaaaaaaagaatcaaaaggttataatacttcttaaaaacacaaagtttttaacaaatattcaattttttgttaagttgaatttcctgattttattgatataaatattatctatgtattgattgtttctttgtattgactttaatttcttttgtaattccaaatattttctttgatttctttgagtgaaaatattcttaaattaacttgaagttatgatatttataacatgttggcttcattatatcttcgaattgaagctttaaaattgttattttatggttatttttcaaaaaaataatcaaaaaaaaatgtgtcacttttgatcggcatattataaaaaaaacgtttattccatctttagaaaaaagaaattgtgaaaaaaaattgataattttgattaaaatatcaattaatagtgttaaataactatttggttgattatatttcaatttttttaatcttaaaaaaattcatacatttttgaatttaatattggaattaggttgtttataaaaaaagctaagtcattttaataattattaacgttggttaaataaaattatgatgtttcttatagttaaaattgagatattgatcatcgaaaatttagtcaatgattttgtagaaaattgttattatgaatctacttcttgtatatttaaattggtttagtaaaaaattttttcaatttcatttattcatgaaattgtctagatttagttattatttaatataaaattagtatttaaagattgaattctttaataattaaccttgtatttgttaatataatgattgattttatttgtttgtttgttgttcaaaatttggaaatgtaaagttttataaattttagttttgaactaatatttgttaaattataacttgtttaaacttaattatatcattttaagttaaaatttagttttaattattgattttattaggtaatattgttaaaaattatttcttcttttgtcactttttaacgtccgaatgatacgttaaggaatacgttaatgattgtcaattttatgataaacatcagaaaaaatgtaaagtatagaatagaaaattattttaaaattaaattaatttcattttataattaaaatatttaaatttatttaataaatttatttaataatatttttaaattttattatattatcaaaaaatttaaaatttattcaatttaaaaaaattgatcttaaatttaaaaaattttaaaattaattaaattgaataatttttattttatataatactttaaaaatattcttaaattattttaaacttaattttacttaatattatttatataatctaataaattcattttaatgttgaaatttttcaaagtttttgttttattaaaaaagtttttttataattaatattttaattaataatatagttattaatatattagagcatttaattaataatatttattattaaattaattgattttaaattatgaaataaaaatttttttaataagtgaaaatttttaacatttaaatttaaaatatttttaaaatatttttattaaaattattgatttttaacatttttcaattttttcataattttaatagaaaactatcaaatagaatgattttattaaaatatagtatataaatattttataaaatattaaaaattatgattataatttattaatattattaatgaattaattatatataaaaaattataatcaattttttaaaattcctgcatggcgaccgttaagaacaaaaattaaaataactttataattaaataatatttgataatttaatcaataaatttaattttaatgttttaatatttaattaattatttaattaaaattataaaatattttaaattgataattttttttattaaattatttcaaaatccttaacggtcgccacaatattttaatttattaaaaaaaattctgaattcttaaatttttttaaaatttaatacattattaaattaaatttaattcatatttattatctttatattcaaaattttgattttttaaaattttgaaatatctgaatttattcataaaaaagtgaaaatttttttatactttaagtaaaaaaagttttaatttattcctaatgtttaaaaatatttaatcttttaataaaaatatcttaaaatattcaaaattaatttttattcatttcatgaattttgatttttttaaatcattttatattatattcgtaatcattttgggactaaattataattttattgttaataattttagatgttggatagttcggtctgctatgggggtacctaaaaaaagattggaatgccttgaaatcaataaacattaatttttttcgtaataatgatattattatttattacttgattgtttatgtgtatgttaattccttttgtggaaattattattatttttagtacataaaaatcattcattttaaatgttgattttgacattaatattgtcgttaaattttatctatgtgttagttatttaaggttgtcgttattaatttttttttttaatccttaaattaattcaaatttttcatttgaaattattagttgagaaaaaattgaaaatttgattgaattcattgttacaacaatgttataaactagttgtgtcttaaattaatactttaaaactaactttcttttgtcaatttcgtccgtttgaaaagtatttttgtgtcactttttgacattcaaatttgatgttaatactgtcagttttaaatatacctcagaaataatgttttaaaataaaattaatgttttaaaatcaattttgtttaaaattctaagtaaaaaatattcactaatgttgttgtattactcaaaaaatatcaaaaaatcgatttttattagagtaaaaatctcaacctgacaaatacacgatttaatggaagaaaaaaaactaagttgccaagaatattttgtttacttcgaattattattgttacaaaaaacttatattttagacaattttgtgaaatatagaaatgtcagaaaatattggaaatactgagttttgatactttaaaacattgtttaattgactctgtagatttcatttttcaatttttttgtaaattttgatatttttatttggatggaaattcgaagattttgaactcaataaacattaatttttttcataataatgatattattatttattacttgcttgttttgtgtgtattgattcatttgtggaaattattattatcttagtacaaaaaaaatcattcattttaaatgtcgattttgacattaatattgtcgttaaattttatctatgtgttagttatttaaggttgtcgttattaatttttgttttaatctttaaattatttcaaatttttcatttgaaatgattagttgagaaaaaattgtaaatttgattgaattcattgttacaacaatgttataaagtagtgtgtcaatttagttcgtttgtaatctatttttgtgtcactttttgacatttcaaataagacgttaataatgtcagttttaaatatacctcagaaataatgttttaaaatcaaaaagaatgttttaaaatcaattttgttcaaaattctaagtaaaaaatattcactaatgttgttgtattacaaaaaaaaaaaaaaaaatcgatttttattaaaattgaaaattactcaattttgacaaattttgaatttaatggaagaaaaaaaaactaggattttgcaagaatattttgtttacttcaattgtattgtctaaaaaaactatattttgaataattttgtcaaatatagaaatgtcaaaaaaatattggaaattatgagttttaatacttaaaaacattgtttaattgactctgtagatttcatttttcaatttattagtaaattttaaaatttttatttggatggaaattcgaagattttgaactcaataaacattaatttttttcataatactgataatattatttattacttacttggttttgtgtgtattgattcattttgtggaaattattattattttagtacataaaaatcattcattttaaatgtcgattttgacattaatattgtcgttaaattttatctatgtgttagttatttaaggttgtcgttattaattttttgttttaatctttaaattatttcaaatttttcatttgaaatgattagttgagaaaaaattgtaaatttgattgaattcattgttacaacaatgttataaagtagttgtatcttaaattaataatttaaaataactttcttttgtcaatttagttcgtttgtaatctatttttgtgtcactttttgacattcaaataagacgttaataatgtcagttttaaatatacctcagaaataatgttttaaaaatcaaaaagaatgttttaaaatcaattttgttcaaaattctaagtaaaaaatattcactaatgttgttgtattactcaaaaagatcaaaaaatcgatttttattaaaattgaaaattactcaattttgacaaattttgaattaaaaaaaaaaaaaaaaactaggattttgcaagaatattttgtttacttcgaattgtattgtctaaaaaaactatattttgaataattttgtcaaatataaaaaaaaaaaaaaaatattggaaattatgagttttgatactttaaaacattgtttaattgactctgtagatttcatttttcaatttattagtaaattttgatattttcagaaaaatattggaaattatgagttttgatactttaaaacattgtttaattgactctgtagatttcatttttcaatttattagtaaattttgatatttttatttggatggaaattcgaagattttgaactcaataaacattaattttttcataataatgatattattatttattacttgattgtttttgtgtgtattgattcattttgtggaaattattattattttagtacataaaatcattcattttaaatgtcgattttgacattaatattgtcgttaaattttatctatgtgttagttatttaaggttgtcgttattaatttttttttttttctttaaattatttcaaatttttcattttaaatgattagttgagaaaaaattgtaaatttgattgaattcattgttacaacaatgttataaagtagttgtatcttaaattaatactttaaattaactttcttttgtcaatttagttcgtttgtaatctatttttgtgtcactttttgacattcaaataagacgttaataatgtcagttttaaatatacctcagaaataatgttttaaaataaaaaagaatgttttaaaatcaattttgtttaaaattctaagtaaaaaactttcactaatgttgttgtattactcaaaaaaaaaaaaaaatcgattttttattaaaattgaaaaatactcaattttgacaaattttgaatttaatggaagaaaaaaaactaggattttgcaagaatattttgtttacttcgaattgtattgtctaaaaaaactatattttgaataattttgtcaaatatagaaatgtcagaaaaatattggaaattatgagttttgatactttaaaacattgtttaattgactctgtagatttcattttcaatttattagtaaattttgatatttttatttggatgcaaattcgaagattttgaactcaataaacattaattttttttcataataatgatattattatttattaattgcttgtttttgtgtgtattgattcattttgtggaaattattattattttagtacataaaaatcattcattttaaatgtcgattttgacattaatattgtcgttaaattttatctatgtgttagttatttaaggttgtcgttattaatttttgttttggatttaatggaagaaaaaaaactaggattttgcaagaatattttgtttacttcgaattgtattgtctaaaaaaactatattttgaataattttgtcaaatatagaaatgtcagaaaaatattggaaattatgagttttgatactttaaaacattgtttaattgactctgtagatttcatttttcaatttattagtaaattttgatatttttatttggatggaaattcgaagattttgaactcaataaacattaattttttttcataataatgatattattatttattaattgcttgtttttgtgtgtattgattcattttgtggaaattattattattttagtacataaaaatctttcattttaaatgtcgattttgacattaatattaaaaaaaattgtaaatttgattgaattcattgttacaacaatgttataaagtagttgtatcttaaattaataatttaaattaactttcttttgtcaatttagttcgtttgtaatctatttttgtgtcactttttgacattcaaataagacgttaataatgtcagttttaaatatacctcagaaataatgttttaaaatcaaaaagaatgttttaaaatcaattttgtttaaaattctaagtaaaaaactttcactaatgttgttgtattactcaaaaatatcaaaaaatcgatttttattaaaattgaaaattattcaattttgacaaattttgaatttaatggaagaaaaaaaactaggattttgcaagaatatcatatttacttcgaattttattgttaaagaaaactatattttgaataattttgtcaaatatagaaatgtcagaaaaatattggaaattatgagttttgatactttaaaacattgtttaattgactctgtagatttcatttttcaatttattagtaaattttgatatttttatttggatggaaattcgaagattttgaactcaataaacattaatttttttcataataatgatattattatttattacttgattgtttttgtgtgtattgattcattttgtggaaattattattattttagtacataaaaatcattcattttaaatgtcgattttgacattaatattgtcgtttaaaaaattgtaaatttgattgaattcattgttacaacaatgttataaagtagttgtatcttaaattaataatttaaattaactttcttttgtcaatttagttcgtttgtaatctatttttgtgtcactttttgacattcaaataagacgttaataatgtcagttttaaatatacctcagaaataatgttttaaaatcaaaaagaatgttttaaaatcaattttgttcaaaattctaagtaaaaaatattcactaatgttgttgtattactcaaaaatatcaaaaaaatcgatttttattaaaattgaaaattactcaattttgaaaaaaaaaaaaaaaaaaaaaaaaaaaaaaactaggattttgcaagaatattttgtttacttcgaattgtattgtaaaaaaaaactatattttgaataattttgtcaaatatagaaatgtcaaaaaaatattggaaattatgagttttgatactttaaaacattgtttaattgactctgtagatttcatttttcaatttattagtaaattttgatatttttatttggatggaaattcgaagattttgaactcaataaacattaatttttttcataataatgatattattatttattaattgcttgtttttgtgtgtattgattcattttgtggaaattattattattttagtacataaaaatcattcattttaaatgtcgattttgacattaatattgtcgttaaattttatctatgtgttagttatttaaggttgtcgttattaatttttgttttaatctttaaattatttcaaattttttatttgaaatgtttagttgagaaaaaaattgtaaatttgattgaattcattgttacaacaatgttataaagtagttgtatcttaaattaataatttaaattaactttcttttgtcaatttagttcgtttgtaatctatttttgtgtcactttttgacattcaaataagacgttaataatgtcagttttaaatatacctcagaaataatgttttaaaaaaaaaaagaatgttttaaaatcaattttgttcaaaattctaagtaaaaaatattcactaatgttgttgtattactcaaaaaaaaaaaaaaaatcgatttttattaaaattgaaaaattactcaattttgacaaattttggatttaatggaagaaaaaaaaactaggattttgcaagaatattttgtttacttcgaattgtattgtctaaaaaaactatattttgaataattttgtcaaatatagaaatgtcaaaaaaatattggaaattatgagttttaatacttaaaaacattgtttaattgactctgtagatttcatttttcaatttattagtaaattttaaaatttttatttgaatggaaattcgaagattttgaactcaataaacattaattttttttcataataatgatattattatttattaattgcttgtttttgtgtgtattgattcattttgtggaaattattattattttagtacataaaaatcattcattttaaatgtcgattttgacattaatattgtcgttaaattttatctatgtgttagttatttaaggttgtcgttattaatttttgttttaatctttaaattatttcaaatttttcatttgaaatgattagttgagaaaaaattgtaaatttgattgaattcattgttacaacaatgttataaagtagttgtatcttaaattaataatttaaattaactttcttttgtcaatttagttcgtttgtaatctatttttgtgtcactttttgacattcaaataagacgttaataatgtcagtttaaatatacctcagaaataatgttttaaaatcaaaaagaatgttttaaaatcaattttgttcaaaattctaagtaaaaaaatattcactaatggtgttgtattactcaaaaatatcaaaaaatcgatttttattaaaattgaaaattactcaattttgacaaattttggatttaatggaagaaaaaaaactaggatttttgcaagaatattttgtttacttcgaattgtaaaaaaaaaaaaaactatattttgaataattttgtcaaatatagaaatgtcaaaaaaatattggaaattatgagttttaatacttaaaaacattgtttaattgactctgtagatttcatttttcaatttattagtaaattttaaaatttttatttgaatggaaattcgaagattttgaactcaataaacattaatttttttcataataatgatattattatttattaattgcttgtttttgcgtgtgttgattcattttgtgaaaattattattattttactatgtaaaaatcattcattttaaatgttgattttgacattaatattgtcgttaaattttatctatgtgttagttatttaaggttgtcgttattaatttttgttttaatccttaaattatttcaaatttttttcatttgagaatgattagttgagaaaaaattgtaaatttgattgaattcattgttacaacaatgttataaagtagttgtatcttaaattaatactttaaattaactttcttttgtcaatttagtgcgtttgtaatctatttttttgtcacttttgacattcaaataagacgttaataatgtcagttttaaatatacctcagaaataatgttttaaaatcaaaaagaatgttttaaaatcaattttgttcaaaaaaaaaaaaaaaaaatattcactaatgttgttgtattactcaaaaatatcaaaaaatcgatttttattaaaattgaaaattactcaattttgacaaattttggatttaatggaagaaaaaaaaactaggattttgcaagaatattttgtttacttcgaattgtattgtctaaaaaaactatattttgaataattttgtcaaatatacgagaatgtcagaaaaaatattggaaattatagagttttgatactttaaaacattgtttaattgactctgtagattcattttcaatttattaacgtacgtacgatattttatttggatagaggagatcgaagatttttgaactcaataaacattaatttttcataataataatattattatttattgcgggtgttttcgtgtgttgaattctgtttgtgaaaattattaatgtacgtaaaataaaatattaaatttaaatgtcggtacattaatattgtcattaattttatctatgtgttaattatttaaaggttgtcgttattaatttttgttttaatctttagtatgcttccatttttcatttgaaatgattagttgttaaaaaattgtaaatttgattgaattcattgttacaacaatgttataaagtagttgtatcttaaattaatactttaaattaactttcttttgtcaatttagttcgtttgtaatctatttttgtgtcacttttgacattcaaataggagcagattaataatgtcaaggctttaaatatacctctgaaataatgtctaaaaatcaaaagaatgttttaaaatcaattttaaaaaactatattttgaataattttgtcaaatatagaaatgtcagaaaaatattggaaattatgagttttgatactttaaaacattgtttaattgactctgtagatttcatttttcaatttattagtaaattttgatatttttatttggatggaaattcgaagatttttgaactcaataaacattaatttttttcataataatgatattattatttattaattgctttgttttgtgtgttattgtagttcatttgtgtggaaagtattattactctggctacataaaaatcattcatttgtaaactgccgattttgacagcattaatattgatcgattagatttttatctatgtgttagttatttaaggttgtcgttattaatttttgttttaatctttaaattatttcaattttttcatttgaaatgattagttgagaaaaaattgtaaatttgattgaattcattgttacaacaatgttataaagtagttgtatcttaaattaataatttaaattaactttctttgtcaatttagttcgtttgtactctatttttgtgtacactttttgacgattcaaaataagacgttaataatgtcagttttaaatatacctcagaaataatgttttaaaataaaaaagaatgttttaaaatcaattttgtttaaaattctaagtaaaaaactttcactaatgttgttgtattactcaaaaatatcaaaaaatcgatttttattaaaattgaaaattattcaattttgacaaattttgaatttaatggaagaaaaaaaactaggattttgcaagaatattttgtttacttcgaattgtattgtctaaaaaaactatattttgaataattttgtcaaatatagaaatgtcagaaaaaatattggaaagtatgagttttgatactttaaaacattgtttaattgactctgtagatttcatttttcaatttattagtaaattttgatatttttatttggatggaaattcgaagattttgaactcaataaacattaattttttcataataatgatattattatttattaattgcttgtttttgtgtgtattgattcattttgtggaaattattattattttagtacataaaaatcattcattttaaatgtcgattttgacattaatattgtcgttaaattttatctatgtgttagttatttaaggttgtcgttattaatttttgttttaatctttaaattatttcaaattttttatttgaaatgattatttgaaaaaaaattgtaaatttgattgaattcattgttacaacaatgttataaagtagttgtatcttaaattaataatttaaattaactttcttttgtcaatttagttcgtttgtaatctatttttgtgtcactttttgacattcaaataagacgttaataatgtcagttttaaatatacctcagaaataatgaaaaaaaaaaaaaaagaatgttttaaaatcaattttgttcaaaattctaagtaaaaaatattcactaatgttgttgtattactcaaaaatatcaaaaaaatcgatttttattaaaattgaaaattatcaattttgacaaattttgaatttaatggaagaaaaaaaactaggattttgcaagaatatcatatttacttcgaattttattgttaaagaaaactatattttgaataattttgtcaaatatagaaatgtcagaaaaatattggaaattattagttttaatactttaaaacattgtttaattgactctgtagatttcatttttcaatttattagtaaattttcaaatttttatttggatggaaattcgaagattttgaactcaataaacattaattttttttcataataatgatattattatttattaattgcttgtttttgtgtgtattgattcattttgtggaaattattattattttagtacataaaaatcattcattttaaatgtcgattttgacattaatattgtcgttaaattttatctatgtgttagttatttaaggttgtcgttattaatttttgttttaatctttaaattatttcaaatttttttaatttgagaatgattagttgagaaaaaaattgtaaatttgattgaattcattgttacaacaatgttataaagtagttgtatcttaaattaataatttaaattaactttcttttgtcaatttagttcgtttgtaatctatttttttgtcactttttgacattcaaataagacgttaataatgtcagttttaaatatacctcagaaataatgttttaaaatcaaatttttgttttaaaatcaattttgtttaaaattctaagtaaaaaatattcactaatgttgttgtattactcaaaaatatcaaaaaatcaaatttttattaaaattgcaaattattcaattttgacaaatttttgatttaatgcaagaaaaataattaggattgagcaggtatattttatttacatgaaatttttgaaattcttgaaataacaagaatcgaaaaaaaaaaaaaaaaatagggatgctttatttcgaaccagcggcgcaggatgttggatgcagcaatccctaccattgggctatcggaggagaaaattccccgaaattttttttaaatgtttttgataatcttgaaatttacaacaattttaaagttaaaagcagaagaacaagtgtaaatgccttgttcatgaccagaatataaaaaatatgaaaattttgaaattagtcaaaaatttgaataattcaaaatttcaagaaaaatcaaaattataatagaagaaagttcattaaaatgataatagatgaaattgttctattaaatatctgtttaatttcgaaaatatcaaaaagatcacaacaaaaaaaataaaaaaatttggaggtggcttatttcgaaccagcggcgcaggatgttggatgcgacaatccctaccattgggctatcggaggagaaaattccccgaaatttttttaggtatttaatatataaatcaaaaaaatttgaaaatgaaaaaaaattctcaaaatgaattttttcgaaaaatttttgttttcaaattcaaagtaaattacaaaaaattaaaaattttcaattacattaattttgattggtgcaagaatattaactaagttcaaagggattttatttacttaaaatttttttgatttaaagcaaaatttttgaaaatcttgaaatttacaagaattttaaatttaaaagcagagaaataagttcaaatgccttaattacgactagaatataaaaaatttaaattttttgaaattagtcaaaaatttgaataattcaaaaaaaaaaaaaaaatcaaaattataatagaaaaaagttcattaaaatgatgatagatgaaattattctattaaatatctgttttaatttcagaaaatgtcaaaagatttcaacatgtacgctaactgcaattaaggccaaaaaaaacaaattaaagaggaaatatggagagataaaacaaaaaaaagaaaattaaaaaaaaatatgaaaattgaaattttcaaaaattttgaaatttaatataataaataatagtaatcaacaacaataaatgattgttatatttaataatgaataaatttaattttaaattaaaatttttataataatcaaattttttgatttcaaaattttgaaagtataacagcaatataacaaggtttaataaagtgaagaagaattttaaataataggaaattgaagaataaaataacgagcgaccgttaagagaattaaaaaataataaataaataaaaaagtttaataaataaaaattaaaaataaaaattgatagtaaataaaatgaataaaataagatataaaatataaatttaaacaatattaaaagatttaaataatttttaaagtaattagatatcgatggaaaaaattaggaaaagagagaagagaaggaaagagaaaattagatgagaggtacaatttaaagcaattcattaaagatgttataatatataaaacatttaaaattttacaggttttatgacgaaaaattgaaatttttctctgaaactgaagtatctgtaatcagtaagtattattaaacaataagtcagtaagcaaagtaaataaaacaagagaagaaggaataaaaaaattttaagaaatactgacacttttcgtgtaaaccattcaaaaaattttcaatactttacaaaaataaagtttccaaaaacttaattgacaggtttatatttcaagcaaaaattagtgctcttgtctattaaaatttttacctataaaaatgaagtcgttttgccccttatgaggataacaagtaaaaaaattcaggaaaaaaataaacttaaaataattaaataaaaattaaataggagaaactctatattaattattctttattttttttctataaaaataataaaagaagctttataattttaaaagtaatttaggttaataaaaataatattaattaataaagaatttattaaaattatttttatttataatcagtggtaacaaattaaaaaaaaaatttattaaattatcaatttttgattatttatacttggttgatcctgccaaggaagcacactatggtcatagattaagccatgcaagtgtaagttcaggtaactaaactgcgaacagctcattaacacacttattatctacttggaaaagattttttaaagaaatcataaatggatagcagaagtaattcttgtgctaatacatgtttttaaaatttcattggaaattaaatacaatgataaattttacctttttattaaggaaatccaatcgaatgagtgacctatcaggccagtacttaggatcttttcctaattaagctattacgggtaacgggcggttaccgtcgtactgccggagaaggcgcctgagagatagcgactatatccacgggtagcagcaggcgcgaaacttacccactcgaaattctcggaggtggtaatgaccagttataatttttatttttaataataaaattatataggaatataattttccattatattggaacctagcagagggccagtctggtgccagcagctgcggtaattccagctctgcaagtttgctcccatattgttgcagttaaaacgctcgtagtctgaattaatattaagtaactttaaaaggttacgttcactgtgaacaaatcaggacgcttaaagtaaggataaatatacttgaatgattttgcgcagtatgaaatttttatttaactttcagtaaagttaaataagatcaaagagattcatcggggatagatctatttcatggcgaacggcgaaatgttttgacccatgagagagaaactaaggcgaaagcatctatcaagtggacttctatcgatcaagggcgagagtaggagtatccaaccggatcagagacccgggtagttcctaccttaaactatgccgacgagggcttatttttttattttagaagtaggaccattagagaaatcaatagttcatgggctctgggggaactacgaccgcaaggctgaaacttgaaggaattgacggaagggcacaccaggggtggagcttgtggcttaatttgaatcaacacggggaaacttaccagaaccagatatttttaatgactgatcaggatgaagttctttcaggatataatttttggtggtgcatggccgttggtggtgcgtgggttgacctgtctagcgttgattcagataacgagcgagattattaccaattaaataattaataatatttttaaatattatttttaatttctaattgggactccctgcgtctaagcaggaggaagaggatagcaataacaggtccgtgatgtcctttagatgctctgggctgcacgcgcgctacaatgttaaaaacaataagaataatttaaagctaatttgaaaagatcatttttttaaaatgaaaagctactcttgtaatttttaacgtagttgggattgatgattgtaatcattatcatgaaccaggaatcccttgtaaaagtgtgtcaacaacgcacgttgaatacgtccctgccctttgtacacaccgcccgtcgctcctaccgattggatgactcggtgaaatcattggattttttttatataaaagaaggtgattaaatcacgttatctagaggaaggagaagtcgtaacaaggtaacggtaggtgaacctgccgttggatcagtttagtaaataaaatttaaacaataattttaaaaaaaaaaaaaaataatatacaaaattaattttcaatcattaattaaaccttaaacaacggatgtcttggctctttacacgaagaagaacattgcataatgtgataagcgactagattagctcaatttgtgataagttcgatctttgaatgcatattgcgtatttattaatttattaataaatacatatataatttagtaacaaataataattaattaatcattttaaataaaaaatgagaaactattttaagctttttttaattgttctaaattatataggaaaacccgctgaactgaagcatctcaataagcggaggaaaataaactaactaggatactcttagtaagtgcgaccgaagagagtaaagctcgataatttaaaatctatttttagattaatgtaatttattaaacttattaattaaaatattaaactattgattaaatacatggctataaagagtttaagcctcgttacaattattttaattaagcataggtttaaataaaggagtcggatagcttgagaatgctatcttaaaataggtagtacatcctatctaaagctaaatattgtaaagagaccgatagtatacaagtagtgtgaacgaaagatgaaaagaactcctgaacggagagttaatagcgcctgaacttgtttagggtaaggtatttcattaatacacccgtcttgaaacacggattagggagtttgactataatacgagtatttaattattaaaatttaaatgcgaaaagaaattaactgctctttttttttggagatggctatagagtattattgtcaaaacccgaatggaggtgaactatgcctgtacagattgaagtcaggggaaactctgatggaagatcgtccgcgttattgatgtgcaaatcatttgcttgatatgggtataggtgcgaaagactcatcgaacctcctaatagctggtttcctccgaattttccctaaggatagctgtaatatttattaatagttaaggagagtagagaaatgggtagaggtgtagtggaactccggttctgcaacttatttccaaacttcgaaccttcttaaaatgaataatttttctaatagaaattaatcattaaagaatatatattacaagtgggctcttaccggtaagcggttatggcgaaaaagggatgaacctaacgtatagataaagtgcctaaatttactattaatgaaaccattaagagagtccatgtatttagacagcgggtcggtgcccctaaaagcaggtatccgttaatgagtgtgttaaaactcccccgccgaatactctggcctcgaaaatgaatggcgcatatagtaattactgatactatacaaataatttttaaataattatttagtagggggatgtgaataactttaagaatttttaaatgtaaatttaaattaaaagttatttattacaaatcctaattgaagtagcgattatccaggttaaaatcctgggggctgatgaggagtagggtttctgggcaacttaaatagacccagagttagtcgaacctaatttcaataaagaaagaaagggaatatgaatgatatttcataactaaaaaaatttttttaataaatagtggtaacacaaatttaaaaaattatcaatattaattaaatactgtaaataatagggatttctttcctatataactttaattatttcctaagaatcaaatcaattggagaatagttgaaataatttagtaaaacttaaaattcgttttaagttacggctatttaattaatccttgaaaagataattttaaactaaaaaatttttactcgtaccgataaccgcatcaggtcttcaaggtaagtagcttctggccattaagttataataatttagggaattcggccaattagagctgtaacttcgggataaagcttggctctgatggaaatcagaaccgatagttacaaggagagcccaactgtttaataaaaacttagtaattatgtaattactaataaaagtattaaacataatatgaatcctgctcagtgctgtgtttgttaacttggaaaaattcaattaagcgccggtaaatagctggggtaactatgactcttatcaaagtagcgaaatacctcgtcacttaattagtgacctgcatgaacggagctatgaggttctcactgtcccaaattattacttagcgaaccaacagttgtgggaacgggcacaaattatccagcgggggaaagaagaccctgtagagcttcactttggtctaattttgtatagtttcgttaggggtgcagactaggtgggacatttaataaatggattatgagaaaccactaccctttctggaattatacttactttttaattaaaaggatagaattagatagaaagtttggctggggcggcacaccttcgaaaaaagcagcgaaggtgtcctaagttaagctcagtaaggacagaaatcttacgttgaggataaggccaaaagcttaatttactgtgtctttttgtactagaatcagttatgaaagtaaggcctaacgatccctaattagtcttaggtatgtaagacttggggtgacagacaagttacctccgggacaactggcttgtggctgctaagagatcaaatcaacgcagctttttgattcttcgatgtcggctcttcctatcctagtgatgtataagtcactaagggttggattgttcacccgtattagggatcgtgagctgggtttagaccgtcgtgagccaggtttgtttttatcctactggatatttatattaagtatcatgttagtagtttgatttagtacgagaggaactgttgattatggtctctggttaaggaattttaggaaactaaatgttccaaagctacgccatctgagataatggctgaaggcctcttaagccagaaactcttctaaaaattgatactttaaaactattttaaaattatgagataaaattaatatatttttaaataaaaatctctttagttttaatgaccaaatgtagaagacattttgtcaactagggtcctgtaagtgtaagagtggcatttagtcacgattcactgagggtcagcctaagttgtatggttattataatgtaatttaaaaaaaaatttttttcaatttttttttgcttatttttgtccgaccaaataaaaattcaaaatattttgtatactttatcattataatgaattattcttaatactattttttcatcaattttgacagaattcaattgttatttggtcaaaaatacaaaataaactatttaaaaagtctagttttttacattaatggggtgctgcacagcaaaaatcatcaaaattttcgattttttttaaattgcatttttaaacttattaactaatgacattcattctttcttatgatcattttgcttaatttttgatttttattgaaatattctaattattaataattaattctaatttttaaa

(The sequence listing continues in the following parts.)

---

We claim:

1. A *Histomonas meleagridis* strain having all of the following attenuating features:

(a) an inactivation of a gene, wherein the gene has the sequence identified by SEQ ID NO: 1 or a sequence with at least 90% sequence identity thereto, (b) an inactivation of a gene, wherein the gene has the sequence identified by SEQ ID NO: 2 or a sequence with at least 90% sequence identity thereto, (c) a truncating mutation in the coding sequence of a gene, wherein the gene has the unmutated coding sequence identified by SEQ ID NO: 3 or an unmutated coding sequence with at least 95% sequence identity thereto, and (d) a truncating mutation in the coding sequence of a gene, wherein the gene has the unmutated coding sequence identified by SEQ ID NO: 4 or an unmutated coding sequence with at least 95% sequence identity thereto.

2. The strain of claim 1, wherein at least one attenuating feature is a homozygous feature.

3. The strain of claim 1, wherein the inactivation of the gene is a deletion.

4. The strain of claim 1, wherein the truncating mutation is a frameshift mutation or a point mutation leading to a premature stop codon.

5. The strain of claim 1, wherein the gene with the truncating mutation of attenuating feature (c) has the coding sequence identified by SEQ ID NO: 5 or a coding sequence with at least 95% sequence identity thereto.

6. The strain of claim 1, wherein the gene with the truncating mutation of attenuating feature (d) has the coding sequence identified by SEQ ID NO: 6 or a coding sequence with at least 95% _sequence identity thereto.

7. The strain of claim 1, wherein the strain has attenuating feature (a), wherein a genomic PCR of the strain with forward primer AGGATGTTTCAATTTCCTCGC (SEQ ID NO: 7) and reverse primer CGGTTGTCCATTTTT-CAAACAG (SEQ ID NO: 8) does not yield a product.

8. The strain of claim 1, wherein the strain has attenuating feature (b), wherein a genomic PCR of the strain with forward primer GCGGGAAAACAAACGAAAC (SEQ ID NO: 9) and reverse primer ATAGCCATTGGTCCTGGTC (SEQ ID NO: 10) yields a product with a size between 850 bp to 950 bp comprising the sequence identified by SEQ ID NO: 15 or a sequence with at least 90% sequence identity thereto.

9. The strain of claim 1, wherein the strain has attenuating feature (c), wherein a genomic PCR of the strain with forward primer TTGATTATGGGGCAACAGAAG (SEQ ID NO: 11) and reverse primer TTGGCGAAGTCTTT-CAAGAG (SEQ ID NO: 12) yields a product with a size between 450 bp to 550 bp comprising the sequence identified by SEQ ID NO: 16.

10. The strain of claim 1, wherein the strain has attenuating feature (d), wherein a genomic PCR of the strain with forward primer AAATGTTATCCATCGTGACCTC (SEQ ID NO: 13) and reverse primer GATAGCCTTCTTTGGCTTCC (SEQ ID NO: 14) yields a product with a size between 350 bp to 450 bp comprising the sequence identified by SEQ ID NO: 17.

11. A *Histomonas meleagridis* strain having four attenuating features verifiable by:

(a) a genomic PCR of the strain with forward primer AGGATGTTTCAATTTCCTCGC (SEQ ID NO: 7) and reverse primer CGGTTGTCCATTTTT-CAAACAG ((SEQ ID NO: 8) not yielding a product, (b) a genomic PCR of the strain with forward primer GCGGGAAAACAAACGAAAC (SEQ ID NO: 9) and reverse primer ATAGCCATTGGTCCTGGTC (SEQ ID NO: 10) yielding a product with a size between 850 bp to 950 bp comprising the sequence identified by SEQ ID NO: 15 or a sequence with at least 90% sequence identity thereto, (c) a genomic PCR of the strain with forward primer TTGATTATGGGGCAACAGAAG (SEQ ID NO: 11) and reverse primer TTGGCGAAGTCTTTCAAGAG (SEQ ID NO: 12) yielding a product with a size between 450 bp to 550 bp comprising the sequence identified by SEQ ID NO: 16, or (d) a genomic PCR of the strain with forward primer AAATGTTATCCATCGTGACCTC (SEQ ID NO: 13) and reverse primer GATAGCCTTCTTTGGCTTCC (SEQ ID NO: 14) yielding a product with a size between 350 bp to 450 bp comprising the sequence identified by SEQ ID NO: 17.

12. A method of attenuating *Histomonas meleagridis*, comprising the steps of obtaining *Histomonas meleagridis* cells; and introducing at least all of the following attenuating features:

(a) an inactivation of a gene, wherein the gene has the sequence identified by SEQ ID NO: 1 or a sequence with at least 90% sequence identity thereto, (b) an inactivation of a gene, wherein the gene has the sequence identified by SEQ ID NO: 2 or a sequence with at least 90% sequence identity thereto, (c) a truncating mutation in the coding sequence of a gene, wherein the gene has the unmutated coding sequence identified by SEQ ID NO: 3 or an unmutated coding sequence with at least 95% sequence identity thereto, and (d) a truncating mutation in the coding sequence of a gene, wherein the gene has the unmutated coding sequence identified by SEQ ID NO: 4 or an unmutated coding sequence with at least 95% sequence identity thereto, into at least one of the *Histomonas meleagridis* cells.

13. A *Histomonas meleagridis* cell, obtainable by the method of claim 12.

14. A vaccine comprising cells of the strain of claim 1, wherein the cells are live or inactivated, and at least one pharmaceutically acceptable excipient.

15. The vaccine of claim 14, wherein the vaccine is further defined as a live vaccine.

16. The vaccine of claim 14, wherein the vaccine is formulated as a gel.

17. The vaccine of claim 14, wherein the vaccine is suitable for prevention of histomonosis.

18. The method of claim 12, wherein the method produces the *Histomonas meleagridis* of claim 1.

19. The strain of claim 3, wherein the inactivation deletion of the gene is a full deletion of the gene.

* * * * *